United States Patent 10,724,096 (METHODS AND COMPOSITIONS FOR INHIBITING AND TREATING NEUROLOGICAL CONDITIONS) - sequence listing, part 125

SEQ ID NO: 2315 - DNA, 315943 bp, Homo sapiens
catggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcgtgaccctccccattccctggcagcctcgagttctgtctctctccgtctgtttcactctctccccttgtcagtatccacttcctccagctgaggggccttgtctcactattgggaaacgctctgcagatgtcaaggcttaagacaggagctcccgcccccacccctgtggtcaaggagggccaggatcggggtgagcagccaaagcgaggggggagtgtggaggcagtgctgctgtgtttgaggacagtgttcatctcttgacaggcttataaaacacatcttgagttacattcagtccataaaaatcttcctatgctatgggtgtctgactttgtctttcacaacttagaattatttttaactctttaatttctttgggactttcccaggtagaaaatcttcaaccatactggaccgaaaacagattctgatttataatacgagtgttggagtgaacgtcaaaacgtccaaggtcattttgacctttcttaaaacagataattactagcctacctgtagccaccgatgtggctcatttcccacatccaaagagagaaatgagttagtttgaatgactgttattcttaaaatacgtgtacgggaccaggcgttagtctcacttagggcgctggtgaagattcattcagtagctagtgttcttttatcatggaggagtttggagtttttcaaacgttatttgtggctttatgcataacttactttgactttatcagtcaatgcatcgcagtatgggaatgatttagccctctgtggaaatgcagtggctttttagaacaattaagcaggttattttaagagagaacaacatgttttccaaaacaataacttggtggaaacaaatagcaagagtgtttggcagacgttttttggatgtgctacaggctttcctcccttgttgcttatttttattgacaaacatccctaatgtgtgtcatgtctttctctgtctctccccttccctctctttttttctcaaattatgtaacttttgaggacagttacttctgtgataaactcttcaagtaagaccgttataagatagatttggaaattaaagccccagttgcatttcagtaactcatttcagttatttcgtctgttctgtggttctttttgcctagtttatgattataaaacaaaatattaaatttatgtcaggcatatattgtgagatcgtttggaatgaactgatagtagcacatactcatccttttcaaccagctttcagttttctacattagtttggagtgatatgaaagaatgatctgtttcacctgcgcacaaacaagtaaggacagtgatgttagcttctgggaagttcaagtgtataacctgagctttagaagtgaatttccttttttgatttaattcattttcacttcgaataaaatgaaattttgaggagactttttgaaaatttgaaggctcttttgtattaatagatgtgatactacgatctgagacggtttgaaattgctttgcagtaatagtttcttttacagaaagtcttaacatctcttgaacaaccgatatacagtcatgcagtccatgcttaaggactacgactgggataccttgttagaaatgtgtccttaggcattttcattgtgcaaacatcatggagtgtagttacacaaacctaggttgtgtagcctgctacacctactacctaagctatatggtatagtctattgctcctaggctacaaataatgttactaggctacaaggcgtgttactatacccaatactgtagacagttgtggcacagtggtatttgtgtatctaaatatatctaaacattggaaaggtaatgtgttatgttactatggctatgacatcactaggcgataggaatttttcagcttctttataatcttacgggaccattgtagtgtatgtggttagttgttgaccaaaacacaagtgtgagcactgggatcactaatacctgggttcaaaactctgtaggatctcaggaaagttgctaggcctctctttgccttcagtttgcccatctgtaaaatggagctgatactaggaccttttaggttttgggagaatcgaaagagataatgcctaacaagctaacatttgcccacagtgtttggtcaatgataagaacttaatgaatatctgttgttattattaataataaatattgcatcatggattaaaaggatttccagtgcctaccacaatgtatgaaatatagtatatacttaataaatagttggggaacaaaataattttgcaggttcataattgcagaagtaaaatagaaactaaagaagtaagtctatcaagtcaataagcattctaatattgttagatattcttgggtggaaagctttttatttgaaaagtgccaagtaagtaaagtctgtatttgagttttcaattattgtgaatttgggtgtgctatttttctatttacaattgacttaaaataggtacaggtttccaatttaaatcaggataaataagattatctgcctttaagtattcagagtgcaaattggtgattataatgcttggaatttgtttccagagagactgtcctgggggcaagttaatctttaatgagttgtatttttattagtagataaattcttctacgcaatggaccaaaaattcagtgaggttaatatatgggcaatagggtagtagtcaaataaatgaaataccattcttagatgatcattaaaacttaaaagaattgttgcagataaaaaccaccaggccaacaatgtagggaaatatcactcttttttcatggttttttactggcaggttggggtctaattactacttcgaaacaaccatgcagagtatctgatgtttttgctgtaagtgaagattatcagttttattagtttacagttttataaatggaaatttattttcaagtttaggtttttgatgggtgtggtaagtcttggaatgaataccatagacagcatttttaatgataaagaaaatccttatataatttctttatttaatactgatcttcaaatgtaaatttcatgcatcatgtgaaataatagtattgatttatgtaagccaattaaattttagttaaattaactcaaagttataagttacatatcataactcacattaactcaactgagttatcagggaggaaagggaggagagtgttatagcaggaagtctgggagaaagtaagaaataattgagtcaagagaatcagagatacagtcttggtgtttgccagagtactgaggcaatcacaggattcctatattaatacttttcttttttaaagtatttttctttgtaaaaacatatatgtgtactataaaattaaaaattcccatatataacacagcacttcaaattattatttaaaaaaaatttcccatataaaattcagaagcataggtattttcaaagtttgggaatcccttctttcagtagagaaaatggtaagtgttaaaaagtgggacctgtggtggggaggaatggcctattttcatgaaaggagattgacatctggtgggattttatgatactgctgccaaagactttaagaaccatgttgcatttttgcagtgataggcagaactggggtcatttgctactgctcggttgagtagcagagttagccactgaaacagaggttgttgtacatcattgattaacagtaggagcagcaactatgttatctctttaattcagcaaactttagtggatttttaaaatgatttgatgaacagataataatttagacttttttcatgagagcgggaagaaatatgaagccaaaaatgtgtgaaaatgggggagtactgaaagtgaagataaagagtaaagcttaaataaacagagttttctagctaatgcttgatcaaggctaataaacagcaaaaacaaatcaaatacatttatgagcttagagattaatagcacagggctgtgggccaaatctagatttgaatcttgatgctacattttaatagggagcttgggagaatccatcacttggcgacctcatttctcaaatggggcagttaatggtagtacttacctcctgaggtagttttgaaaatgaagaggaaaaaggtgtatgtaagtcatcccagtgctggcaacataggaagtgctgaataagctaataacaatattcacagtaaatcattatgtataaaatgcactttcttatattgatcatgaaaatcaagtatattggaaactttagtttggtcttaaattatcttacgattaatgaacatgcacagctatctaaatattattattggcctccctggtagcttgccatgtgttgagtatacttgtaaaggtgggtgggtaaatactaagtaaagctccattagacatgagtgtggagttctagattttgctcaggacgagagggcttttcaccctttttagttgtaaattgttcttgctttgagtatttttcattatttgactggtcctgagccattcatttctagtatggtttactaaagactagcagcgaaatcagttaatctctcttctggttgtaagttgctctgaatttgagtcattcattggtgtgtagaaagaaggttttttgaagaaaatactctgcctgggttaacatgtttcatttgctcacctgtaaaatggggataataatagtcctactttacggtgatattgtgaatgctgagtgtgagaatgtatgtaatatgcttagttcagtgccaggttgatggtgcttaataaacatcagttcagatgcagcagtactgtctcacatgatggataaagatttcaaaacactagaaagcaaatacttgccaagtctttttttcttttttcttctaattgcatgtgaatcctttgtgtatgtgtgtgttgggggggggggggtgtgtttgatgtgttttagtgaaagtcttcctcaaaaaattagaaaagtttgttatgacaatttatttgatccagagagcatagttgcaattaaaattgctttatagattaagtgaaaaaacacatcagaggttgtatagcttggcagtaaagagcccaggagctgctttcagactaacttggattgaggaggtcctcactttgcttctcgtagagttccgtgaggatgcactgagaggggcagtaaaacctcacgctcacgggcatggagcaagcactctcagtcacttatctctatgaagacttggagggttttggtgaagttgatcattgataaatacatagctagagaggtttgttataccaatgacttttacaggcaagaatgtatttggctgcgactaacaggaaacctgacacagagtggcttaaacaagccaggggtttgtccttctcacctaatgagaagtctggggctaagcagtccaggctccaagagctgctcaagggcatcaggagccccgtgtcttccctcttccctgcctccaccatcttcagcctgtggctttttgccttatttttgcactgtggctgtggctgtgttttgaggtgtgtctggtttatgcaggaaaaaggcggaagaagaaaaattattttctcttagagattttgcatttttatgtgacaaagaattctctctcctggaacttctgtctgtacttctttggccaccttttgctgcaaaagactctgggaatgtatcttctttttccagcctcactagtggaagtaggcaaagaagaagggggtcagaatggatgctgaatgttttaccccatattttcctcacagtgggcaaagtggaggagcattaggactcaaaattgcaaattgtgactgaagtcaaagcttacctgtattggagactttggactgtgctgataatctgtaggaacttatgttattcagtaacattatatatcagtagaatttctttctttcctttttttaaattataattttttttcatcaggcagcccctgaaccagaataggttctgagaggctccctagaatttctttcttggcatagtccagaagtaaacctaaataccaaagaggaaaccaactctgatcatctaaagctcttctcatcttgttactccttttatgaacagaatctaggaccactgagtactggaactatctctaaaaattctccattgttttctccatgtcaaatgtttttttttccatagaaaattacatggtacaataaaaatgcttatttcactttttattatcttaagatatcttttctgtcctccctcctcccactgtccacacatgtcagatttggtttagaattgacaggttcagtgtagttcatgcctcgcccttttggcttttcatagattggtcacttaggtataatctggccaacaaagccagaatttgttcagaaccgttttggagacagtttgatagaattatcatcccatgttttgtcgtctgaaattgtccaaaatagtgagctaataaaatagaccagttgactcattcttagttcgttttaagatactgttcttacttaaaaaatacatagggtaatagtgaccacatatattcctttatatgaaatatttaataaactaccaggaatgaggcgcaattttattgctaatttatagtggttttggtgtgtggggatgatcttggcaagaaaatcttgttatgctgcaaaagccaccaaattcaatgtctaatccttatcgtactaccatctagggcagtctccagagagcacaaaaccatcatagaagcattgtgggtgctatacatttgtaaatccttttcctacctatcaggctactaatagctgtggatgatgaaaatgtttgtatttgtaacaagtattaaatcttgttcccatttatgatgctggcatataaaaagataacactttctaggtatcaggtggtttccctgttatagtgagaatgataaaccacatattagtctgcatattgagttgatctggagcttaactgtatctcttatatagaaaggtgattaaacataggatttgaaaattagccattgctgttttttccccctcgattttaaaagtaatacaaacctatatagaatacttgaaagtataaacataagtaaaaaagaaaaaccaagtcatccctaactccagaatccagcaataaccactgatgatattttaggaatttttttcctggtcttttgaaaatatgcccacacataatttatttttgccatgcattttgagtttgtaccatatgtcaggtgcagtgttgagctttggggatgcagatgaaaccaaaagagttactggccctacccttctgtgacttaaattctacactgggatcatacctcctatctttttcacttagcgttgaatcataagtattttctgtttcattaaaggttcttgaagaacatggtttccggtgtctgtataattcttttgttgtagtatactttgtttaaacactacaacattttagaatatttttaggtggctagacagtggaatgagtccagtgtttctactcaaactgcccgggattcagatcctgattattagccatgtggcctgggacaaattaataactcatttggcttctcatctctaaaatggagataaaaagtatctatcttctaggttgtgaggattagaaatactgtatccacaagtgccaggtgcggagcaggtactcaagatatggcagatgataaatatttagcccgctgtcccaaccacttctgcctaaaagccttttatgcattttttattattctcataggaaaaaccttattagtgaaattttggggagcaaaggacatggaaattttaaggttcctgatcaattttgcaaaattattttctgggaagttttgcaggttaggcagaagagacaacaaatctgcagggtaatctgctccttatacctgcggttcccacagtccattattagaaagcaattgaattaccaatataaagttagatctccgttttgcctttttttgctgaaaaattgaagtgaattttatcttacctgcttagcatgtttgtggatcagtattttttaaaagttgtgggcatgaaaatcagccagggaatgtggtgttttttttttttttttttttttttttttttttttttttgagggagtacactttggccttccctctcagattccaactttgtaggtttgagagtggtgttggcaggattggcattttggaaagaatcttttgtgagtctaatggagatggtcccaggatcacactttgagaaacattgcaaggtggttagaggatggtgaaatcattgaagttaagaatcagactcttttctttctttgatttcctttacccttgaagctagtactttttccacattattaaaccatcttgaagcattttagtctgggaacataatttataactggtatgttgtttatagtggcttgttgtaagggacttgggggaggagcacaaatctatatattcttgcggagggcaatattgtcatattgcacagtaggctcacaatgcatttggttttcctgcagactcccattaagttaggcataatagatacctatgtaatatattatgaaataatttaaaaacacacttttcattgtagaaatttttaaagcaatacactccttagcaaatgtaaaagaacagaaattataacaaactgtctctcagaccacagtgcaatcaaactagaactcaggattaagaaactccctcaaaaccgctcaactacttggaaactgaacaacctgctcctgaatgactactgggtacataatgaaatgaaggcagaaataaacatgttctttgaaaccaacgacaacaaagacacaacataccagaatctctgggatacattcaaagcagtgtgtagagggaaatttataggactaaatgcccacaagagaaagcaggaaagatctaaaattgataccctaacatcacaattaaaagaactagagaaacgagcaaacacattcaaaagctagcagaaggcaagaaatagctaagatcagaggagaactgaaggaaatagagacacaaaaaacccttcaaaaaatcagtgaatccaggagctggttttttgaaaagaccaacaaaatggatagaccgttagcaagactaataaagaagaaaagagagaagaatcaaatggacacaataaaaaatgataaaggggatatcaccatcgatcccacagaactacagactaccatcagagaatactataaacacctctatgcaaataaactagaaaatctagaagaaatggattaattcctcgacatatacaccctcccaagactaaaccaggaagaagttgaatctctgaatagaccaataacaggctctgaaattgaggcaataattaatagcttaccaaccaaaaaaagtccagaaccagatagattcacagctgaattctaccagaggtacaaggaggagctggtaccattccttctgaaactattccaatcaatagaaaaagagggaatcctccctaactcattttatgaggccagcatcatcctgataccaaagcctggcagagcacaacaaaaaaagggaattttagaccaatatccctgatgaacatcgatgcaaaaatcctcaataaaatactgacaaaccgaatccagcagcacatcaaaaagcttatccaccacgatcaagttggcttcatccctgggattcaaggctggtttaacatacgcaaatcaataaacgtaatccaacgtataaacagaaccaacgacaaaaaccatatgattatctcaatagatgcagaaaaggcctttgacaaaattcaacaaagcttcatgctaaaaactctcaataaattaggtattgatgggacgtatctcaaaataataagagctatctatgacaaacccacagccagtatcatattgaatgggcaaaaactggaagcattccctttgaaaactggcacaagacagggatgccctctctcaccactcctattcaacatagtgttggaagttctggccagggcaatcaggcaggagaaagaaagaaagggtattcaattaggaaaagaggaagtcaaattgaccctgtttgcagatgacatgattgtatatctagaaaaccccatcgtctcagcccaaaatctccttaagctgatagacaacttcagcaaagtcttaggatacaaaatgaatgtgcaaaaatcacaagcattcttatacaccaataacagacaaacagccacatcatgagtgaactcccattcacaattgcttcaaagagaatgaaatacctaggaatccaacgtacaagggatgtgaaggacctcttcaaggagaactacaaaccactgctcaatgaaataaaagaggatacaaacaaatggaagaacattccatgctcatgggtaggaagactcaatattgtgaaaatggccatactgcccaaggtaatttatagattcaatgccatccccatcaagctaccaatgactttcttcacagaattggaaaaaactactttaaagttcatatggaaccaaaaaaagcccgcattgccaagtcaatcctaagccaaaagaacaaagctggaggcaccacgctacctgacttcaaactatactacaaggctacagtaaccaaaacagcatggtactgataccaaaacagagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttaattcaagattgatcaaaaattaattcaagattgattaaagacttaaatattagacctaaaaccataaaaaccctagaagaaaacctaggcattaccattcaggacatatgcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggaaaaaatttttgcaatctactcatctcccaaagggctaatatccagaacctacaatgaactccaacaaatttacaagaaaaaatcaaacaaccccatcaacaagtgggcgaaggatatgaacaaacacttctcaaaagaagacacttttgcagccaacagacacatgaaaaaatgctcatcatcactggccatcagagaaatgcaaatcaaaaccacaatgagataccatctcacagcagttagaatggcagtcattaaaaagtcaggaaacaacaggtgctggagaggatgtggagaaataggaacacttttacactgttggtggtactgtaagctagttcaaccattgtggaagtcagtgtggcaattcctcagggatctagaactagaaataccatttgacccagcaatcccattactgggtatatacccaaaggattataaatcatgctgctataaagataacatgcacatgtatgtttattgtggcactattcacaatagcaaagacttggaaccaacccaaatgtccatcaatgatagactgaattaagaaaatgtggcacatatacaccatggaatactatgcagccataaaaaaggatgagttcatctccttggtagggcatggatgaagcgggaaaccatcattctcagcaaactatcgcaaggacagaaaaccaaacaccgcatgttctcactcataggtgggaattgaacaatgagaacacgtggacacaggaaggggaatatcacacactggggcctgttgtggggtggggggaggggggagggatagcattaggacatatacctaatgttaaataatgagttaatgggtgcagcacaccaacatggcacatgtatacatatgtaactaacctgcacgttgtgtacatgtaccctaaaactttaataataaaaaaaattttttaaagcaatacaaggaagctttttaaaaagaaaaataatcgtcagtaatctcaccatcctaacaaccattttcatttttctgccttgaattagagtttatgtagttgctggtatagtatttactgctttgtattcagtattttaatctattaaatgttttctgtatttctaagcagttttcagaattctgtggttgaataatagtacatttggttgaaaaaaattttttatagttatgaactacctaataacgaatgtgattacatggcttttttttcttcgtgactgtattctgaggaagaaatttgaggaatctgagtactgaagaatgatggtagttgcaaaagcagcagccaatttgtattatctcttactttgtgtgggacattgtctttggtgatttatgcctgtgcggtcatctcagcttctcagcaacaactcatgacatacagatgcccattgggatctgtactttacagagaaaaaaaaaagctgtaaacactttaaatttggagccctgatttctttttggaattccaagtagacctagacactagttttccaattagggttgttgtaaggtctagacttttgtatgttgtggagatgtatcatagctgagtttaggatgacaaaccaccctcccgaataggttacattgtttctttctttttttcttaattatactttaacttctagggtacatgtgaacaacctgcaggtttgttacatatgtatacatgtgtcatgttggtgtgctgcacccattaactcatcacatgtgtcatattggtgtgctgcacccattaactcatcatttacattaggtgtatctcctaatgctatccctccctgctccccccaccccacgacaggacccagtgtgtgatgttccccaccctgtgtccaagtgttctcattgttcaattcccacctaagagtgagaacatgcggtgtttggttttctgtccttgcgatagtttgctgagaatgatggtttcccgcttcatccatgccctaccaaggacatgaactcatccttttttatggctgcatagtattccatggtgtatatgtgccacattttcttaattcagtctatcattgatggacatttgggttggttccaagtctttgctattgtgaatagtgccacaataaacatacatgtgcatgtatctttatagcagcatgatttataatcctttgggtatatacccagtaatgggattgctgggtcaaatggtatttctagttctagatccttgaggaatcaccacactgtcttccacaatggttgaactagtttacagtaccaccaacggtttaaaagtgttcctatttctccacatcctccccagcacctgttgtttcctgactttttaatgattgccattctaactggtgtgagatggtatctcattgtggttttgatttgcatttctctgatggccagtgatgatgaacattttttcatgtgttttttggctgcataaatgtcttttgagaagtgtctgttcatatgcttggcccactttttgatggggttgattttttcctgtaaatttgtttaagttctttgtagattctggatattagccctttgtcagatgggtagattgtaaaaattttctcctattctgtacgttgcctgttcactctgatggtagtttcttttgctgtgcagaagctctttagtttaattagatcccatttgtcaaatttggcttttgttgccattgctttttgtgtttttagtcgtgaagtccttgcccatgcctgtgtcctgaatagtattgtctaggttttcttctaggctttttatggttttaggtctaacatttaagtctttaatccatcttgagttagtttttgtataaggtgtaaggaagggatccggtttcagctttctacatacggctagccagttttcccagcaccatttattaaatagggaatcctttccccatttcttgtttttgccaggtttgtcatagaccagatggttgtagatatagaccaatggaacagaacagagccttcagaaataataccacacatctacattgcttcttgagtgccctgctgaaatgcagaggagcttggtgtcaggctcgggtgggttagaattctcagtgagaatgcaggtgttgcaaagctctgccttctactagctttggttatgctttctcagtttctccctttacaaaacagaataataatatgtctcatgtagggttatgataacatttgtaaggctggcacacaattggtgccctgtaaatagttggtatttttcaaattcatattctgttcctctgtggcatctggcccagagctgtgaaaatatctggactgtgtttatagaataaatgacccatgatggatctggattaaaaagtttgttcattttgggctagcggacctggcattgacctcatggaatggagctttaaagcaaagtcacgtgcttggccttaggaagtgccaaacagttctgccttacccaagtaaggcagagcagttctccatatgcaagatgatctgtcttcaccctcaatctaggccgtatgtagaatgttttactgttagtgatagaacattagtgtggagttttgaatgaggatatgcaaaacttaattcaagcgaggttaatgttaattatatttgtatctaatctggattagttttataaatcgaaatttgtcaaggttaatataatttcagtttatttcattgccgacactgaattatcttgttcttagaataatatatctctagatacttgtttaaatgtgatttcaaatcttctcagataagagataatccattctcaaaattaagaataaccttttatgttagcttgctcactgcactaaaattatcattgagttattttgagttagagggaaataaaccacttctccccacaaaatgttgattaggaattaggtgccctgagttcatgacccagtcttgccactgacttcgccaccttggacagcctctcagggttttggattagatgccccttaaaatctctttcagttccagtattccgggtcttctgcacagtaaacaatacaaacccaatggtactttgaacgtggtgttagaagctgagttggttctccatacatgagtagctttggtagggatttgccttgatctttaccacacctgagcattcacagcaaatgggaaatgtggtagaaagagaggatagttaaagtgtctcggctttggagaagcaagtacttgtcagagagctaaccacaagctttgttttctaacatcttggcagtcaaatttgcaacaccctgaattctgtgggctagagcttagctaatttaagattttctatggtaattgagcagagattacagtgtaaatcatagttgagacttgttggtgttaacatacttgtctaggtgaacaacagattttatgcgtcttcaagtaggatctttttgtcacattttccttttcctctgctaacatgtccagctatcaagcttcatgtgccagtattgatatctagcatctaaaccactagagttgcagggcaggaaaatgtaatgttgtgccttagggtaaaatttcaataaaaaatacatctgtatctgtccagatttcaagtattttcagaattgttttaattgcttgttgattattgagaactaacacagtatttctcttattctgcgcagaagaccactaaatcttgtattatctatgttctgagttgatccctttatcatgagctttttcttttgtttgttaaaagcatcacttaaagcaaaggcaatgttttggtaagattttatcttttttagttatttcatataatgatttaacttcaagccagagaaatgtgtgtttggcttgagtcttgcaggaggaatcatgtaaagacatgtttattttaatctggggggaattttttttaattagaactttttatatgggaaaagaaaacctgagattgttatagatctatagcgtttttcttcagggatctataatttactaaaacattgttggcacttattacgtacacagaaagatcaccttcaaaaatatatttactatcagtaaatggatatctgagatgcattatctaaatagagcatatttgaccaagtctaaaaactgggctttagcaacaaaacattataaaaatggatctggattttaaaagttttgcataaatgattagctttcaagcttgtgaaagtttttttttttcattttaaatcatttgggactagtgaggccatctacaatgggaaattgttgcatgtattggacaaaaatcatgagtgcatattatgggactgcagaattaaatgaggccctttacctttaaaaggaatataatctagtggaagagaggaaacgtatctgtattttttaacagaaaacaaaaggagatcacgtagagtaaggccctgattaatgtacatcatagcctgggtcacgtacctccaccccacaagaccaagaagtgaaatgagggaattgaagaatcaaatagaaaaaggcaaagccaatacaatgatgcactatctagtttgttacttctgaggatgactactacttctggtgaggcccagaagctatatccctaaattgtccacctaaggaattaaaaagagaggcattggtctgtcagcttctgttccctccttgaggagagtcaagggttgccttctggggcctgcctttcctgcgattctgtgttaatacacttaagacttagacgtatagatatctaacaagctcctagggaagtaataaagaagtatgtttagtgtaagattgagatgagacattgttaccccaaagtgggttgatacctatgccgaactgtttactgtagcctcgctggaatcagagatgaaggtgagatggtatataagattgtgtgtccagtacaatgtctttatatactttaaatgcaaaaaaaaaaaaaaaaagaaaatcagaaagggagaggcggaaatggacgtttaagatatttcatacctttgttctaaatcaaagaaacttccttactgtaaattcttcatgtagagaatgctttatgagattacaaaaataagcctgtctgcagtcagcaagatggaggaatagggagcaccagacttctacccctacagaaatactgacttaacaatatgtggtccaataaagcctttatgagaaggccagaaatcacttatgaagtcacagaactccagtttaaaaccaagaaccatggttttgaaacaggtaagaaaagctgtttcatttcatctgagtcggccccttccccaagccaccacagctaatgatgaggaaaaaaagtccagtgactggtttctcccttgggagaaaaagagtaaaatggaattatgtccaatgtgctggctttttgagactactcaagtgactggtttctgccttgcttgacttggagtgctgatgaggaataggcatactttgattgcctggggactgctgagaacaagagagctcagcggttggtggcagtaccaaaatacccgtagtactgcaaacagacaccagagggtgcaagagactgtagactcctgaaaaagaaaccagaaaactttgtctggttgtgaaattacacacataggctcagaaaaaattcatctctgtaaaaggtttgagagaccgccagaatctctagctgggctgattggtgaagatctttttccatccaaaaccagtctgtaaagactggaagaggtgaccgtttattcaaatacaaaaattacaacaaaatataaggcacacaaacagggaaaatatggtccaatcagaagaacaaaataactgtccgtaaactgacccaaaagaaatggagatctgtgaattacctgacaaatagtttaaaaggaacattttaaattagtgcactacaagaaaacatatacaatgaaactgtgaataaaatgagaatatcaattaagagatggaaactgtaaagatccaaacaggaattctaaataactaaacaggaattctgaagctgaagaatacagtaactgatttgaaaaaaaaaattataggggatcaacagcagactttattaagcaagagaaagaatcagcaaactcaaagacaggtcatttgaaattattgagtcagaggaacaaaaagaaaaaggaaaaatgaagaaagcctaagggacttatggggcgccatcaagtgaatcaatatatgcattacatgaatttcagaagaggaatatagaggaaatgagggacagaatatttttcaaactacaatagccaaaaccttccaaatgtgaaaaaggaaatagatatccaaatataagaagctcaaaggactacagtcatgatgaaactaaagaaattcacactaagacacattctagtcaactttccaaaaacaaaaatcttaagggcaacaggagaaaggcaatgtggtatatacagagactttccataagaatatcacacatttctcagtggaagcatcgcaggacagagtggaatgagattatatgagggatcttcaaaaagtttgtggacggtatgtattatgaaaaaaaaaactatgcatggatttcaaacttttttttggcactaaaataaattcctgctgatttgggtaagacatcaatttgaaaagagtccctatccagagcaacatgtattctgctattactgaggcaagaacaaataccaaatttatggtgaagcatggtggaagaatggtgaaattattgatactttacaaaaaatttatgggaatagtacaccaaagaaatcagctgcttccaaatggataattcattttaagaagggacgagatgatgatgaagatgaggcccatggcagcagaccatccacatcaatttatgagaaaaaaattcatcttattcatgcctaactgaagagggccaacaattcacagaagaagcaatggccaaacaccataggcatctcagttggtttagcttacacaattctgactaaaaaatcaaagttgaacaaattttccactcaatgggtgccaaaactgttgtgctaagattagctgcacacaagagctttcagtgaaaaattcaaacaattggcattgagatcctaaagcatttctcgaaagaattgtaacagcagatgaaacatggttttgccagtacaatcctgaagacaaagcacaatcaaagcaatggctaccaagaggggcacatggtgaagagcaaaagtcatggcaatagttttatgagatattcaaggcattttgcttgttaactttctggagggtcaaaagaaaataacatctgcctccgtcccaaaaagaaaaataaaaaagaaaataacatctggttattatgagagtgttttgagaaacccaaagctttagaagaaaaacgtctgggaaagcttcatcagcgagttgttctctgccatggcagtgcttctgctcgttcctctcatcaaacaaggacaaattttaaataatttccatggggaatcattaggcatccaccttacaattgtgatttattccttttgacttctttttgtcttctaatttaaaaacatctttaaagggtatccatttttcttcacttaataatgtaaaaaagactgcattgacatggctaagttcctaggacccccacttttttagtgatgtactaaatggttgatacaatcacttacaagagtactggaactttttggagcttatgacaagaaataaagttcatatttttaatttttatcttttaattcaattttccatgaaagttttgatgtcccctcatccatacagagtgctgaaggaaaaaaaaacctgacaatcaagaatagtatatatggcaagacttttaaaagtgaagaataaataaagacctttctggataaacaaaaggcgaggaattaattaccattatgcctgccttataagaattgttaaagggagtttttcaggttgaaacaaagggatactaaacagtaacatgaaaggatatggaaatataaagctctctggtgaaatacccatggtagatgcaccagaaaaaatgagaaagaaagaaaagcatgtcactacagaagaatcaatgaaatagaaaggcagcaagagccgcaaagggggacaaaattactactagccatacagaacacaattaaatgataatagtaagttcttacctatcagtaattactttaaatgtaaattgattaaattccccagtcaaaagacatacagtggctgaatggattaaaaaagaacaagatccaactatatgctgtctacaagacactttagatataaggacatactcgggctgaaagtaaaaggagggaaaaaagatattccatgcaaatggtaacccaaagagatcagaggtgttcatgtttatatcagacaaaaatagactttatagaaaataggtaaaggagggcattaagtctccccttacccaagatagcagattggaggtattgctagcatgcctctcccacttagacaaagtagtgtgtagaaattaatgctctgaacttttttttcaagaagcaacataggaactaaacagaaaaactgaaaggaactacagaccctttgaaagaagcagtgggcggcagcctatactgtgaaccagactgaaaacccccacaggaaacactgaacctgctcaacaccaagcatatcactactacaacgagcatctgagaaaaacatcacacaaagattctctataaccaagaaacttatacagagtcttcaccactgaaagcacctagagccaaagctaggtgacaataaattataaacattaaagtcataccctcaaggggaataaaagaaataaaaaccccagttaaatgaaaaataaattcaaaaataatgagaagaaatagtctacccaaatgagaaggaaccagaaaaataattctggcaatatgaaaaaacagggttctgtaacacctcccaaaaaacacactaactctccagcagtggattcaaaccaagattaaatctttgaaacaccagataaaaattcaaaaggttgattattaatttactcaaggagatacaagataaaggtaaaaaccaacacaaattaaaaaaaaattaggatatcaatgaaaaatttttttttaaagagatagatttttaaaagaaaaccaatcagaacttccagaaatgaaagacacacttagggtactacaaaatgcagtggaaagtgttaataatacactagattaagtagaagaaacaatttcagagcttgaagacaaggctttcaaattaacccaatcagacaaaaataaagaaaaaagatttagaagaaacaaagtctccaagaaatatgggattatgcaaaacagacaaagaattataggttttcctgagggagaggaaaaaacaaaaaatttggaaaacctatttgagggaataattgaggaaaacttccctgtccttgctaaaaatttagacatccaaataaaagaagctcaaagaagtcctggaagactcattacaaaaaggacgtcaccaaagaacatagtcatcagattatctaaagtcaatgtgaaggaaataattctaagaacagcgagacaaaagcatcaggtaacctattaaggaaaacctagcagactaacagcagacttctcagcagaacaaaccagaagagattggggtcattttttagtcttcttaaacagaataactgtcaggcaagaattttgtatccagcaaaactaagtttcataaatgaaggagaaataacgtctttctcagacaagcaaatgctgagggaatttgtcaatactagaccaatgttacaagaaatgctaaaaggagttctaaatcttgaaagaaaagattgatacacaccaggatagaaacctctgaaaacataaaattcacacggcttataaaacaataacacagtgaagaaaagaaagtatctaggtaacaatcaacattatgactggaatagtatctcacaatactaacattgaatggagatggtctaagtgctccattaaaagatacagattggcaaaatgaataaaatcgtcacaaaccaaatatctgctgtcttcaggagacacatctaacacaaggattcttatagacccaagggaaaagggtggaaaaagatatttcatgcaatcagaaaccaaaagcaagcaggaggaactattcttatatcagataaaacagacattaaggcaacaatagtaaaaaaaaaaaagacaaggtcattatacaatgataaaaggatccaattcatgaagaagataaaataattctaaatatatatgcacctaactccagagctcccagattcgtaaagcaactaccactagacctaagaacagagatagacagaaacacaataatagtagagggctttcactccactggcagcactagacagagcactgaggcagaaagtcaacaaagaaatactggactctagaacaaactgacctaagagatatttacagaacattctactcaagaactacccaagaactgcagaatatacattcttcttatcagcacatggaacattctccaaaatagatcatatgtaagctgcaaaacaaatctcaataaattttttaaaaattgaaatcacatcaaccatattctcagaccacagcagaataaaatcaattccaagagtaatcctcaaaactgtataaatacatggaagttaatctgttcctgagtgatttttgggttaacaatgaaatcaagatgaaaattgaaaaatttctgaaatgattgataacaatgacacaagttctcagaacctctaggacacagcaaaagcagtgttaagaggcgtttatagcactaaatacctacatcaaaaaatctgcaaggttacaaattgacaagctaatgtcatgcctcagggaactagaaaaagaacaaaccaaactcaaagctagcagaagaaaaataacaaagatcagggcagaatgaaatgaaattgaaaagacagtacaaaaatcaatgaaacaaaagctagttatttggaaagataaacaaaactgatacactactagctagattaaccaagaaaagaagagaaaagattcagataagctcaattagaagtgaaaatggagacattacaactgacacctcagaaatataaaagactatttgagattactatgagcacctctatgcacacaagctagaaaatctagcggaaatggataaattcccggaaacatacgacaccctagcttgagtcaggaagaaatagaaatcctaaacagaccaataacaggctgtcagattgaatcaggtaaacaaacaaacaaaccaaaaaaacaaacctgtcaacaaaaaaagcccagggcatatggattcaagccgaattctactagacattaaaagcagaactggaatcaattctactgaactattccacaagattgagaaggagggaaacctccctacctcattcgacccagtcagtatcatcctgataccaaagccaagaaagaacctagcaaaataagaaaactacagaccaatatccctgttgtatatagatgcaaaaatcctcaacaaaatactagaaatggaatgaactagaacaaaaaaaaaaatcatgatgaagtgggttttattccgactttttctttctcaataggtgcagaaaaagcatttgataaaatctggtatccctttatgataaaaattctcaacaaactagttatagatgaaacatacctcaaaataataaaagccatctatgacagattcacagctaacataatactgaaaggggagaacttgaaagaattccccctaagaatgggaacaagacaaggatgcccactttcaccacttctattcagtataataccggaagtcctagccagagcaatcaggcaagagaaataaagggcatccaaactggaaaagaggaagtcaaacttatgtctatttgctgatgatgtgatcatatacctagaaaaccctgactcctccaaagaatcctagatctgataaatgaatccagtaaagtctcaggttacaaaattaatatacataaatcagtagcaatgctatatgcactgagaaccaagctgagtatgaaattgagaactcaattccttttacaatagttatacaaaaatatttaggaatatatataaccaaggaagtgaaacatctgtacaaggagaactacaaaatactgctaaataaatcacaggtgacacaaacaaatggaaatacaccttatgctcatggattggaagaatcaatatcgtgaaaatgaccatactgcccaaagcaatttacagattcaatgtaattcctatcaaaataaccaacatcgttttttcagataattagaaaaaaaatcataaaattcacatggaaccaaaatagagcccaaatagccaaagcaatcctaagcaaaaagaacaaatctgaaggtgacatcacattacctaacttcaaaatacactacagggctatagttaccaaaacagtatggtactggtaaaaaagtagttacatagaccgtggaacaaaatagagaaccaagaaataaagccgaatacttacaaccaactgatctttggcaaagcgtacaaaaacataaattggggaaaggacatcccattaaataaatggtgatgggaaaattgaatagccacatgtagaagaatgaaactggattcctacctgtcaccatatacaaaaattaagatagattaaagacttaaatctaagacctgaaaccatgaaaattctagaagaaaaacttttctggacattggcctaagcaaagaatttatgaataagacatcaaaagcaaatgcagcaaaagcaaaaataaataaatgggacctaattaaacaaaagcttctgcacagcaaaagaaataaccattaaatagacaacctacagaatgagagaaaaaatctgcgaattttgcatctgacaacatacacggaactcaaatcactaagaaaaaacaaataatcccattaaagagtgggcaaaggacatgaatagacagttttcaaaggatgatttgcaaatggccaacaaacatgcagaaatgctcaacatcactaatcatcagggaaatgcaagttaaaacgcaacaagatactactgtaccccagccagaatgaccattattaaaaattcaaataacaatagatgttggcatggacagggtgaaaaaggaacacttatacactgctggttggaaagtaaattagtataacttctatagaatacagtatggagatttgatccatgaattccactactgagtatctacccaatggaaaggaaatcaatatataaaaaagacatatttatcacagcacagttcacaattgtaatgatacggaatcaacctaaatacccatcaaccaaagagtagataaagaaaatgtggcatatgtatattgtagaatactactcagccataaaaaagaatgaaataatgtcttttgcagcaactgggatggaactggaggctattattctaagtgaagtaattctggaatcaaaatctaaatccaacatgttctcatttacaggtggtttctaagcttatggatatgcaagggcatacagagtggtataatgtacattggagactcagaaggctggcaagcaggagagaggtgagagatgaaaaagtacctattggatatagtgttcaggtggtgggtgcactaaaattctagacttctccatggtaccgttcatccatgtaaccaaaaaatcactcatacccctaaagctactgaaataaaaaaaaatttttgaagtacattatgtaatgatgaaagggccaattcaccaggaaggtatgacaatgataaatgtacatgtactttacagcagaacacaaaaaatatataaggcaaacatggacaaaattgaagggagaaatagtaacataataataatagaatatttcagtgccccacttttaataaccagacagaatattagtagagaaacagagcacttgaataatgctatagaccaattggacctaacagatacatacagaacactgcacaccaaaacagcagaatagatagtcttttcaagtgcactaggagcattcttcaggatatatcacatggtaggccacaaaactagtattaagagaagattgaagtcatatcaagtatctttttagaccatattgtaataaaactagaaatcagtagcacaagaaaaactagaaaattcacaaatatgtggaaattaaacaacacactcttgaataatcagtggatcaaagatgaaatcatgggaaattagaaaatatattgaaaaatgaatatgaaaacacaacatagcacaacacataagatgcagcaaaagcagtagtaagagggaagtttatagcagtaaacatccatattaagaaaatctccaatcaacaacctaactttatacttaaggggactagaaaaggaagaacaagctaaacccaaagttagcagaaggaagggaggaataaaaattagagtccaaataaatgaaatagataatagaaaaagagtaaaaaaaaaaggctatgaaactaagagttggtttcttaaaaagatcaacaaaatcaacagttccatatttagctagaataagaagaaaacaaagactcaaataacaaaaatcagaaaagaaagaagagacattacaactgatgccacagaaatgtaaagtatcataatagagtactatgaacaattatacaccaacaaattatataaccttgaagaaatgcatacatttccagaaatgtacaatcaagaccaaattatgaagaaataaaatatctgagtggacatatactggtaaggagattgaatcagcaatcagaagcctcctgacaaaagcccaggaccagatggcttcactggagaatgcttctaaacaattaaataagaattaacaccagtccttctcaaactcttccagaaaactgtagaggaggaaacgcttgcaaactcattctacaaggtcaacattactctgataccaaaaccaggatatgcaaaaatcctcaacaaaattttagcaaactgaattcaacaccacattgaaagagtggtgcattatgaccaagtgggatttattactgaaatgcaagtatggtccagcatataaaaatcaaggtaatactgatatgttaacagaatgaaggaaatgtaacacatgatcatctcaattgatgcagaagaagcatttgagaaagtcatacaccctttcatgacaaaacactaaccaaacaaggaatagaaggaaattacctcaatgaaataaagggccatgtgtgaaaagcccacaactgacatcatactcagtggtgaaaactgaatcctttctctttaagatgatgcacaagggaaggattccttttctcaccacttctattcaacattgtattaaaaattttacccagaccaagcaggcaagaaaaacaaaaagcatccaaataggaaaggaataaatataatgatcttttcataggtgacatgatcttgtacgtagaaaaccctaatgattccacacacacacataaaactgctagaactaataaacaaatttagcaaagttgcaggacacaaaatcaacacacaaaagtcagttacatttctatactcagcaatgaccaatctgaaaaggcagttgaggaaacaatcacatttacagtagcatcaaaaagaataaaatacttaggaataaactttaccaatgaggcgaaacacttctacactgaaaactacaaaacattgcagaaaaaattgcagaaaacacaactaaatggaaagaccttctgtgttcatggtttggaatccttaatattttgttaaagtatctctattacccaaaccaatctacagattcaatataagccctattgaaatagcagtgttattttttgcagaaatagaaaaaaaaattctaaaattcatatggaatctcagaggacccagaaaagccaaaaaagtcttgagaaaagaaaaacaaagctcgaaacctcgtatgtcctgacttaaaaacatattacaaatccatagcaatcaaaatattatggtagtggaataaagacagacagacatataagcccagtgtggtggctcacacctgtaatcgcagcactttggaaggcagaggtgggcagatcgtttgagatcaggagtttgagaccagcctgggcaacatggcaaaaccctgtttctacaaaaaataacaaaagttatccaggtgtagtgatgtgtgcctttggtcctagctaatctggaggctaaggtgggagaattgcttgagtccgggaagttgaggcagcagagagctgtgatcacgccactgcactccagcccaggtgacagagcaagaccctgtctcaaaaaaaaaaaaaaaacaaaaaaaaaaacccagacatacagactagtggaacagaatagagaatcgagaaataaatcctcgcctatatagtcaaatgatttttgacaaagatgccaaggctactagtagggaaaggacaatctcttcaacagatgatgttggaaaaactggatattggcatgcagaagaatggtataaccttataccagattaaaaaaaattaaatggattaagacctaaatgtaatacctgaaattattaagctcctagaagaaaacaggggaaaagcttcatgacattgggtttggcaatgattttgtggatttaacacaaaaagcacaggcaccagaagcaaaaatagacaaataggacatcagacctaaaaacttttgtgcagcaaaggaaaatcaacagagtgaaaaggcagtctacgtaatgggagaaaataattgcaaaccatatatctcataacgggtacataaccaatatatgtaaagaacttctgtaactcaataacaaacatcaaaatttaaaaatgggcaaaggactcgaatatatcaaagaagatatacagttagccaacaaacatgaaaatataaacatcggcatgaaaagatcaacatcaagtaattgttaaggaaatgtaactcaaaaccacaagaggtatcaccttgcactcattaggatggccattattaaaaaaaaacaaactgaaaaaaacaagtgttggttaggatctggagaaattgcaatccttttgcactgttggtgggaatgtaaagtgatgccactagggaaaatgatatagaggctcctcaaaaaattaaaaccaaaattaccgtataattcagcaatctcacttctgggtttatatacaaggaattgaaaacaggaccccatggagatatgtgcacacccatttgcattgcagcattatttccagtagctaagaggtggaaacaacctaaatgttaatcagcagagacagggataaaaaaatgtgatatagacatacaatggaatattgctcaggattaaaaaaaggaaatcctgtcatatgctacaacatagataaacctggaggtcatcatgctaacttaaataaaccagtcacagacacataccacatgattccacttacatgaggtatctaaaatagccatactcttagaaacagaaagtagaatgggtagttaccaagggatagggatgaagaaagggagagttgtttagtggttatagagttttggttttgcaagataaggaagttctgtgtttcttttttacaacaatgtgcatgtagtcaacactattgtaatgtacactgaaaaatggttaaaatggtaaattttgttactcctcccatcccacttttttagacagggtctggctcctgtcacctaggctagagtgcagtggtgtgatcatagctcactgcaaccttgaactcctgggctcaagcagtactcctgcctaagcctccccaatagctaggactatggttatgtgccactaggctcagctaatttttttaggttttgtagagacagtcttgccatgttgcccaggctagtgttgaacttctggcctcaagcgatcctcctgtctcggcctctcaaagcactgggattacagggtgtgaaccactatgcctggcctatgtttttttttttaaccataattaaaaaaaaaaaaaaaagaaaccacctgtctgcattctgatattttacctgataggacaaatttgccttaggtaaacctttataaacaggcatgatcttttagaaactactcaaacgttttaaaaggaagagcaagagcaagtgtcagttatgacacttgaagagtcataactggttacctttgttacagtttaaaaaaggtagcactttctgtgtttcacagggtgaatgccttcatccattggaacctgaaccatgagtatttccttctgagactttcatcaaactaagtctgcatgaagcctgagtcctgtggtaactggaacctcataatagcatttacatttggtgttaaaatgcacccaacaggaaaaaggattcagttattttcaagcttccaaattccaaatgtgctgaatagacatttcctttaaaaaataaatatacaaaatggatttgtgtgacttgaagtttaaaagaaatgttcttgcatgccatagttaagaattgtaacaatatcacattctcaagtttacttattttaaaagtagactgtcatggtttggctcagctactaaattaaattattgctggcttgaacattcctgttggttacactgtaatctttacctcccttggaaaatatgtccgattttgagtgtttatttcagacttggcttgaaacacctctgtttagcagtgaagtatggatatatatgtgtgatctgtgttacgtatgtagaaaggaaagaaatagaaaaaagttttacattgtgtgttacaaatacacactaacaggaatacatatatacatacatatatgcaactagaaccatgcttatcaaggatcaagataatataactatactgaattaatagacatgcatacatacatacatgtgtatccattaacatgttattacaggttgaattgtgtctccctttcccccaaaatcagatgttgacattttcacctctgggagctcatttggagatagggcttttgcggcggtaatcaagttaaagcaagatcattaggttgggttctaatctaatatgactggtattcttattaacaaggggaactttggatacagagatatgcatagaaggaagacagtgtgaagagacacagagaaaagacagctatctacaagccaatgagagagacatggaactcatctttctctcatacccctcaaaaggaaccaaccctgtcaacaccttgcttttgtatttactgcttccagaaattgtgagacaataaatttatattgtttaagccacctagttggtggtacttcattacagcagcactagcaactaatacaaggtatttctctattatgctaagaattcaggatatactcatttagataggatacacgattagtctttacatgttttaacttttcatagtatctcctaagcactctaagaaactagtttccctaaaaataaagaaaaaaggaaaaaaagaaattagtttctcaagtttgcaaaattaagaaattagtttctcagttttgcaaattgagaaattaacgttgactgtgatgatgaagcagttagatttggaaagtggatcctactttacataaataataatcagactttttcttttattcaggagtctgtgagtttgtgtaatttgtagtgatagtatcagagtttaccagaggcctaatggattggaaagtcagaatcagaacaagcaaatctaccctcatccagcaccagaattaaaagttctcaaaattgcgcacatgggaattaaatttctccacattagaaacagatgccttcaaataactgatttttccattgccccaacgtgtaagtgcctttttattgtgctcattttgtcatcagtagaaggacgcttgagttcagtacttggaagagtggaagggtgcagtattccttgggccctgtccctttacgtttcatggtatgccagggatgtctgtgtttactacctccaaccaatgcaagaacatacctgaacaacccaaactcctgactggggctaattggagttagtgacagagaagaacactattttacagtgttgggtatttttgttgttgctctggaggttgggagggattagtctttgtcaggagataggatttagcagaatatatctatttatatcttgttttatctattacatctccatcctattgacttctttcctgaaccggaattaagcaatgaatgctgtttgggcatttttagtgtggctgttcattattacctggataattcagagtacttctaggtcatgacataaaaatgctgttatttgtattagcttacagatactgttggtctgtctccaatgttgttgtttttcaaattccaggagtaacaggatggaaggttgcagagctctaagtaataagtaaagtggcctgggatactgaacatagggagtggtggagattgaggcaaactagacagatagctatgccttgtttaaaggggctgcctgtgttgtattacatctggttgttgtcctgtgaaaatgcaggccagatgtggccaaatcttcctgtttttcaaaccaagtggtagaaatttgaatttttacaagcagtctcccaatttttattgtgacaactagttcagattacgaaaaatatttatgggccaagtaaaataccacctgttttcagcctctagtgtaggatatatgaagccagcttgttcttcaggtagcaggtggtgcttacaggtcatctctactgaggcatcgttggtgaagtcctctaagactcagctctgggatcctctgtagtgaatggctctcatagttgcaggaaaaacccaggtccaaatgacacccacagttgaccacagttttacctaattaagtaaaaaactttttttaaaaaaataatttattttgttatcctgttaccagtactttcaaatacttaagaaaaaaatcaatattaaagtatcagttttgcaatccagaggatatttgtactttttcaaaaaaatttaaaaattagaaaaaagataacatattggcctcctgccttttaaatatttaagggatgaatcagactttcagatgtgcttaaattggtacctagagacctaatggaggtttcttattttcttcactggtaagattttgtcattcattccagtagatacttttaagcaacctttttattttagagcagctttagagataaagttatgaatatagtacagcgagtccccctatacgccaaacccagtttccccttattattaccatcttatattaattaatgagccagtaatgatgcattgttatgaactacagtccatactttattcagatttccttagtgtttacctgctgttctttttctattctgggactctatccagaatatcacattgcattcattgtcatgtctcccttggctcctcttggctgtgacagtttctcagactcctcttgcttttgatgattttgacagttttgagaagtattccataaaacatcccttagttgggatctgtctgatgtttttttctcatgattatgtatttttggggaggaagtctaaagaggtaaagtaccattctcctcatattaagggtgtacactattgtgtcagcatcatgttttactgttgatgtgaatcttgatcacctggctgaggtggtagtcatcaggttcctccattgtaatggtattgaaggcactgcgtgcagcccatgtgtgagtaggagtcatgctgcacttctgtgagaggagagtatctacatcaactattcggaattcttctgcataagagattggtctcttctctgtgtatacatgcatgcatgtatgtatgtcagtatggatatttatttattttatactttggattataatctaatacttgtttatttcattgatcagactgttgtagctttggccatggaagctctttcagttggctactgtgtccctttgatatacccccactgttgcattgttgttgtttttgagtactttcttaatttctggcactacaagatgctcatgcacatcttgtatattccctgctccagtgctagaatcaatgattttttccaaggagccctggtttcttttattggagactgttactagaaaccaagatctgctatgctcattgctactgggatgtgttgcttctaggctctttcagctgacagagcaaggaaatatgttgtgtataataatctgtgtatgttcacatatttataaatatttgtatttgtgtctgtctatattaagccaaatatgtgtttatactgatgacttcaactcttaatctgttaccacatggctcattggagttttctctcattgcttctctgtaaactgtcattcaaacactgagagatctggctcccaagagccacgatccatttgcattgttcaactccagtatacagtataatagtgattttagaattcctaactaaataccctgtgagaaacagttttatccacagagcttatgcacagtgccttttgcctttagtcttacctactccacttatttgtaaggatgctcaggtcagcatctttcccattccatcactgagtgtattttatacatttgctagattctttcaccacagcctgcattccatcttggattctccaacctcccaaatgattttttacaatttgcatacattaaggttagctctgtattttgtgggttttgaaatttacaatgtcatgtatcccccattagaatatcaaagagaatactttcatatcctaaaaatccaatgtgctatatttattcaaccctcaccccttccgaaacccctggcaatgattgacctatttactgtcactgtagttttgcctttttcagaatgtcacacaaatgtcatatagtacataatcttttccttggctcaacatcatatttatgtatatgcatataagagttatctatgttgttgtgtttttggggaggggaggggacagggtcgtgctctgtcacataggcccttgtttttgttttagtttactttggggtgtgtgtgtgtcagggtttccctctgtcacccaggctggagtgcagtggtgcgatcatggctcactgcagcctcaacttcctgggctcaggtgatttttccacctcagcctcctgagtagctgggaccacacacctggccaacgtttatattttttgtggagacagggttttgccatgttgctcaggctggtctcaaactcctagactcaagcaatctgcccatcttggcctcccaaagtgctgggactacaggcatgagccacctccctcagccagtttttttttttctcctatgaatagtattctattatatggatgacaacagttcgtttatacactcacctgttgagattgtttccagctcttgaccagtataaataagacttctataaacattctcatgcaggtgtttatgttgacataaaatttcaaaggagcacaattgctatattatatgatagagactgtgtttagctttttaagacactgccaaactgtattccaaaatttggaatggtatacagcttttgcattcactccaacaatgaattgagagctcctgtttctctgcatcctagtcaacgtttggtattgtcagtttttaaaattttcgccattttaatagatgtctagtagtatctcatcattttaatttgtatttccctaatgagataatgatgttgagcatcttttcgtatgcttatttgtcatctatgtatcttctttggtgaggagtctgttcagattttttttttttggcccttttttttgttgttgttattgttgagtttcaagaattgtttgtttgtttgtttttttcttttttttttttgagatgaagtctcactctgttgtccaggctggagtgcaatggtgtgatctcggctcactgcaacctccgcttcctgagttcaagcgattctcctgtctcagcctcctgagtagctgggattacagatgtgcaccattgtgcccggctaatttttttgtatttttagtagagacgggtttttaccatgttgcccagactggtcttgaacacctttacctcaggtgatccacctgcctcggcctcccaaagtgctgggattacaagtgtgagccactgtgcccagcttagtttcaagaattctttgtatattttaattatttatttagtttggagacagggtcttgctctatcaccttgactggggtgcagtagcatgatcatggctcaaagcagcctcaaaatcctgggctcaagtaatcctccacctcagccttctgagtagctgggactacaggcagtgccaccatactctactaatattttattttcaaatatttttgtagagacggggttttgctatgttgaccaggctggtctcaaacttctgacctcaagcagtcctcccacctcagtctcctaaagtgctagggctacaggcatgagtctccctgccccgctgtatattttatatacaacttctttatcagacatgttttctaaatattttctccgaatctttggtttgtcatttcattctcttaatagtgtctttcacagagtagagtttgaattttattaagtccaatttatctatcttctttcataaataatgtttttttgtattgtatctaaaaactcatcactaaacccaaggtcatgtagattttctcctatgtgttcatctagaaattttactgttttgcattttatgtctaggtttatgattcattttgcattgtttgtaaaatataaggtccaagtccaggttcatttaatttttttcttggtgtatgaatatacaattattctagcatcatttgttgaaaagactatgcttttttcattgaatcgcctttctgtgtttttcataaatcagttgactacattgtatgggttgatttctggggtctgtgtcttgttccattgaccaatgcatctattctttctgccaattctacagtttggatggagtttgattttaattggtattaatttttatttggggtttgagaaagaggttctcattcaattttatgacagtgcttgtgtgtttgggtgtttttaagatattagacattttatctccttcatcttgtcatcagcttttaacattccacatcctgtttgtttttaagtgacattgagaatgcacgtctctgatcttccttcacatctcagtactagtaaatacaacctctttctgacatatgatatacttgtttcctttttatctgttcccctgatccttcactatttcataaaagttcataaaagcagggcttttaaaatttgttgttcactgctgtatcccctttacctaggacttgcctggcatctggtaagatctcaatgaagtaatgtgaactagattaatgaaatatgaggtctcacatttataacatctttgaacaagaggttattatacaaaggtgaatttgctaaatggctgaactttatacctttaagctgcaaaacttttattatttatttacttttaaattgacataaaaatttaatatgttcatggtatatacaacatgatgttttgatatatgtacatattgtggaatagctcaaatgagctaattaacatatccattaccttacatacttaatttttgtgtgtgtggtgaacacatttaaaatctgttttcttctcagtagttttcaagtatacagtacattgttattaactgtagtcacaatgtgtacagatctcttgaacttacttttcttgtctgtgtgaaattttgtatcctttgaccaacatcttcctaattccacacctctccttcccacccagcccctggtaaccatcattctactatttgtttctgtgagtttgacttttttagatttcgcatataagtgagatcatacataatttctctttctctgaccttaggacttttatgacttctgacctctaaaactgtaagacaataaatttgtgctgttttaagttgctaagtttgtattattttgttacagcagcattaggaaagtaatacagatgtttagtgcaaggaacaccatgcaagttaattttagaaattagtcttctgaaatgtttataaaatatataaagacaagttttttttggggggggatagactctcccttctttttttagctttttctttaatgaacatcaagcagattttaatgctcattttgtgtgctaacacttctttgtcattttcaagggtagctttttggaactttgtcaatagagtacaaaaatgtaaaaaaaaccagtctactgggtctggatgggaaagagttcactcttcatgtgttaagagtcttaacttcttggttacctacagtgtttgaggggaatggtgacttatagaactaaaaacattgaataacttatgttttactatacagatttatagttgcacaaatctgtagttgatattttcaaactgtaattacattttattcttatttctttttttattattttatttatttatttatttttgagatggagtcttgcactgtcacgcaggctggagtgcagtggtgtgatcttggctcactgcaagctccgcctcccgggttcatgccattctcctgcctcagcctcctgagtagctgggactacaggtgcccgccaccacacccagctaattttttgtatttttagaagagatggggtttcaccgtgttagccaggatggtctccatctcctgaccttgtgatccacccgcctcggcgtcccaaagttctgggattacaggttattcttatttcttaaacacaccgtagtgaacttttttgtttgtgctatgtcatatagtattttgaccagaaataaggaaattgagttaaagtcctgtttctgaaactatctagccaagtgatcttaggaaagttataatttctctaggtctcagttgaacactagattggtggtgagatatcttcagatctcaacagtctctaaaattctgattgatattgactgtattccttgtgacgttttttaaacagggctttcctcacaatgatattaaagtatgtagaacattccacgtaggcatgggctttcagacagatatataatattttagttattattttaaagaaatttttattcatctgcctttgttgctaagtgttcctgtgtttatatattttttcctactgaattgtagttttgttcttttgtctttccctttaaattgacccccatagggcttgttcatccctataatctgttaatagactctctcaataaatgtatgacagatgtagtggtggagagaagacagacctcccaaagatgtccatattcaaatccctggaacttgtgactgtgttaccatggcaaggggaattaggttgcagatggctttaaggttaccaatcagctgtccttaaagaggttagcctgggttatccaggtgggcctaatgcaatcacattggcagtaagtgaaagagggaggcaaaggagttagagtcagaggaattcaatgtgagagcaacttgattggaattgttggacttcaagatggaaggaagctgcaaggaatgtcggcagcctctagaagctccaaaagtcaaggagacagattatcctctagagtttccagtaggattgcagtccatcaacacctggattttaacccagtgaaatccattttggacttctgacctctgaaactgtaagacaataaatttgtgctgttttaagttgctaagtttgtattattttgttacagcagcattaggaaagtaatacagatgtttagtgcaaggaacaccatgcaagttaattttagaaattagtcttctgaaatgtttataaaatatataaagacaagtttttttttcgggggggctagactcccccttctttttttagctttttctttaatgaacatcaagcagattttaatgctcattttgtgtgctaacacttctttgtcattttcaagggtagctttttggaactttgtcaatagagtacaaaaatgtaaaaaaaaccagtctactgggtctggatgggaaagagttcactcttcatgtgttaagagtcttaacttcttggttacctacagtgtttgaggggaatggtgacttatagaactaaaaacattgaataacttatgtttcaatttatactatttggattctgtagaagaagaattttatttaaaataatgtttttgttatgtttattttaaatgatattgaaaatgaattacattttctcaaggtcatttaaaatgaactgattctttattgggtgataggtggaaggcaggaattgattgaattcatacctgttaatcccatattaaattcttaaggagttaggaagatctgtggtggttgtactaattctacagttaaggaaagctgagagtcagagaggacaatttaagtgatgagctctattagcttatctgttttattgtcgaaccctgagcagaacttagtctctgaactttaaatccggtcttcttttcctgtcttgtaagacaaaaatgggagaatttcaggcttttaaaattgaactttagtcaatgctgtagttatgtaatttttataaagagcctacaatatatagattctcttattaaacatgttagccattataaacgccttaggcaaacaggcattcttattttatggttcagtttctgaagttcctactcttttttgttgttcttcctgtgatgtaagtcaggagcagtggttttggaagaaagtataaagaaggtgcaaacatcagaaaaaaaatgcttgtgtgtttactagaacagcatttgtataataagaattactttgtgtttttgatccatgaaatatacacattcattatggctaaaaggaaggacctaatttaaacaatgtgatatcaatgttggtttaatatcctgatttttaaagtcttatatgacttacatttgatttttttttttttgcctctctagccttgttagaattacatttaattttggtataataaattctgttatatatacctccttttctattttatatattaatattttactattttattttcttgtaagcttaattctgtttgtttctcttttggctctgtgactgatcaagaacatattaaatgtataaagtctgagcttgttattttaaatttgtaatgtccaggttttgttataaataccttagtgtctttctttaaaaagaaaaagaacaagtaataagtaactcacatagtggggagagtaaaaccattttagctgaaatggtttagatctaggataattatttgggggaaaatacattttcgagattttttcatatttttgcttgaattacctttactttcagtgcaaacttctgaaatttgatgtaatgtactctttattcctgttgtaacaacctcatagatgtcaggtttttattttacagctgaagagaatagaggctgttggacattttttttttttttttttttttttttttaggtggctgaccctaggacgtaagcagcaatactaaatgttgcaacttgtggtcctatgtattgtaacctgttggaagtagagtaattagtagtactggtggaaatcttaaaaacatcaatataaataggcaaaatttcttttctgattatcaagatcaaaaaagggaagctaaggtctaggtgatgaggttctctatgtgaagtcagttaattttcaatgagcagatcagcgttcttatctcttctcacaataatgattagcagttctttgcaaaggaagtttcagtgagtgcttgaaaaatatgggtcactgaggtctgtcatgcgaaactaagtgttggcctggcatctctggaactcaaatgatggccaagcaggcttgacttcagtgaaacagggttttaatgattaaatggaaatggatgaagttggtgaacaaatatagtgacttcaaagcctttaacttggattactggagaatcaagtgaaatatttcaccactgtgttatcactaaagagaatcagttctgtgtgtggtattggttctttaaacattatgttctacactaaggacccgaactgtcattcccagttagatagtgtttgaatgggaagtaatgttgaattgtttattcttaaaatttttttttatttccttaattatggttatttagataatccatcaattatagaatgagaagcctatttgtaagattgtggaatttctagttttcgagtgttgggggatagttaatattatgacaaattattaacttagggtgattgcgaaagttatacctcctaggttgagtttaaaatgctagtctcttactgttgaatgtgaaaccttgaatatgtctaatttttattggcatggatgtatgcatacaaatagagaaaggtaaattctactcatttgcagcttctcagatattctgaaattgcattactagctctaaaataaacataataggtcaatttggtcttgcatcgaagcattttatgtaaggaaaatgtatattaaaagttattgaatttcttgatgggccataaatccccttagcatcaaagtttgcagcttggttaagagtatgaaggagaaaagaaacttgaccaagaaatgttacttagaaaatatttgtatggagttaaattaccataatttcaattcctcttatgccagattttgcccttaaaagtgaaaagcaatttgattgatagagcagttgatgcaggcaggcagaaacctttttttttaaaaatcactcttcagattgctcatgagtttgtttttttcttaacatcacttacaatattatcattatgtaaatatttgctgtggaatcaagtagtatacttggagtgattaagaagaaaacaatcttaaattactaagtatgcagttcaaaaggtaatggcctaggcatcaaagtccgaaagagtgtcagttttgtccttttgtctgtttcttctcagtcatatgaggcttccatttaaaaagaattctcatatgtttttcttgcattactattttttattctagtgtaacatctttttaagtggtttcttcatatgaggtgtgtggttagtagaattatggcccctaaaggatgtctacattctcattccaggaattcatgaatgttacctcgcgttgtaaaagggactttgcagatgtgattaaggatcttgagatgcaggattgtccttgatagttattttttctctgtctgaaggatttcctttaacatttcttatcctttaatattctcattttgcctttatttttgaaagatgttttcgttgagtaaataattctaggttgacggtgttttaaaattgcttttaagatgttctactcttttctggcttgcattgtttctgatgagaaattggccatcaacattgtctttgttgccttgtagataatgtgtattttttttctctagctgttttaaagattgtctttaacattggttttaagcaatttagtgatatatgacagcgtctttttttttttcatgtgttcagtggagttcattgagcttcttggatttatagctttattgttttcattagatttggaataattttaaccattatttattcaaatatcctttctgtttctccttcattgggaactccaattacacatatattcgactgcttgatgttgttccacagcttattgatgttctattcaattttttccagtattttaaaaatcaccatttaactttagataatttctgttgctatgactgtaaatccaatctcacatttttttctcacatagactaatgtgctattaatactttcagtgcttttttaccccaaagatgtagttttcatcttgagaagtttagttgggatcttttgaatatcttaacacttttcaaatttttctctagctttttaaatacacagtaacctttttttaatgttcttttctgttattctaacatgtaacaattctatgttggtttcagttaattgatttttcttctcatggcctgtattttcctgtttctttacatgtctagtaatttttgattagaggccagacattgtaatattaccctttttggtccagatattttcgtactcttgagcttgttaagggatacagttaaatcacttggaaagagtttgacccttttatgtctgtctttctgctttctcaggtaggaccagagcagcatttagttcagggctagttttacctcctactgaggcaaaagccttctaagttttctacctgatatcctgttaattataaggctttctactctgaccattgtgaacaggaggagctgttctaaaactatgtgagagttaggattatttcctataatcctttcagttggttctctagtagtttactcatatgcatgggttgatcggtactcagctgcacactcaaggagtaagcctgaacatctccagaattctttgtccttgcagctttcacctctttgctattctgccctgcaaactctaggcgtcttggtctctttggtttccaggcccagttcctctacttagagagacttctaggttccaccttgcttcatgcttttcgcgtcacaatctgtaagttctcctggcaataagctggttcaattgtatgattattttatttgtttccccccaggaatcggcatgctttgttgcttgttcggtgtaaaaccactcttaaatttatgttttccatttttgagttgttttcaaatgtgagggtaaatcaggtcccattttctctatcttggctggcagagtatgtctcttgcctatgagatcttaatcttaactctaagcaacattcttagtttcttagttcacaggtgctgctgtaacaaaaattccctagattgggcagtttataaacaacagaaaattatttctcacggttctggagcctgggaagtccaagatcaaggtgctaacagtataggtgtctaatgaggacctgttcctcatagatgatgccttctagctgcatcctcacataatggaaagggcaaggcatttacctgggttctcttttataaggtcactgatcacatttatgagggctctttccttacactttaatcacctcccaaagttccacctcctaatacaatcaccttgagagtatgtttcaaaaatgaattttgagatgatacaaatattcaaaccatacaaatattcaaaccatagcacttaggattgccttttgtggtacttgttgctgttgctaacttcatgatgtgttttaattaataaccacccccccaggacttttactttcataattgagccccgaaaaataatgtatttatatatatttaggagatttataatgacttatctgagagtctgtaaaatatagcagaaatctcagtgttcagtcacaatgctgagaaatactaaaattaaagttgtaaaggatttacagaactgaaaaatggtagcatgcttactcactttttgcatgctaaatttatttctaggcatttgtgttttttttttggtaagtagatattgtaaatgagattgctttcttgaattgtttttcagctctttcattattgctttatagaaatgctaccaaattttgtattttgattttgtgtcctacacctttattaaattcatttatcagttctaagaattggtggagactttaggtttttctgtatataagattatattgtctgcaaacagaaacagtttgattaccttgtttccagtttggatgctctttctgttccttaattgttctggctaagccttccagtactatgttgaatgtgagtggtaaaagtggatatccttttcttgttccaattcttagaggaaagcctttcacatttcccttgttcagtatggcgtcagctatggggttgtcatgtatggcctttattgtgttgaggtacattccttctatgtgtaatttgttgagaatttttatcatgaagggatgtcgaattttatcaaatgctttttctgtgtttatagaaataatcatttaggttttgttcattttgtgatatatcatgtttattgatttgcatgtattcctgggataaagcccacctgatcatgttgtgtaattttttgatgtgttgttggatttggtttgctagtgttttgttgaggatttttgcatctaggtttatcaggggttttggcttgcagtattctttttttttttgcagtgtctttgtctcgctttggtattagggtaatgctggcctcatagaatgagttaggaagaattacctcctcttcaattttttggagtgatttgagaagaataaatgtgagtttttttataagtttggtagaatttagcaggaaagtcatccattcttgagcttttctttgttaggagactttattactgactcaatctccttactcattattagtttgtttaagttttctatttcttcctggttcaatcttgataggttgtatgtgtcaagggatttattcatttcctctaggttttctagtttgttaacataaagttgttcataacaagcgctgatcttttgtatttctgtgttatcaattgtaatgtcttcctcttttatttctgattttgtttattcgggtattctctctttctcctggttagtctatctagtggtttattgattctgtttatctcttcaaacaactgtatttcgatttcattgatcttttgtatttttttagtctctattttgtttatttatgctgtgatctttaaatttgtttttcttttaccgactttggtagaaggaaagatttgcttttgctttttaaattccttgaggttgttcatttcaggtcttgccactgttttgatgtaggtgtttattgctgtaaactgttttcttagttcagcttttgctgtatcccatagattttggtatgttgtgtttgtattttagtttaataattttttttgttttcttcttaatttttcttcatcactctactggactctactggtgttcaggaacatattttcatttccatttatttgtacagtttccaaagttcttatttattcctagttttattctattgtgatatgatttcaatttttaaaaataggttgaggcttgtttttgggttattatctggtctatcctggagaattctccatgtgctcataagaatgtgtatacagtagctgttggatgaaatgttctgtaaatgtctgtcaggtccatttggtctgtgatgcaatttgagactgatttttgttgctgttgatttttctatctagatgacctgttcaatattgacagtagagtgttgaagtcctcaactattattgtattggggcctgtctctcccttttaatataataatatttagatctattaattcatgcttatgtatctgggttttccagtgctgggtgcatatatttacaataattatattttctggctgaattgatctctttatcattatataatgactttttttctctttttatagtttttgacttaaaaattcattttatctaatataaatatagctactcccatttagttttggtttctctttgtgtagaatattcttgttcatcccttcatgttcagtctgtgtgttctttataggtgaaatgagtttcttatatgcatataactgggtcttgtttctttttttaaaaaaatctattcagcaactctatatcttttattggagaattgaaaccaaccatttatattcaggattactattgataggtgagagcacactcctgttattttgttgttttctggttgttttgtgtatcatttgttcttttcttcctctcttattgtttatctttggtggttttctgtagtgatagggtttgattcctttctcatccttgtgtatctgctctgtcagttaattttatactttcatatgctttcatgatgttaaattttgtccttttacttccagatataagactcccataagcctttcttataaggttgctctagtggtaatggatttcttcagtttttacttgtctagaaaagactttatttcttcatttctgaagaatatttttgctgggtacagtattctttgctggcagttttctttcagcattttgaatatataataccattttctttttgctggtagcatttctgctgataaatttgctgttagtatgatggggagtccctttttacttcatgcttttctcttgctgttttgaaaattctctctttgtttttgacttttgacagttttcagtaatgtgccttggagagaacttttttgaattaaatttacttaaggatttttgagctatcgtatcttttccatgacttgggatattttcagctagtatttcattaaatatattttcaatacctttttccatctctttgttgaattcctataatgcgaaaatatgttcacttatttgtgttccattgtcttattggctttctccattcatttttattgttttttctttttattttgtttgacttgactatttcaaaagacccatttttatctttagaaattcttcctagaaaaatcagtctcttctgcttgatctagtctattgttgaagctcttaattttgttttcttatttcattcattgaattctttacctcaatatttctgttttgttcttttttatatctatttgtgttgaatttctcatttagatcatgaattgtttttgttttcattgaattctcagtctgtattctcttgtatcttgctgagttttcttaggatcatcattttgaattccttttcaggcactttataaatttccttttttggtgtcagttactggagaatagttttcctttggaggtgtcatattccttgcttttcacttctcttgtggtcttacattgatatctgtgctcactgcttctgattttatgtagtttttgtaaggataattttttttttctgtttatgtgtcttgtagtgctggtttggtagagtgttttcattttagttctggattggaacagtattgtcttcttgtgctttctttggcgtattcagtgtcagctgtgtctgcaagtgcctcagtggcctgggctgtgggtgtttctgtaggcagtggcacagcttttttggtgtggggcctgccaggcaggctgactctcaggtccttgggagcgtataggggctcccttggtcttgagggtagtctcctctctatgctgggccactgcttcttggtatacaggttgctgtatgggcttgcatgcctgagtcattgccgtaccactgggttcagggtggcatcattgtgctgcagccttctctgtaggcatggtgagatagtggaggggtcacagggatatggaattgcagggatattaggccccagggaaagatgcactctggtagtagctcatctctcaatatggctctgtgccgcagcagcctgggtcctgggggttgcgggggagacccagcatgagttttctctggggagcagtgcagccatgttaactttaggcagctccctgtaccctgactaaagtgtactccgcttagtcctctgtgaggactgtggggctttcctatagcaagcattgcaggcatccatggtggcaacggaggctacctcttaccttttctccacaatggagagttcctcttggttcaagccaatccttgctggatgctttacttccttctctgtgatactatcctgagtttttgtgtccagaggctttttgccacttccttgctaacttgcagtgttctctcttagacattctactcaaagtgcagttatctctttgttgttttggttctttgtggaagaggctagcactggacacctccactcagccattgatgatgacatgttctttgcttttgactacatgtactttgaaaatcagagacaaaggggtgttttaaagttttcctttcatgtctcttagcaacagcaaataaattttctttggattgcaattttataagtgataaaaatgtttagcaatatgatggggtgattgaaatttcttgataaaagttgccagtttttctaatgtttgccgtgaaaagtagattgcatatttgagtactcaaacacatatatttaattgctgatagtatcctatgccacattttattttgtacggctctttcttttgtctttcaagtagaaaaataaaagtcttgtgatattttgtgataaatatgtgaccaaagttgaaggagagtgaaagctgaacactatattttaagctaatcttaatttaaaatattttttgttttaactttatatttttgttataaatttacatacaacatagtaattttgagtattgttttggtcactcttctttttccttttctttttcttgactgtttaaaaaattaaatggttttgaaggaaagtcacagaatgctttgctctcatttattgtttattttccatggctataaatcaagtccataaatgagaaaatggttttggctttttcagtgaggcttgaagtgcttgctgatcatggtgtctgaaccagtggggctgtccttggctttacaggtggcaggcagttaatattgatcatctcaaatatcagcagtatatctggcattttatggatgaagaacctattttatggatgaagaacctaatattcagtgagatcactgtaagctgctccttgtcactcagtgagcaagaggttgattttttgaacttcatgacaactatgacattatgctgttttctaccttttccccttggacatgggtagagacaactattacctgttcaattgccccttgttcattgttatggaggtcagtgtaccatcatccagaggaatcactggcctttcaattacagtcccaaactagtctgttgggatgtcccacagctttataaaaagaggctatgaaacccatttgatatgaatttggtaaatatggttataaatggttctggctatttatttgagaaaaatctacaaaatgggacacttttaggaataatcccttttttatttattttggcaataagttaaaaatatgaaataatatacttttaggcataattttgtccttttcattttatataatattggtattaaagaggaataggaaagaaggaattactcaagaatatgacgtccctttttttaaaattatttgatttacctatttacattttttgcttcaacttacctagccatcagagaaacttttattgtaagccaaatcttccaacacttcacactcactgattcatctcctgggtatcgtgaatattctgaccatttatatcagtgaaaaaatttgtatgtttgcaaattgatagagatgcatttcatatttaggattttattagcttttatgcttcatctatgctatttaagcaggtaggcacatgtgaaaaactgatatcaattagccattacataattattttgcatctgttatgtccatgtgcctaggaacacagtgtgaataagccaggcctagaccctcatctctaaagacttgcagtcaaggaattgcaggagcttttggaatgttgaacagatgctgagcagagcctcttttcatcctgtcctcagaggagctggtcagtcaaatctgccaaaattctctgcctctgtgtagcctattccttgggggtttaggaaagagggcaataatcctctgagtcagagagcagaccatctctcatccttcacagcagctggatgctactgtctccccttgcccccccgatgtatgccctgggcggacagtactaaatataatggaaaaccaaaatacttaactggaaacctttatcatattaattagatctctctttgcttcaggctgtaaaactgattagtgttctcaaagtccctgagaagactttgctatcttctttgactgatctatgaaggaaggggtagaagactggttgcagggtaaggctggcccagtctagggaaaatcttttttgttttttttgaaaggtcaatatattttttaaaaatcctttatttccataggtttttggggaacaggtggtgtttggttacatgcataagttctttagtggtgatttctgaaatgttggtacaccttacccaagcactgcacactgtacccaatttctagtcttttatccctcagccccatcccaccttttcccctgagtccctatagtccattgtatcattcttatgcctttgcatcctcatacgatgtttggttttccattcctgagttacttcacttagaataatgatttccaattttatccaggttgctgcaaatgccattttttcattcctttttatggctgaatactaattcaatgatgtgtgtgtgtgtgtatatatacatatacacacgtgtgtatatgtgtgtatacacatgtacacacttgcatatgtgtatatctatacatgtacacacgtgcatatacatacgtgcatatgtatatatgtatagatacaaacatgtacacacacaccacatggtgtgtatatatatattcaattatatatatacatacacatatatatatacacacacatatatgtacaccacgatttctttatccagtcattgattgatgggcatttaggctagtttcatatttttgcaattgtgaattttgctactataaacatgcatgtgcaagtatcctttttgtataatgacttctttttcctctgggtacatacccaatagtaggatcgctggatcaaatggtagttctacttttaggtctttaaggaaaccacactgttttccacagtggttgtgctagtttaaattcccatcagcagtgtaaaagtgttctcttttcaccgtatccccatcatcatctattattttttgatttttttgactatggccatttttgcaggagtaaggttgtatcgcatcatggttttgatttgcatttccctgatcatcagcaatgttgagcattttttcatatgtttgtaccccttatcttctgatgtgtttgtgagaaaggcccttacttggaatgtgtgtgcattcttctgttattcacgatttcagcaagcttgcttacctggtgtttaagtccacagctaaccagaagtgacacagtagaggcttggagaagggatatttaggccacttactctctgacattataagtatacagcacagttgaaacctgatgggagaataataaaaaggtgtaaaaacctgaaaactgattgtactctggtaataggaggtagagaggcagcggcagctgtgcaactctttggaggcctgcagaatcataattcacgtgcatagtggtgggttaggccatgtctcttgtgccttaggaaaggtggggaaaaagtgttttaaaatgtcacagaaagctttctatgcttaatggtttacttacattttgttgttgttttgcttaagggtataaactttagttttttatggtggactattcccagacctgaggttttagtgtacatgtcattaatcagcctctcccataagctctcaaaaattatttggatgattttttctccctttaggaaagttatgaagagaaagaaaagacagtgatttgtcatcttttaggggagatatatatatatgtgtgtgtcttttaggggatatatatatgtcttttaggggatatgtatatgtgttctaggagataaatacatgtatgtcttttggggtgtatgtatatgtatcttttagggtatatatatatatctcttttaggggatatatatatcccctaaaattatatataaaatatataatttcccatcccccaattggcttatttgactttaatgtttcagcatacttttttgagcctctgctgaatgctgtgcctgtaattgcatagctaagaccttagacagccactgtcagtttaaagtcaatacttaaatacttatagttaatagattacttataatatagcatttataaagttcctgctatctagagactccctgatcaattgtgcttggaagtgtgaatacccagggaaggcagtgacgtcatctgattctcaagtaagtgtcttaagggacttacttacctagggacctgtaagtgcagaggcttcaatgttggaaagggcatggtatatttggagaagactgggaggtttatgtgatcaaaatgctcaggggacaatggggagggaatcagaaagaaaaaacagttaaaatcttctctcctggagtgatcattttgcagtcagtggcattctactcccaacaactttctggctatctgagtttaggtagtttaccttgatttcctcatctgtacagtcagtggtgctaacagtgagactccagtctctaggagagcttttctaaggactagatgaggagatacagaggtcttgagcacactgcctgaaattaagtgctctctacaggttattctctcctttttctcgttctgctcaggacccctggtgacatccttgttactttcatcctgactgacagatgccaagtagagccctaggatttgatacgaaagggctggcttgggaatgcctttaagtaagcaacatttggtttgctccttcagagagttctccttgagatcaccacactctaaacctgggtcacatttgttccaaggccttctaaagctaattctgtattatatagcacttattttaatgttccagtgggttatctgttcacctcaaagattaaactgagaactccttctggcaagaatgaaaggaaaggaagaggggttgttggccagcaaaaacagaatagaagagaaactagtgcccagaacgcccacatcagcacaccacatccactccaaggaggcttttcaaccccaaacatccagccagggtttttaggtaaggattggtctttgtgttcagtgtttgtcttggacatcttcacattttttcctactcctgtgctccactcccttctcccccttgccttccctcaactcagtgggttattggaagaaagaaggcaagaatcacatctgaacaccttttgtaagaacgacatgatattaccaaggcctctttaaggaaggggaatttggcctcaaagccaactggcctcttggcttgccatggagtgggtttggaagcagctactgctcaggctttccctcctttaccttttgtgttcctaaggaaagatttttgtaaaaagacaaatgaagacattctacttcttggggttattcctaagaattttcagcttgggcccttttaatttttcccttctctaaataacaaaggtagggaaatgaacctggacaggtttgataaaagtacactagaaatgctgttcatgtatgtttaaaagttacattgaaagggagaaaacagcacttcaagttaagtaagttacatgtagaatgcagtctttacatctaataatattcatttggagatggtatgactcaatgttcgtctacagtttcctggaagttcttcaatctcaaacctctttaaattatacagtgttgcatttttcttcttgttgcagttcacctcatcacaaggaatatatgtacatgccacaatacttaaacatgcaattaaaatggaatgtctttttaaaaagtatactttaagttctgagatacatgtgcagaatgtgcaggtttgttacttaggtatacacatgacatggtggttcgctgcacccatcagcccatcatctacattaggtatttctcctaatgctatccctcccctaggctcccaccccctggcaggtcccagtgtgtgatgttcccctccctgtatccatgtgttcttgttgttcacctcccacttacgagtgagaacacgtggtgttcggttttctgttcctgtgttaggttgctgagaatgatcgtttccagcttcttctatgtccctgcaaaggacatgaacttatccttttatatggctgcatagtattccacggtgtatatgtgtcacattttcttcatccagtctgtcattggtggacatttgggttggttccaagtctttgctattgtgaatagtgttacagtaaacatatgtgtgcatgtgtctttatagtagaatgatttacaatcctttgaatatatacccagtaatggaattgctgggtcaaatggtatttctggttctagatccttgaggaattgccacactgtcttccacaatggttgaactaatttacactcccaacaacagtgtaaaaacatttctatttttccacattctctccatcatctgttgtttcctgacatcaggaatgttttgggggaaaatatttctgagagtatccctcagataaaacttcgggaactataagttgtcagttgcagtaagcagtacataagcaaacattactgcctagtgagagagcatgaaagtcaatgaatttatttgttctgatgaagagccttcgttgggaaatttatttaaagacaatagatgtagtatccagttctgatgtcagggttagagaaattatctttggctaaggttatctcctattttgccctgtaacattgaaatgcatgctgttatgtgatgccagcatgtgcttttcctggcttgctgccctcttaggtttggccctggcagattgaaaggttctccaagttggccaacccttgtgatgaactctttgagcatgataggctggaggcggtggcaggagcagccaagatgactggattctggtgttgaaagagggtgaagtgaaactattcataacagatgcagagttacttacttcaattgatcccatctttgtaggcttcttttcagctttagaactgcttcttactttggctttgtatgtttatctttcccttaactttctagtcataatatatttgagtcagcagagcttgcaatttgtgcctaatttgcacaaatacagtttggaaacttaaaggtcagggaagttatgtgcaaataggaaatttaacttaaaccagaactgtgtatttccgagacctgaacccgtataacctggaatcactaagccaactgctaatttagcattgacacagcctaaacagaaacaaatgggtagcaagtgtagtttagggtgaatgttttgaaatcatttctgtttggggtttgtaaaaataaaatgctgctgatcttgttttgctctttttgggtagaaatgtttgcttgattctggtcatttttagtacccagcaaaggtatccacttcaccagttgctcatttctttaccattgctgtgtatccagtgcattctagacttggttgcagctctagatcaaacaatttgatttgagaatctggcttcccagttttcttatttttgtttcatagaccgcaagattttagaaaggcatgctgaccagttctgaatggtgtcctaagaattcagggacttgcataattttattggaagaaaactttgttttccctgggcctatccaaataccaagctcatggaagaggcttaaatactttttcgttgcagttagataatcaggttttatatttttatttatataatttttatttccaacttttattgtaagttcagggatacatgtgcaggatgcacaggtttgttacataggtaaacatgtgccatggtggtttgctgcccacattgtcccatcacccaggtattaatcccagcatccactacttattcttcttgattttctccctcctcccacccccgccctccgacaggccctgatgtgtgttgttccacccatatgtccatgtgttctcatcatttagcttccacttgtaagtgagaacatgtggtagttggttttctgttcctgtgttagtttgctaaggataatggccttgagttccatccatgtccttgcaaaagacatgatctcattcctttttatggctgcatagtatttcatcatgtatatgtgccaccttttctttattcagtttatcattgacgggcatttaggttgattccatgtctttgctattgtgaaaaatggcgcagtgaacatatgtgtgcatgtgtttttataacagaacgatttatattcctttgggtataaagaaatgggattattgtgtcgaatggtatttctgcctctaggtctttgaggaatcaccacattatcttccacaatggttgaactaatttgtactaccaccaacagtgtaaaagtgttcctttttctccacaatctcgcaagcatcttgttgctttttgactttttaataatagctgttttgactagtgtgagatgatatctcatcgtagttttgatttgcatttctctaatgatcagtgatgttgagctgtttttcatgtttgttggccgcatgtatgtcttaagaagtgtctgttcatgtcctttgcccacttttaagtgggatttttttttctcgtaaatttgtctaagttccttatagatgctggatattagatctttgtcagatgaatggattgcaaaaattttctcccactttgtaggttgtatgtttactctgttgatagtttcttttgctgtgcagaagctctttagtttaattagatcccatttgtcaatttttgcttttgttgtgacacgtcttcatcattaaatatttgcccctttctatgtcctgaatggtattgccttaattaaagacttgtttaatcgaactgatatggacaagcagtacactatttttatagatgatcttgttggaagccagatttaaggagattgcctggagactaaaaatacattattttcatggggatttcatttttaatctagtgtgaaaatagtgttgatatgagcaaactttattcagtgttgtaattcctcaaataaaatatgcatgaaattgaaaagcacaaaagtcttcaatgtttatctctgtcatctatatctatgtctacctgtagatatatagcacatatctatatgtgaatatatagagaacaatgctagaatgataaaatagcaacagggattatatctgggagatgggaaatgtgagaacaccagatagccagaggtaaacaatactacgcctttgatccctcaacatggaatgaaatgtggtgagcattttccattgtcattaggtagtcttcgatggcatggttttctgttattatttattctgttatgttgttatgttattatgttgttatgtgatattctgtcatataggtattttgtttatcttggtgcttaagaaagccaaagtagataattcatatttgactttggatcctgtgttttctaagtttttacctcaaacaaaatgatgacacaacaccttgatgtggcctgaattttggaagctgcatgttcttcctgcttggctctctcccattctgcctctactttctcttccctctctgctttctccagttgtaaataggactatcttagtggttatgcactgccaacttttgtagcattgggttcagtttatagcatgtgtaagtggtcaatgaatgtttcttcctctaaatacttttcttacaagaagaggtagttagattttcatccaacacaaactccaatctggcttttgtcattactgaagatactgattttgcaaggcagaattcctgaagcttttgagccctttctaggcagttctttgcggttagatgacagtgctggataagaaggaataggtatttctcaggcccagatggtctgaaagaggttttgctaatgctcctaaaccaatttgatggattataattctttgtttcttttgggtaagcatgaagagtgtaatagatggcaaggtaagggctgtagggtttctcttcaaagactttattaggcggtgtgtaataaccaaagcaaatctcgcaatgaattctgcctcacatgcaaacccttattaatgagcagggcccagttgtatgactgttctctaatgtcagtgaggtgcctgctgtctgtccttagggtactctaacagatctgtgcatgagatgtttatttgaagcagaaagggaagttgttcaagcagcgtgattgacttctgattattcttcagcatcaaagtcctaagcttaagggtactaatcctaaggggttgaggcattggacatttttggtttgtagaccctgtttagttaaaggcaggagtaccctatagtatttctgaccactctacatctggcaaaattcacatttacccatgagaaataatttttagcatccattttgctaactaacaaagcctccgttgtttatgacaaataaaatttggagtccgctgactctggagtgtgagcctccctaggaaggctttcacatactcatgaagtacctctggggtatgttctcagctggaataacccaccactcctgggaggagggtcagaaccatcctacaggcatttgttacatgcactgtgctgaagtgttttaaagataattacagacagcacaacagaaggatgttttgtgattcttctgtgtgagaatcagattgggagatggatttggacacaaaaatgttgaaatataaggaacatttttgtggttgatgggaaaaattggaaacacatttgatgttaagactgtcctggaaaacccaggacacgtggctaccagagaacaggctctttcagtttgcttttttctgggaagtgagataaaaataccaaatgcagtgtgataaacttttccttcccataaaatatacatgtattgatatgttaaagtactatgtgttcacaaatacaagcttaattttatacatatgcataagtattaaagtgtatacagctctttcaccttcaggaacagttttcaagcattttgatttcaagccccttttacattttaaaaattgttgaggatcccaaaagagattttatatgtttggtttatagctattgatgttgactatattttcagttaaattgagacaattttaatagatttattaatatttttaaaaataacataaaacttactgcatgttaataaaaaattgtttcacgaaaaattccctattttctaagacaaaaaattcagtgagatgaatgatattgttttacgtttctgcaaacttcttgtgtgtctggtgtacaagaagacagctgcattctcatttcttcttctgcattcaatctgtccctctcactcttcaggtagcctctgaaaaactctgtgtacatttgtgtgaaaacgagtgagcaaaaaatgactcagtataattttagaaattattttgacccctcaaaccttttttttttttaattttactttaaattctgggatacatgtgcagaacgtgcaggtttgttacttaggtatacatgtgccatggtggtttgctgcacctatcaactcatcatctaggttttaagccccacgtgcattaggtatttgtcctaatgctcttccctcctgttgtcccccactccccaacaggccccggtgtatgatgtccccctctctgtgtccatgggttctcattgttcaactcccacttatgagtgagaacatgaccttgcaaaccttttaaagagtatcaaagatccccgggtccctggatgacactccgcacactgctccgtggtttcagtgttctaccacccattgtgttatttggtcctaattgccagccctgagaagtcattactatctccattttatagtcgaggcaaactgggattccagaaggcttgcctttgagtattatgaaagttccactagtactgatgcagccagtttttatttttattttatttagtgtttaaaggttacagtcttattgccttggagatttatgaagtagtttttttttggttgttgttgttggtttttttttgttaagaaatagggtctcgctatgttgggtaggctctccttggactcctggacttaacgcgattttcctgcttcagcctcctaggcagctgagtctgtaagtgtgtgccactgctccaggctgcaaccagtttttaaatgagagtcttctgatggctttgtttctgtgattgttccttttcaatgtattaccataaattgtatttaccttctacttagaattcagggagagggaagcttttatcttttatttatgcaagttcacaatagaagtttgcagagcgttatagctttggatgatttttcagacattttcatatcaggttttaatctgtaatattttaatatttgagcatttatgctaagaataagtgataatattttacaattttttggtgtgtgctttaaataggttatttgaggacagttgttttattttctcactttatgtggattaaatgtcacatctttgaagagccgagtggatttggcagagtgtcacctagcccctaattaactgtgtttacacagtccacaaacttgtgccctccatggaggtcaaagcaaatttgccttccaaacctttcaggaacaactctgttatatagaatctgagttttaaaatttcaaaattccagtggaatgatactttttgtatggcgtactgatcctgtaatagttaatacaagtgaatagtgagaaaaatgataattactagaaaagcagcagacatacaaaataaaagcctggatttttatttcattccacatgcatacaactaccttttcaagttactacaagaatttctaaatactctttaatttctgtatcattctgtattatctgcttgctctctgggaacacacggttcatgtacaagcaaggatcgcactttgaatagcactgatgcccattattgccactgtgcattcctgcataattcaaatctggaattttagctgtcttacttcgtgcctcccatcctcaacttcagtttaaactagagaattatttgttcttctctgcctcccctcccaaaatacttaaatggtgttatacattgttacaaaagtgagggagatatgtatatacaaaatatactgtttaaaaggatcaatactgttacaaaaaaaccgcactcaaatgtaagttcagatgacattgttctgaatcttattttcctcacttaataaggtatcacttctggctcacttgcttgagggggacaaaataatgagagagaaagaaagttatcccagatgtcttgagttaagggaaaggatgagtgattgcttatttttttctttatgggattcttacatagttgttttaacgaagacttgtggatgaggggaggaacagagcaatagctggtcagaagtgggagcagctgagaaaatgagggaaaacagaaacaaactgtcgggccagaggcagagggggctctcagagacagagaaagcaactttgatcagatgaggttggtttccacaatgtccagctatctgctggacctgtgatcctcacagtcagtgctgggtttccctgagcacttaccattcagtgggtgcctaccatgtgctagacaggggaggttccttttcacacacctgcacttaaccctcacaacagacccaagaagtggaatgagagaacaatgaggctcacaggggtaaagtatttgtttaagggcaccaactagtaagtaatgagactgggatgggaaccaacatcattctgatgccaaagcctcttgctttttccagatttgctacaaatttaaaagatagggagtcgagactgaggagggcccatgaaggagcagtaatatgcctggtacattagcccctgtagcttcctaacaattcctacagtacttctccagataaagaatatggaagacagtgaagtatctgtttccagaaacatttttgaggaagtcagagagaggccaaaagggacttaagtttcttcagagaggaagttgagaaactcaagtatagcaaaccactaatgccagatgttatttatccaaaggtttttggctatattgcaatactttctggatctctgctagttctctgcaatctttctgaagctgctttgagttttgaaaatatacatacctgaatttgaaaccatggtcatttaatctaaaatatgtccttaaaatcctaaactctttgtaataacaatggtggaagcacaagaggaatcattctcaatgactatttgaaatattattttattctaagtcaaagaagtatttctgatttggtaactgtttcagctagagcaagctgtgtttttgctttaaaaattgcatttagccctctctatgtgcaaatagagtttctttcttaaatttttaattattattcctcaatggaaggctgaaaggagatttcattgtattatagccctcattgacttttctctctaaatgatgacaaaagcttttaaatttagttataaggcaaaaaatacttatggacctgtaaagtgtgtgaagaggtgggtgggggtaaagacaattaacattttcccttatgaaaagggctgatttgtgatataatttctctatttatccttcatttcctgtgtgtcattttcagcaacatttcaactttaatatcttgacttttgatcattttttcctcttcacttgagagtatttccgagttgttattttttgttcctgagactttagtcaaagaatctcttctacttgttctttttatttttctaccagtatactgtgtgatctacctttgtcttttccaacgtcgggcccacattgtatttcaatacatcaccctaattgatagaaaacttgcggggatgtattgttccggctaatccatttttcctcttaataaagaatcatgaagaaactttattttcttttttgactctgactgttgaaaatgttcctaaaacaataacccacattcctgccttagtaagcacagtggatatgattgactcctgatggccgaaaaccttgtagtgtttgagagcaactcctgcagatatcacttcttcccaaatgtatggtaaattgaaatttgaaagaggtggaggtaaacagcttctggcataattgcgagagaggcacaggatctcgttaccctatcccctcgcccctcatcagagagaaacaccataacccctataagagccatgccccctctcccacctgtgtgtgcaggagttcaacctcccttcacttggaagtgtgcagaattctcttcctttgctgctactccttgaaagctagccctctgtgccctcacctctcgtacacataaagggggaaggcataccttggcagtgccttttaagatagtgaatggccaggaagtggctatatgaaacaaatcctcatgatatctagatttcttatgagttgatttctcatgaaagttctggttcataatgtttcagacttgtgccctgttgagaattgatgaggaatctaaaggcccccttcatatataataccactggtggtcagccccactgaagccccactgggacctaaggccatgtccctgttgagctcacagctgcaacgctgtcaccttgggtcagttgtgcctctggcttccttgcgacattccttagaactggcttgaaactgaagctcagtgggtgtccacaagggcaatagtccgctccttgctggagagaagacactttaactttatttttgggttatgctgcttacgtaagtaaaattaaatataagtaattattttttcctgctggtgctgacgtgtcacacccacagtaaaactagaattgtcttcaccaaaggaatggcttgtgtgcgtgcaggcattattcatggtgaacaccacagcgttaacaatccacgtgtcaccatgatcagatcccggagccacgcctactggggcatcggtttttcctagcctcactagctctgattttacaatccatcccctggcagagaaatttggggctctccctggatgtcagcaaatcactgctggcttgtaactaccaggtgggaagtgttcatccctaattgttcctaatttttgaagtaatgggagttttcttttttctctcctactgctgagcctgtgaagtacttcccctactcagttggctgagttaatctgctctcagagaggatgcaggctaatttagcataaagggagtatgattagaaaggtaagtttacagggcaaagaaagcactggaagtcttccaaagtagaaaagaacagcttttttggattattcattttttccataatagaatatatactctagcttactctcagtcactccagtttagtttcatggctatgtgagaaataattatattacattttgccctaaattttttttttttattgtgtttaagaacacttaacaagaaagctgtcctcttagcaatttttttttttttttccagacagaatcttgcctgtcatccaggctggaatgcagtggtgtgatctcagctcactgcaaccttcacctcctggcttcaagtgattctcctgcctcagcttcccagtagctgggattacaggcacccaccatcacacccggctaatttttgtatttttagtagagacagggtttcaccatgttggctaggttggtctcgaactcctgtcctcaagtgatctgcccgcctctgcctcccacattgctgggattacaggtgtgagccactttgcctggcctctcttagcaaattttaagtacaggttgagcatcccaaatcccaaaatcccaaatttgaagttctctaaaattcaaaactttctgattgctgacatgatgctcaaaggaaatgttcattggagcatttcagatttcaaatttttggacttgggatgcttaactggtaagtaaataatgcagatattccaaaaatctgaaaaaatccaaaatctgaaacacttctggtctcaagcattttggataagggatattcaacctgtatataatacattattgttgactattggcacagtgttctacagatctctagagcttattagaagctcttaacttaaacttcatgcttgttgattaataacttccatttccctggatattatgctatggagtttttggctctacctgctaccagctttcccttcccaatatcaagcaatatttttattaaatttgaaaacctcagttaccaatggactgcaaacaaactcagtgtatgaaggagctagtggtttttaaagctcaaaccatatcagaggaatttcatgtttagtaaattttaaagtctccttaggatgtcttaatgatgggagtaaaaacagaaaaaattatgtgacaacctttgtattttatttagaaaaggttttaatcagggaagaggggttggtattcaggttttgaagttatttgtgtgtgaaaacttactagatatgtctaagaattttattttccttttaaaaattaaatgatgactttatttcttggtgtttcagttttccatacttataaagcaaaggaaataataagaatctctttgtagctctgcttttataaggataacataaagtctcagataattgtgcctactactcctgaaggaattatatgttgaggcctctttttaaaagtgttaactattttgaatagtagtgctttgctaaattttggtacttaaaacagagccacaaaaattaagtggtaatagtaatatttatatttaaaatatgtcagtttatgatgatattaagttattcagtggtcagtttattcatctatatacatgcttaatattatttttaaatgttgtagtgtttttgatccataggattttgacttttcacatgcctctgttttatgatccttgaaaagaaaagaaaaaatcaaggcacaacaaacttaaaaagcaggaattttgttctatattggtggagaggagcaaatagactgatgtgagatgttagaaatatttaggtgttgacatcaattgatagatgttggttatttatcatactgtagtcttagttaacaacattaacgatccacgtgtctgtggtcagatcctggagcctcgcctgctggggatcggtttttcctagacgcaatcatactgtattataaataagagggagaaaagtgctaaggggaccccctccctccaatttgggaagattgagaaaagcacatctgtttgttttcaatggatgaaatatgcacatggcaaatttcagaagattaaaaaaaatacttaaaagtatattagtatttttttctccattcctttaatcatcaaattcctctctatctctcctcccccatgttacgataacggattttttcaggttattttgtcctctctcccaccaccccaaggtcatctgtgcatatacatgcatatgtatgtgtaacctgttttgtttttaaagcaaaattgtagcattctctgcactctttccctagctccttagctttcaatttttgaagattgctccttcttagtactcatcctttccaatatccagctggatgtactaatattatttggctagtattctcttagtggacatttctgttggttttagtggatgttaggttatgtgtatattgaatttcaaatgatattacagaattgctctctgtaaactctccactttatatttacagcaataatgagtcatattgcctagttttctacattcttactaacatgatgtggtctttttgacctttgttaatctaataaatgaaaaattgtattttaatgtagtttaagtatttcctttgagggaggctgagcataaatgaatacctttaactatcagggtattagacttgatcaccaaccactcaggtccttttctttccagtttatattctctgtattgatggtgttataaattcttattagcttcagttactatccacttagatgtctcaaggccacttgtatttcctattgttgctgtaataaattaccacaaccttagtggcttaaaccaatacaaggtgattatcttagaattatagaggtcagaagtccaaaacagatctcactgggctaaaattagaaagttgacagagctgcgttccttctagaagccctgggggaggttcatttccttgtctttctccagcttttggaggccacctgcatcccttggcttgtggctccttcctccatttttaaagccagcagcaaagcacctgattcttctgcctttctcttccatctttttaagaactcttgtgattgcattgagcctactcagagaacgcaggataatcttatttttaggccagctgcttagcaatcttacttccatctgcaacctttattctccctcaacatgtaacctaacatattcatagactccagggattatgatggaggggccgttattctgcctaccacatggcttaaactccacatatccaacacagaattccatcaccccaccctaaacttagtcttcctctagtgttctgtgtcttaataaatggttcctctatcagttgaagaaatagatgtctccgagttgttattgttgattctatctttgtcttcctcgctttctagatataatctatcatgaacttttatggattctgctgccaaggtagatttcttaaaatttttttttatttcaataggtttttggggaaccttggtgacatttggttatatggataaattcttcagtggtgatttctgagatcttggtgtacccatcacccaagcagtgtgcagtcttttatccctcatccccctcccacccttcccctcgagtccccaaagtccattataacattcttgtgcctttgcgtcctcatagcttagctcccacttataagtgagaacataacgatgtttgtttttttccattcttgagttactttacttagaactgtggtctctaattccatctaggttgctgctaatgccattctttcttccttttttatggctgagtagtattctctctctctgtgtgtgtgtgtgtgtgtgtgtgtgtgtgtgtgtgtgtgtgtacatacacacacataccacattttctttatccactcattgattgatgggcatttgagctgattccatatttttgtagttgcaaattgtgctgttataaacatgtgtgtgaaaggtctttttcgtattatataatgacttcttttcctctgggtagatgcccagtagtgggattgctggatcaaattgtagatctacttttagatcttaaggaatctccacactgttttctacagtggtagtactagtttatactcccaccaacaggatggccttaagtcatcctcctgccttggcctcccaaagctctggaattataggcatgagccactgcacctggccactttttcttcatagctattgttatggtttgtaattgtaactgttttgttgagtagttaagtatctctactctgaatgtaaacatgaaacacacacacacacacacacacacacacacacacacacacacacagtttttcagtattttttctcacctgcgctatgttgacattcccatttctgtgaggtagaatgtagcatatttcttaatgatatctcaaccagattttatagctttcctttatcgtttcagcatttaagactcaatcctctttattttacaccttctgtcttcaaattggggaagggaagaaatgacctctcccatgaattctgttgtcctccaaaggtaaccataccctgtgttctgagccccctttttggactgactgaggtttgggtgaaatgatggttggtggaattagggccggttctggtgcctcctactaaactctgggaggaggtgacttcggcaatatctggtgcgctcctctgactgctctgtgaatgtatattgtgatgtgcttaggtctgggcctttgctataatttcaggatatgaggatcatggctgggatgctattacataatttgtttttgtgattgtcagagaattttccttttcctcattacacagaaaggttcgtgagtacaataatgtatatctatcttttcccttcatttgtttctcagtggagtgtgactagctgttccagtttgtccaacactgaaggggtttccaaagacatgggacttttaatgctgaaactaggaaacacctgggtaaattgggatgagttcattagtgtattgcagtgccttttttttttttcttagcacaatgacagtgactgacaaaatggttatacaacattttttgaaaaaacatgagtgcggaagagttttacaaagactaaccagtcaagttataaatgattataaccaatattaatgattgtgtatttttgttttacttcattaataaaaatttagcataaataaaattagtcattgtgcagcctcagctgtttagtgattaatttccttcactttaggtttctaatttacaattatacctggcaagtggtagggagttgtacaggtagagtatgaaaagcagaattcagttgacttaatgctttgtgaaccggatcaataatttatttgtagtgttgaataagactaacatatttaggtagcatttcagtattgctatttttttcccttttattttgaaaagttgtttactttggcaagcaaggcttaggtagtctgtgtggtctgttcctgtccaactgtgacacaaatctttgtgtggccattgtcaagtcacttttaaaaatcaggtatgattcagttggttggtgctggtcacttttgaacagttcctaaggacgggtgctatcattagaagatccaatgatgaatgggcctcaactcacagtaagtttatacttaaggaagtgatttatactattttctgaatatggtgatacaaattagggtaaaaaagatcaatgcttatattttgataaattgagaactattttctttctagtttcccctcctatttttctttttccgtgattgcagtcttcggcatatgtgtgtcatacacctcacaggggaccagtggatctcattgtgcattctccctcctcccccagaaaaaccttatacttccccttttctttaataagaaagcactgtggtgaagtgtgctttatgttttttagtggagtaatcagaaaatggattatctcagatatggacttgtgaatttggtataatttcttaataattattaagttcatttaattgtaacaacttcatatattgtagtgtaggtattattctcccaatgtgtgacagatgatgacgtaccttcagagaggtggccaaggtagattgtggttgtatgttagcagaagtagcacttttattctgaaaggtaggggctggtattctacacataaaatacacagtatgttagtagccacatgagtagctaatactcattttaagtgttttcctccagctaaactttatcaattaagagacactctcaccttattatttacaattttctacactggaaagtgatagtttatacatgccagtagtagaaaaaaatgtaagcatttgtagtttccttcgtgaggactaaatccattctaagcagaatcctaaaaatgtgacttccttctttgattcttttgtttcttaacccatttattcatccatccatccatccatccagtattattattatatgtctgctacatttcagatattgtcaaagattgagggattggtgggtcaaagaaatgaggtgattaagacccaatccctgttttatatgaagtcaagctctacaagttgcatgttcttggtaatctcttactgactaccaattgactttctaaatatttgctgagtactttctccgtgtcaggcactgctgttaacagtggaatacaaagtgaataagattcatgcagagtacttcctgtaataccagctactcgggtggctgaggcacgagaatcacttgaaccggggttgggggcgggggggcgcggaggttgcagtgagcggagattgtgccactaccctccagcctgggcaacagagagagactcactctctctcaaaaaaaaaaaaaacaaaaaaaaacctcatacagagttcctatgttcacatatacatacccacacacactatatccacagacatgcatactacagactacatacatatacatgcaaatgaatatatgtatacataggcagaaagcatgcagttacattcccataaacatatggatatcatctggaaatatgtatgtttatgtgtctgcaagtgcgtgtaaatcaatgagctcattgaactgagggtgatttcaggaatcaggcatcaaccaatattatgaacttgtagccaggttcttctctggcctcgtttgcccatttgttctctatgggagagacacagggattagttagcctgctgacagctatgggttttgtgtgtcctgtgctgaggataagaatgttctttactgtgggtggcctaattaaagcctcatgaatattgagtgccacgtatgtctcatatataatttgtgcagcatgaatatttagtgcctcaggtgcctcatgcatatttagtgcctcatgaattttagaagcttcttggtccttccgtcttcttctgtgttcatgcatacgtgttctgcttgctttacctaataggtttcattacttatctatgcttaacacattttatgagcttcatctatcccatgtattttcctgtcttattgatcatagtttcttgtcctattaagcagaattgaattttctccagcactatagcaaatttacattacatctgtccatttggaaagcctatggcccagatgctttatggaaaagaaagctatttttaatattcagaatttcaagtcagtacatacacttacagatattttccagtgtaggacttttcgtaaaatctttagcataataaagctcaaaattgatttaacaatctagaaaaagtattcttgaggaattcattcatgctagtttatggttttgcttaaagcttgtggttggagatggtaaggaaggagaaggtaatattccttactggcttgggggttttgaactttaactggccagctttagccctctatgttgtaaacatttttgatgtagttacaattcaaagttatggcatatggaaatgttctattgtaggataaagtggcggagtagtataaatagggtttggctggctaaaaagctccatttattctgactttgagtcagttacccattaagcttatgggtttcgagtaacctaggggtgtgtttaaggttagtagtaattgacagggttgtttgtattttctgtgtattgtgggaggaagttcattccatttcatgattaatggtcaggaagggacttctaggatttggtgtttcatcttccaccattgaagaggatctcatttagattgttgaagaagatatctttgaacagacacatcagccatcctgcatatatttagggaagtggtacacaaagtggttcatgtacagaaatgcttttccattgtgattgacaccaaaataaacttgctgaaattgaagaatcataaaaaatatatgctctatgtatcttattcccttcaaatattagtatgtatttattcatgacccctgccccttttatttacagggacaaggccttttctgaatatgagaggctgactagaaatatgtattttgtgattatttatttgacaaacacatttggggacaaacacagttgaaccttggtaagtagatgatacatctggtggtgggagcagaggtgctggcgggtgcatgggtgtatcttgttaaaccgagtatttggggtcctcatatgcatcagtcactttgttttacaggaagggagagtggcagtgatgtgaaggttgaaactgtgttagagctgcttctgcatttcatactttcattcttttttgtctaccttgaattccagcttagatctctactgcatgccagtgatggagagggaagaaaggcatttcttgtattggaggctcttgtttgtggcattctggagccatttaaacaggcaggggctggcagcctgaggactgttctctagtggatccagctccagagggtgctgtgcacacgatgtcacaggtaccatgtggctttaaggtagtaaaaacgcatccctatgttgctttgagtatacaaaaatagttaacatccaatatcgagtgccaggccccaggctaagcacactgcgtgaaggagcacatttgattttcatggcattggatggcatagcagacttggccacacctcttgcgactcaccatcctgtgtcaggatggctactgcaagcaccaggtagagtgaccagctgtctccctttgccctgatctcagggttgtccagagagtctgagtttttagtgctaaaaggagggtgagttggtcaccctagtccctgtgactgctgtccaaggacaccggcagccaaggaacctctctcacagtggatgctgccctctaccggtgacaccggtgacggtgattggtgggtgaataccatctctgcagtctccgagagttcccctgcagaattcgtcctgtggcccacagagagaacccactcacacgctcatccatgtaggattccctctttgctcttttgcatttcactttctcacctccctaccagcgcctccggggatcaccttctgcataaatgactttcactcaggtacttgtcacagggtcagcttctgggggaatccagtctaaaacacatgggtagaactgctttactaccatttcacataagaggaaactgaggtgtggggaggttaaataattttgctcaaaattgtacagctggcacacagagctaataattcttagttattaagttatacagctttactttttttttttttagtttttaattttttgagacaagatctcactttgtcactcaagctggagtgcagtggtgcagtcatggctcactgcaaccttgaatgcctggggtcaagctattctcttgccccagcctcccaagtagcagggactagacgtgcatgccaccatgcctgctgattttgttctttaatttttggtagagacaaggtctcgctatgttgtccaggccagtcttgaactcctggtctcaagtgatcttcatgcctcggctcccaaaacaataggattacaggcatgagccactgtgcccagccattacaaattttttaaattattattattattttttttagtgatggggtctcattatgtagcccaggttggagtgcagtggctattcataggcatggtcatagtgcactgcagccttgaactcgtggcctcaagcgatcgtcctgcctcagcctcccgagtagctaggaccatatatgcacacccctttgcctggcttaagttatacagcttttgttcctatcctcacccatgtgtatttatttccaggaaatctacaatttcatttattcatatgggattaacaataagctatcatcagtccagtggggttatgaatggtatgttattattctatctctactaaattcattgagcatggagcagaagtcttgattttaatggacttaggggagtttgatgggactgtttttatgaaggagaaatttgtcttttatacataagttgccaaaaccagtgctgttgctgactaaggactaagtgcctatcccttgcctagctatgcgcagtctggccttgactggaagcaggaatcgtgacatctctgaccagattggatgtaaactgcctgcttgtgctaaggagttgtgtctgctggttcttggctcccatcctagagttctctatgaaatgactcattataaggaagtctattaaaaacaaatctctccccattttagagtatctcttaaaatttcttcttaataagagaattttggtgctttcagttccagttagtgccaagaaatttgaagtgtgtattgaagaaggctatgataattacagtacttgaatttcttgtaaagatagatgctttgggaagtgagtgtatttcccttttatttgaaagacagaagcttggaaattctaccagacttaaaaaaaaatttttctctcactgcaaatccacagcctaatggaaagtgctccaagtttctctagtgaaagtggcttcacttacctcagcatttaagatccttccccattgttgtagttttataggtattttagattatctatttaaaaaggcagctgcctgtcaaatgatccacataaataaaataagattgtgcagaagtgtagaatataaccacatgccaatccttaggaaacagtgggaaatgttttactttaaaaatgtagggttttgcttttacaaaactgatctttgaccaccggttctctcaggctttgccttttctagttcaatgatcttttctactagttcccccctcccttccctcaaaggcctgaatagacacttcccagtttgggaaatagaccttcattagttacacctggctcagcatttttttttcttttctgcacatctgcttagcatcatgtatttgaaggtgccacatacatgtttgctaacgttgctttagatgctgttgagtcataagaagataagcagtgctagggaggattcagtccagcttgatattcttctccacaagtgtgacttgggtagggaaagggggacactttctttggtcaagacggaaaaacagattcatgttacctgtcattagcatagtaaaaactatgggaaatgtcttagtccattccggctgctataacaaaataccatcaactgggtggtctataatgaacaaaaattcccacttctggaggctgggaagtcaaagatcaagcgtctggccttcaaagatgtgccttctctgtaacctcacatgatggaaggggcaaaggacctctctaggttctcttttataagggcactaatcccactcttgaatgcttcctcacatgacctaaccacctcctgaagaccccacctattgataagtatcattaccttgggagttaggttttcaacatatgaattttgggagatacaggcattcagaccacagtggaaaattaagcttaactgatggggagatttaggagatgcagtgagagagctttgttgtgctgtgtgctctgttctctcaatattatgattttaggaaggccattgccttctcaagagtttaggtatgtgctgcaagcactcagctttttataatttacatccttcctctacggatggttgaatgaatgaattgctctgaattcttgtacctatttctatttctggcctgtgcaattgagtttaatgttcgctaaccacatataaagttgtgcttagcaatgtttctcaagtggtgttgtttattgtttttctagattatatagagtaatacagaatatactttccagaatatgacacatctttgtattctctccataccttttataattttataaatgtgattttataatgtttttaacttatccttgctgcaatgaaaatttccacaacaaagtttattagaggaaaaacatacattttacttactgtattaattacccttatttgaagacggttttttgttatgtgttgtgatgagaaataacaagcagtattccctgtatagccgagtattacttttggctaaagttaggataatgttctttgccctattttgtcattgcccattttttcttcttgttagggaggcagaggtggtggtggagacaactgggaacagctagaactgagttaatatctttagagaatagtctgctatgacattgtttttgtttccctctataaacccttcaaataatttttaagaaattcctctgggccagtcgcaatggctcagacctgtattcccagcactttgggaggccgaggcaggcggatcacgaggtcaggagatcgagaccatcctggctaacacggtgaaaccccgtctctactaaaaatacaaaaattagatgggcgtggttggtggcgggtgcctgtagtcccagctacttgggaggctgaggcaggagaatggcgtaaacccaggaggcggaggtagcagtgagccaagatcatgctactgcacgccagcctgggtgacagagtgagactccgtgtgaaaaaaaaaaaaaatagctgggcctgttggcgtgcacctgtagtcccagctactcaggaggctgaagcagaagaattgcttgaacccgggaggtggaggttgcagtgagccgagatcgcaccactgcactcaagcctggccacagagcaagactccgtctcaaaaaaaaaaaaaaaaaaaaaaaaaaaatcctctgcattgagagccaagtgttcgggctcggtgggtcttaccctgacagagcccagcacactaagatccactggcttgaaattctcgctgccagcacaacagcagtctgagattgactgggacgttcgagcttggtgtggggaggggtgtcctcagcaatggtccaccattgcctatgcttgagtagactgttttacactcacagtgtaaaaaaagccactgggaagttcgaactgggtggagcccactgcagctcagcaaggctgctgtggccacactgccagatttcctttctctgggcagggcatctctgaaaaaaaggaagcagcccaggtcaggaacttacagataaaacccccatctccctggaacagagcacctagggaagtgggtggctgtgggcacagcttcagcagaattaatgtccctgcctgacagttctgaagagagcagtggacctcccagcacagtgttcaagctctgctaagggtcagactgtttcctcaagtgggcccctgacccccttgtatcctgactgggagacacctcccagtaggggccgacagacaccttatataggagagctctggttggcatctggcaggtgcccctctgggacgaagcttccagaggaaagatcaagcagcaatctttgctgttctgcagcctcccctggtaatacccaggcaaacagggtcgggagtggacctccagaaaactccagcagactggcagcagaggggtctgactgtcagaaggaaaactaacaaacggaaagaaatagcacatccactcaaagaccccatccgaaggtcaccaacaccaaacaccaaaggtagataaatccacaaagatgggtagaaaccagcgcaaaaatgctaaaaattccaaaaaccagaacgcctcttctcctccaaaggatcacaactccttgccagcaagggaacaaaactggacggagaatgagtttgacaaattgacagacgtaggcttcagaaggtgggtagtaacagactcctccaagctaaaggagcatgttctaacccaatgcagggaagctaagaacctttaaaaaaggtgagacgaattgctaactagaataaccagggtagagaagaacataaatgacctgctggagctgaaaaacacagcacaagaacttcatgaagcatacacaagtatcagtagccgaatccatcaagcagaagaaaggatatcagtgattgaagatcaacttaatgaaataaaaagaggagacaagattagagaaaaaaggataaaaaggaatgaacaaatcctccaggaagtacaggactgtgtgaaaagactaaatctacatttgattggtgtacctgaaagtgacgaggagaatggaaccaagttggaaagcacttttcaggatattatccaggagaacttccccaacctagtaagacaggtcgacattcaaattcaggaaatacagagaacaccataaagatactccttgagaagagcaaccctaagacacataattttgagattctccaagttgaaatgagggaaaaaatattaagggcagccagagagaaaggtcaggctaccaacaaagggaagcccatcagactaacagcggatctctccgtagaaaccctacaagccagaagagggtaggggccaatattcaacattcttaaagaaaagaattttcaacccaaaatttcatatccagccaaactaagcctcataagtgaaggagaaataaaatcctttataaacaagcaaatgctgagagattttgtcaccactaggcctgccttacaagaactcctgaaggaagcactaaaaatggaaaggaacaactggtaccagccactgcaaaaacatatgaaattgtaaagaccatcgacaacataaagaaactgcatcaactaatgagcaaaacaaccagctagcatcataatgacaggatcaaattcacacataacaatattaacctaaatgtaggctaaatgccccaataaaaagatgcagactggcaaattggataaagagtcagacccatcagtgtgctgtattcaggagacccacctcaggtacaaagacacatataggctcaaaataaagggatgggggaatatttaccaagcaaatggaaagcagaaaaagcaggagttgcaatcgtaggctctgataaaacagactttaaaccaacaaagatcaaaacaaagaaggccattacataatggtatagggatcaatgcagcaagaagagctaactatcctaaatatatgtgcatccaacacaggaatacccagattcataaagcaagttcttagagacctgcaaagagacttagactcccacacaataatagtgggagattttaacaccctactgtcaatattagacagatcaacgagacagaaaattaacaaggatattcaggacttgaacttagctctggaccaagtggacctaatagacatctacagaactctccactgcagatcaacagaatatacattcttctcagcaccacatcacacttattctaaaattgaccatgtaattggaagtaaaacactcctcagcaaatgcaaaagaatggaaatcataacgaacagtctctcagaccacagtgcaatcaaattagaactcaggattaaaaaactcactcaaaaccacacaactacatggaaactgaacaacttgctcctaaatgactgctgggtaaataacgaaattaggcagaaataaagatgttctttgaaaccaatgagaatgaagacgcaacataccagaatctctgggacacatttaaagcagtgtgtagagggaaattttatagcactatggccacaggagaaagcaggaaagagctaaaattgacaccctaatgtcaaaattaaaagaactagagaagcaacagcaaacaaattcaaaatttagcagaagacaagaaataactaagatcagagcaaaactgaaggatatagagacatgaaaaactctttaaaaaatcagtgaatccaggagctgattttttgaaaagatcaacaaaatagatagactgctagccagactaataagaaaggagagaagactcaattagacacaataaaaaatgatataggggatatcacccctgatcccacagaaatacaaactactatcagagaatagtataaacacctctgtggaaataaactagaaaatctagaagaaatggacaaattcttggacacatacaccctcccaaggctaaaccaggaagaagttgaatccctgaataaaccaataataagttccgctcaacttgtttgagggatcaagttggctttgcccctgggatgcaaggctggttcaacatacacgaatcaataaatgtaatccatcacataagcaaaaccaatcacaaaaaccatgtgattacctcaatagatgcagaaaaggccttcaacaaattcagcaccccttcatgctaaaaactctgaataaactgagtacccatggaatgtatctcaaaataataagagctatttatgacaaacccacagccaatatcatagtaaatgggcaaaactggaagcattccctttgaaaaccagcacaagacaaggatgccctctctcaccactcctattcaacatagtattggaagttctggccagggcaatcaggcaagagaaataaagcgtattcaaataggaagagaggaagtcaaattgtctctgtttgcagatgacatgattgtgtatttagaaaaccccatcatctcagccccaaatctccttaagccgataagcaacttcagcaaagtctcaggatacaaaatcaatgtgcaaaaatcacaagcattcctatacaccagtaacagacagagagccaaatcatgattgaactcccattcacaattgctactaagagagtaaaatacctaggaatacaacttacagagaatgtgaaggacctcttcaaggagaactataaaccactgctcaaggaaataggagaggacacaaacaaatggaaaaacattccatgctcatggataggaagaatcaatattgtgaaaatggccgtactgcccaaagtaatttatacattcaatgctatccccatcaagctaccactgactttccatacaaaattggaaaaatctacataaaactattgggggaacccacccccaatatttcaatgtaagttctttctattttctataagtgtcagctggctgagaaataaagacagtacaaagagagcaattttacagctgggccgccaggggtgacatcacatatcagtaggacatcacatgtcaggtaggaatcaccatgattcctgcctgagtctcagaccagcaagtttttattaagggtttcaaaaggggagggggtgtaagaacagggagtaggtacaaagatcacatgcttcaaaaggcaaaaagcacaactactagtaagggtctaacacagatcacatgcttctgagggaacaggacaaagggcaaaagcagaactactgataagggtccaacaaagatcacaaggcaaagagcaaaagcagaactactgataagggtctgtgttcagtggtgcacatattgtcttgataaacatcttaaacagcagaaaacagagtttgagagcagagaaccagtgtgaccacaaatttaccagggcagagtttcccaaccctagtaagcctgagggtactgcaggagaccagggggtatctcagtccttatctcaaccacataagacagacattcccaaagcagccgattattgacctccccccaggaatgcattcctttcccagggtattaatattaatattccttgctaggaaaagaatttagcgatacctctcctacttgcacatccgtttataggctctctgcaagaagaaaaatatggctctttttgcccaaccccgcaggcagtcagaccttatggttgtcttcccttgttccctaacaatcgctgttattctgttctttttcaaggtgcactgatttcatattgttcaaacacacatgttttacaatcaatttgtacaggtaacacagttatcacagtggtcctgaagtgacatacatcctcagcatatgaagataacaggattaagagattaaagacagccataagaattacaaaagtcttatttgggaactgataaatgtccatgaaatcttcacaatttatgttcctctgctgcagctccagctggtccctctattcagggtccctgacttctcacaacataaaacttcatatggaaccaaaaaagagcctgcatagccaagacagtcctgggcaagaagaacaaatctggaggcatcacgctacctgatttcaaactataccacaaaacgacagtaactgaaacagcatgttactggtaccaaaacagagatatggaccaatggaacagaacagaggcctcagaaataatactgcacatctacaaccatctgatctttgacaaacctaacacaaacaagcaatggggaaaagattccctatttaataaatgttgttgggaaaactggctagccatatgcagaaaactgaaactggaccccttctttacacctatacaaaaatcaactcaagctgggtcagagacttaactgtaagacctaggaccataaaaatcctagaagaaaacctgggcaataccattcaggacataggcatgggcaaagacttcatgactaaaacaccaaaagcgatggcaacaaaagccagaatttacaaatgggatctaattaaattaaagagcttctgcacagcaaaagaaactatcatcagagtgaacaggcaacctacagaatgggagaaaatttttacactctatgcattgacaaagggctaatactcagaatctacaaagagcttaaacaaatttacaagaaaaaaacaaccccataaaaaaatgggcaaaagatatgaacagacacttctcaaaataagacatttatgcggccaacagacatatgaaaaaatgctcatcattactggtcattagagaaatgcaaatcaaaaccataatgagataccatctcacaccagttagaatggcgatcgttaaaaagtcaggcaacaacagatgctggagaggatgtggagaaataacccttttacactgttggtggacgtgtaaattagttcaaccattgtggaagacagtgtagcaattcctcaaggatatagaaccagaaataccatctggcccaacaatcccattactgggtatatacccagaggattataaatcattctactataaagacacatgcacacatatgtttattgtggcactgttcacaatagcaaaaacttggaaccaacccaaatgtacctcaataatagactggataaagaaaatgtggcacatatacaccatggaatactaggcagccctaaatagggacgagttcatttcctttgccaggacgtggatgaagctggaaaccatcattctcaacaaactatcacaagaacagaaaactaaacactgcatgttctcactcataagtgggagttggacagtgagaacacatggacatagggaggggaacatcacacactgcggcttgtcagtgggtgaagggctagaggagggataacattaggagaaatacctaatgtaggtgatgggttgttgggtgcagcaaaccaccatggcatgtgtatacctatgtaacaaaactgcacgttctgcacatgtaccccagaacttaaagcatattaataaaaaaaattcctctgaattttcttttacttgtcctctttctctctccttaatcctacccagaaaggggttggggacagtaccagatcagtgtggattacctgttcaaggcacatctctatgaaaaaattctgagaccagtttttgtcctttttaagagtgggagggtgatgtaagagagagacttttttcttatgggatctgattgtcccccaaacatcactcctgctctgactaacatgattttaattgtctttcacaaaatctaactaaagagggtgtgtgtgtgtgtgtgtgtgtgtgtcagtgggaacatcttgtgtttgtattctgtgattcattactttttggaagttatttggacaaagattgtcaagaattgcttcaaaatgcatcccactgatgctcacgttctcgtttcctaattgctgatggggaagcttttgctcctcctgttgtagtcactgcttctgcccatgtgtgttgggggctcctcacagttcatacagcagcactgttttgagacatcagctcccagcccttactgttacaacatgcatgtcacatagcaccccgtttttcaaaatcatttttgttggcttgtgattatcctcataaaaggtgcttaattggaagcctcacagctgtagctttctgtttatagccactgagtaggtacagttaagctgactgcattttacgtgttgtgagccacggcccgggaatggagagattcaggctgtctctaagacagagctatggggagaagctgtacacgacttactggaaggtaagcattcaggcttagacagttgaagaacttggtcaagatgtgctgttttgtacattcattttgactttgttaaacttaaaatatcctttggaaatgaaacttttctttactagatttagttagatatatgagtgaatacaaattcatataatatagttgactcttgaatactatgagtttgaactgtatgggtccacttatgtgtggattttcttgcacctatgccacccctgagacctcaagaccaactctcttcttctgcctccttctcagcctgctcagtgtgcaggtaatgaggatgaagaactttatgatgatccacttccacttaatgaatagtaaatgtgattttctaataatattttctctagcttactgtattttaataatacattatataatacatgtaacatagaaaatatgttttaatcagctgtttatgctatctgtaaggcttccagtcagtagtagggtactagtagctaagttttaggggagtgaaaagttgtacgtggattttctacttccaaaggtagttgctgacccaacccctgtgttgtttaagggtcaactagaatcctttttttctcacaaatggataatttaaaatagaattagacttgataagaacacttcactagtttttacttgggtatttatgtgtgtacatactttttaggcagtcattttaaaacttatatatatatatatatatatatatatatatctcccaataaaatttggaaaataaaaaaaatttaatataatcatactcttccctggcatacacattttgatcttgtgatgaatgttcctagtttttatgtgtttatttaaagaataatagttacaatcatgtttcacatgtaattttataatccacttaaaaatcatgccttattttcttttttatgcagtttatcataatcatttttccttattgcttcaaagagttttgcaaatccaaatcatcttttcaaatgaccttaaaatgtttgaaaaagtgtctatatctaaattttcttaattcccatattggtttttccttgtttttgcttattatgtgtattactaagatgacatgtttgtggcagtagtttttcttctttctcttcttacttggattatatttttaagacctagactcttagaaatagaattactggatcaagtacatggaaactatagttattctttatataaaccaaattattcttcaaaatggttgtgtgaatttacacttccgccattgtacaaacactacatcattactagtgcttatgatattactgaatctcagggttataattatataaattatacaatcttcaactgaggtaaaatcttttaagttacctgggaaaatacaccatttaaaaaaggatggattcaagggttgtatcttgaattgaagatcaaaaatttattttcaaatctttctcgaattaatctaagcagatttagcaaaattagaaagatattctagagaatgtttacattatatatttcaggataggtgtctcagccatgaagatccagaacttgatagagcattgccaactattaaagagaataaacttttattacctttttagaaggacttgaatattttgaggctggtgaataaatgaggcctgaaacatttaagtttcttgaatttaagaagaaaaatgagtttaagctttccaaagtaaacaaagtaggaaaagcagctgagaagatagaactgttcaagataataatacttataggaccactatgcaactgtagcagattcattttaattgagatagaatttgactccttaaccaaagttacaattctgggaataagaataaagttatggcttagagtatgaccaatgtgtttgcatcataaatgtacgcacatattttttgaaaggaaatcgaggtaacattatgttataacttttatgctaggccaaagactattacctaaaaattactcttcaagcattgtttgaaatgaaaaccatatttaaaggtggtttgctgcctactgatgaaaaatgaattcatgttaagaaaccaaggactttaaacggaataaattataatcagatgttagatttagaccagctttaacaaaaacaaatgattcttttcagagatgaaaactgatggcttagccctcaaagcatctatcttttttcaaactaaatgtcttgagagaaggggatctgcttaatttcataaaagtaggtgtgtgatttatcagcagcaaattgctgagtttaagaaataagaacttccctaactcccctaaatgtttccctaggccttctaaatgagaatactttgatttgtagtaacttgattatgcaaagctatattttgcagaaggttaaaacaggacccattgggatcatagaccagatcccttctgaatgatgacccttgctgcctttgtttgcatgtccacacttactccgtaaacctctggattatagacttggtcttcttgagtaaagaaaatcctccagttccactggacacctgctgatttactttagcacttcaggcctcttttaatgagatgcagtatgagacagtcttagggctcaaaaggcatttaatagatcaagtttagaatattttaatgttaaaatgtctatcagtgactgcttctaccatccttcatttcaccttgaaaaacagctcttttaggtcataatgagttgtgctaaacactgagagcaaatttgaatctcttacttgcctcagagtaattaaaagagagaattgtttcctcacatttctctgtaatcatggggttaagttaaatatgggatagatggtaatgagtacaactagttaggattataggaggccaacttgactgatggtttggaaataagtagtgttgatttcaccatgtgattccagtggtgtcacaatgcttgagacttacctgtgtgtaaaatttacctggcatgcttgcaaaaatgcagattcctgggatcccagaaagattaaaattcagtgggatctgtgggtggggcataagaacttgatttttctcgtgagcaccccgctacctctatgtatcttcaagtaagttggtatgccgtcagtccactgtagagcgtaatagttgatacactgagttagtcagtgtgtccaatgaaaaaatatacattttgtggtatagttaaatgtattagcaagttaaaagatggaaggatcatgcagattaattatccatttggtagttcacaggtcaattttgtggggagggtgaaattatatagaatgtacattgatggaggtggaattctacttgcagtgaaaatgccaatcttccataatagttattatcaggagtgggaggccaataacattctgttcgttcaatttctaaaatcatgaagtcaatagaaaagtgggcaactagttactcatttggtacttaagtaattaatgagtaatttaatacttaataggtaattaagtacgtaataagtattgccaatattagttaggcctgtggagtttttcataacggtcttcaaataagttcagatctatatttctgttatgtgcaagggggtccctcttcttttttgaatgcttcatctactcactgcctttccatttgtttggcctttctttgcttctgctttctgactaattctgcacttccaagaagacttcaaagcaatagagccctccagatttttgccacatggatggttcacttaattatcctctgatagtcctagtattgtgtgcccagtcccactggggagaggtggggcagtagaactcctgagacttgctactgctgtattgagggccacagtgataaacacattgttgtcttatagtctgtttgatatttagactactcaaatttaaccataatctttaaaaataaaatgtaaatataaatactattaggtcatgaacaaaaaaaattaagcggctgggcgtggtggctcatgcctgtaatcccagcactttgggaggccgaggcgagtggatcacgaggtcaggagatcaagaccatcctgatccaaccccatctctactaaaaatacaaaaaaattagccaggagtggtggcgggcgcctgtagtcccagctactcgggaggctgaggcaggagaatggcgtgaacccgggaggcagagcttgcagtgagctgagatcacgccgctgcactccagcctgggtaacagagcgggggaaaaaataaaataaaattaagcaaagcataatttccatctttacaaatcctgaatgaatattagttcatgcttttatgtctttagaaaacatagttggaatggtgtcttagtctgtttgggctgctatagcagaataccatatactggatagcttataaacagaaatttatttctcacagttctggagactgggaagttcatgatcaaggtgctggcagatttggtgtcctttgaggcccgactttctggatcagagacagtgccttctatttgtttcctcatgtggtggaaggcaagaggcacctatctatgttctctcttatgagggtgctaatcccattttgagggtaccaccctcatgacctaatgacttcccaagggccccacctcctaatagcattaccttgggggttagcatttcagcatatgactatgaaggcaaaacatttagaccagagcaaatggtctaggccagattatcacacttgtcctttgtattctctttgtggtgtgagtactaagctaaaatagcctagaatattaaaaatcgtcacgtaatatatacgcatagtttaaaaatgaaatagtataaaaagacttatgatgaaaacacaatatccttccccacaaaacatactctgttccctagatgtagctgctttttattccttgagctgtttcttgctgattcttcattttcgaaatctgtttattgcattctccccattcattacctttagccattgtctgttgtattcttttgtggtagaaaggatttaccttttatcctcctctgttttcccaataaagtttaatgacaagttttagcttaatcaatattcagtgtgtatattttatttgtcctttggtgtctatgggggatttgttccaggacctcctatggataccaaaacctgatgctcaaggccctgacataaaatgggataatatttggatataacctgtgcatatcctctgtacactttaatctctagattacttacaatacctgatacaatgtaaatgatatgcaaatagttgttatactgtattgtttagagaataatgtcaaaaaaggctgtatttgtttagtatagacacaattttctgttgaatatttttgatccacatttggttgaattcacagacatggaacccagggaatgtggagcgctgactctctatcatctatgttgttgtttcctgacaagcaactaatatacaaacatttcttttcctttttttgtcagaattttgtttttcctggagttggtaattgccttgttcttttcttcccccttgggtttaatattttttatacctatcacaaattctttctacactgtctaatgctctcagaacaattttccacatggttaagatttcagataattaatcagcttttttttttccctgacaactttcctctttgaggcctgttggcctgcttcatcctttactatttgccttctggcctggcttcacagctgtcatcatggaatttgctcccatcctgggaatttctcctcactcttttctatattcaatccccagttaattatataagggaaagtctcagtttcttggctaatttattcaatttgatacatacaacccctactaatatatggaatccaagtagtagggaggtaatttttttccccttgcaacttagcgtgcctgaaaatttcaccatatccttctacttaattgtgggtttagccaggtaaagaattttgggttgaaaataatttttccctggggtgggggaggggggagggatagcattgggagatatacctagggctagatgacgagttagtgggtgcagcgcaccagcatggcacatgtatacatgtgtaactaacctgcacattgtgcacatctaccctaaaacttaaagtataataataaataaataaataaaataaattttccctagaatttaaagctttactctcttgtcatataccatctcatggcttgaatgagaattctgacactattctaatcgcctgtgacttgtttttttctctctggaaggttttaagatatttttatttcaaatgtgaaatttcagaagcatatgctttgagtattttttctttcagttacaaattgaattagctctactaatatggaaccttatgttttttggttctggacattttctagtatatttctttgattaaaaatacattttatagtctgttttctttttctggaaattcggttagttggtcttggattttttaaaaagctatttcctcctatattttatgtatgtcttgttctttctgggagaatttttaaaaatgtttcaaatcttggataagattgtgatatttttgttctctaaatgtttctcttttaaaactgtcggcctggcgcggtgtctcacgcctgtaattccagcactttgggaggccgaggtgggtggatcagctgcggttgggagtttgcgaccagcctgcccaacatggagaaaccctgtctctactaaaaatacaaaattagccgagtgtggtggtgcatgcctgtaatcccagctactcgggaggctgaggcaggacaatcccttgaacccgggaggcggaggttgcagtgagccgagattgtgccatggcactccagcctgggcaacaagagcgaaactctgtctcaaaataaataaataaataaataaataaaactgtcatgctactgttttttcttttgggatgggtgcattactttttcttatctttctaatatcaattgtaagttaaaaaattatcccatcctccattctctttccccatttcccagcctatccttcctcatcttctccacctcctttatcctccttctcctctcttctctttcccttgctttctccctcctgtccttttcgtcccccttcgccttctcctcctccccattctctttcccactcctccctcactcttccccatcggcctccctcactttcttctctttgtcatttcctcatctccttctcaatctcttccttctgttattttgttttgcttttgcttatattttggattgaggcagtaaaactgtttctgctttggtgtgatttgttgactggtcctcaccagcaagggaatgacctcgtatgctgatacatttcatagtgaataactgctacatggctgtcttatgatagtacagtccgtaacaggtagagcattgcatcagctgtgcacctgaattggaatatgatgccctagaactggacatgtggagaacccaggagcaatcttgaactcggaggaaatagctgtccttcctggttttcatggtaatgtatgggacttgagcaagtctaagtcactgacactgaagcagtagtgtagatatgtactattttagaagatcatttactgaagaaaggacatttcctaaaagaaacaatatatgggtatcactggtattatactcctagtattatacaacccctttgtgggtgttctgggccctgaacactaaatgtctgtatcactacccccttttcctcccgcattctataacaaccataaaactactccccacctctcctgcttccactgccccaaaaccacctatttcggaacacctgtgtgaagagtgggacctcccctggtgaagaaagtgttcgccagcttacgggattccctttccctttcaccatcactggagagctccccttcctcccctggcctgtaccatctggctccttctaggcacaggtgctatttcaagtgctctgaggcattgaaaaaagaaaacgcgttttggaatcagacattcatgagtattcacagcattgtctctgcccagaattccctttccccatgtcctcatgtctacattctacattaaataatcagttcaaaagtctctacagtagttattctttgaattcctgtgcttaatcatctgtgactcttctgtaatgttttagtcttgtcgtttttattacacaactatacgtccttagaggtcaaagtagaaggcttccatttattaaatgcttacagggtgctgctttgcatatttcaggggtaaaacagagcttgaaggagattgaagaatttgcccagagttatgccactggtaaatggcaaacctagatttgaacctagacttttctggttccataacttttatctcctctctctgtgccttgttgctaaataaatttgtataaataaataaagaaatacataagtattttagcataaagatgaataagcagccctgatgaaagcaggcatgtctcttctttgccctctgtcaacttccagttttggtggagaaaatagcaaaacagactgcctggtcatggatttctgcatataacctgaactttaaacatgcctggaacacatttggttctgatttaaaacaagttggcttgcaccattgccatgttattacaaatacaaaagaaatataaacttcattccattaaataaccatccacataaactcttaaatactttcatggctttgggctgggccaaagctggatattaaggaaatgattattaatgttacatattttattcaaactgctctaattcttttaaccttccctccatccctaaaagtaccagtcaaccttttccttcctcctgcaaaatgttcccaggaggttaaaacagatagaactttgatttcaagctactgactcttactatttggaaatactctttgttttcagttcctcatagcctgtagctgtgtgctctacttgaaacttttcaatcctccttggatgacagcaaagttagttattattccctatagcggtgctgtacaatggaaatatgtgaaccacaaatgtaattttatgttttattgccacattaagaagagtgaaacaaaacaggtaagattagtcttatatttctttgtttaacccaatatataaaagtaacatcatttcaacatgtaatcaaaacattattaagattttttacattctttttttactacgttttcaaaatcctgtttgcattttataccacagcatatgtgaattcagactagtcacactttcagtgttcacgaggcacatgtggccagtggctgtcatattggatggcgtagctctataggaagatcagcataagctcactgtggtgtattaggtattcctaattccattaaactatgaacattgtttaaattttggtaaagggttagggttgtttttctaaaaaaacattgaaattatgtaaatacccaaagtcttcaaatagtgttatgacctcaggccagactaaacgatgcttcagggattgcttatataagaagaaatagtgtctgaaagcaaggcattggacatgaccaacgtttctgttaatcagttggactgaaattccattgacatatgttagggtcatcagtccaccaggaagtcttcattgttaggccaataaatttgaagttcgaataaacccttagcaagagttactgaaagagttcaagttaaaagttgcttaaagcagtgagtaatgtagatgttctcaaatttttgggaatatatatttccctacatttgatagcaacagatgctttctgaaactaaaatcccctagatgagagaatgctggcctttgcttgctttctgttgtgccctgagtgtgacagggtcagcactgtcttagattgttcctggcattggaatattggcaggaaaaagattttacatgtgaaaaaatgccttgcaatccacattttgagaagtgtgtgtaatctgcagagtcttatggagcagcagtggtccccactgttagacagattaggaatcctccccctaacctccatcataatctttctaattcttattctgttaaaatattttgtgggaaatgaaattttaaaacacagtctcaaaggatgtcttggatggttcaattattggcccatcctcttgtcccaaattgccatggataatctatctagctcttttttttttttattctgagccatagagcccttttataatggggtaaatttctgttttatttcgtgtttcatttgatgtgacctttcattgaaagtgggttttgtttttaaacagcctagaattggaaatgtatgcatatacatttttctttttgcggttcacacattttggagggtgtctatttctgtcttctttggctagctattgagtttggatataactcacagaggttttccaaatactagattgtttactgttttcagctgtgaagattctactataggcctaaatgattaaagcttctccactgagagctgcacaaaatcagtgtttcattctagaaagtactaggttggttaaagcctaagatctatacctggcatgatgttattgattgtccattatctatctctgatattgcgttagtcattgtgtctccttaggcagcttatatctacatttgattttcgtacttttgccaatgattgccttatacactgtgggctgaaaataatgctgtgacagaccagtaatggtgaaaccttggttcattctcaaataggaaggaagatttaaaaataatttttacctgaatgttttctaattaaaaagcaattcaagctatttaaaggtatgctgaaaaatacaaagaaaaaatgataaacagacccaagaattctaccactcaaataacaagtgttattaatattttggtatttatcctttcagtcttttttctaacacattcactatgtatccatatatctaaatacatgtttgtttatatttgtgtctgtatatgtacacgtacagacttttatacagaatttaagtcattctgtacattctgtttttttgtttcttctttttttttttttgagacagaatctcgcactgttgcccgggctggagtacagtgtcatgattttggctcactgcaacctccgcctcccaggttcaagagattctcctgtctcagcctcccaagtagctgggattacaggcatgctctaccactcccagattattattattattattattttgtatttttagtggagacagggtttcaccatgctgcgtaggctggtctcaaactcctgacctcaggtgatcctcccacctcggcctcccaaagtgctgggattgcaggtgtgagccactgtgcccagcctgtacattctgttttatactttaaaaaaccaagttaagattgcatttttgaccatgggaatttaactgcaaaaataaaacaatatttaagaaaaaatattaaagtgaagaagaaagccatccttaatccagccactgttaagagaaaaattatatttatttttgtctattcttaatttttctcaacaggcctatttatttaattttttacaggcaggtgaatttgaattgttcacagtgaagactggtaattagagagggaaaagatagggtctgaaaattctcacacttatgagatacagcattcagatgatacttttcaccgttgaaatttaaagttagaagtgttcttcagttggttagagtattttaatgatgactatgattttaattcagaagtggaagaaactttaagaatgaacctaatgactactcttttctcagttggctctcagagctttgcatgccattccaaagtgcaaggtataattcatgaacataaaaagtttctctgggaatgtatagaaactgcatcttctacatcttttgtgctgattcctctttcacttgaattggctgggttgtcagggaaacagttaacatacagttttctggaaacagttaatatacagaataaaatatatggcatagctcttttagcatatggattaaattgatacaataagggaatgttttaaattttgtgtaaaatatttttgcacaagaatcaggctacctgaataattgtttatctttcaggtgaccgaaaagcacagcagccctcttagttgcaaatgtgttgagttgtgttaaaaaaaaaaaaaaaagatggagaggaatgccctgattctttacagatttgaagaattatatctcaattaattttataatttgaacttggtattttcttgctcaaattccaaaggggaagaaaccccattgtttatcaaggtaatgtttaaagatgtttcatactatgttataaatatgaagaacatagtccttgtgtttttagagttggctccataaagcatcagatgttataatagaaaagcatttcaaaatgaaaaggatatttaaacagaagtttccatgtgccccaggaagaatttaaagtcaagctacccccctcccatttaattcagtcattaactggacttgctctgtagtttggggggattgtaatagtttacacctgtttcaacttttgctgtttttattggcagtggcttttgccatcccatatttcttgtgaagcaaaaatatgaaataaaatatggcaaagcattggagaaattataataaacataaaaaatgaatcgttcagcttaaaatatgaaatgctttacctgcacattcagccagccacgtttcagtagtattgaagtaatttattcccggagttgtgtgtcatgaaaataaagacaattgctttcattggcaggaataatccagggtttttacatccaagcgaataaactttggaacatcaggcagacgttatattgtaaagacagtttaaggaaaacctgctaaatcattatatctgtgctcatgtcactgtggaataaaaaagatgaaggagtatcagtgtctaagattgcaaagactcaatagaagtattttaccacagagtgtaatcaaactttaaaggtcaagcaatatcatgacataaagtatggtttggctcatttcacaggctccattttgccctccaaatataatgaaaaggaaatgatttgagtcaatatattatcatatctcatatatatttttttcttccgatccagctctctaatggtctccatataagtgccctttgttcttcagatctaacggtagctgtccagctccagtgttgggttcggagtgaaataattaagtttttagtgcattgtctagaatgagaattgctaaattaaatttataagtttaatttggttagaattgtgactgtgaaaaactctctgggaaagttgctaggagaactgaattttaactttggcttaatctcaccagttaggttgctttgaatattttacaggttggggttgtaatttgaatgaaggtagggccttgcctattttgattcattagcatcgaacctaagtcctaagtatttgcagaatgaaagtgtcagcttttctgggtctgtaaaatgagcattttattttatttatcttattttttttaaatgagcattttaaatgcctaattttatattgagaaaaatgttcttcagtgatacccttttccccaatctctcacttcttggaaagactttatattttgatactaatgaatgcagactaagtgggagaagtagactctcaaatttgggctcagaagaatccgtgtttgggggaagagaagaagacttttagtgaaatgtcactctcttaataggctctcatggcctttgttagctttgtctgcttggggtcagtgaaagtccttcaggtgacctggcatcctgggagtgaattgagtatgcttctccctaggaagggctaatgattgggactcaacaccgtttgcacctgagaccatgatctaaccaacaactcatcagcatcttttaccaaggtatttatgggcttgggaaatggatacatcagaattgaggtaaaatcaggctcagatttagaatttcttgcacacaaacacttggaataaaaaagtccaaagatttttgctgccagtgaatgtaatttgccatttctggcttcttgcctgctgttttccctcaaataataaacttgctaaaggtgcaggtttctggttaaattttagtgattttttttcaccttggaacagaggtaataacagtttaggtctaacttaggaaatctttccctttttattcatctggaggttgaagggccattctgtgaagggtgtttagtgttttgatggacttggaatgaaggggcatgacaaagtgtgatgtaatgagtttgtcttgagcaaaataagtctcctcaaggaagtttgtgtaataaatatagttgtataatgaaatttcaacagatgaattctaagttgtgaaggaatttcctgtggtaaaaagggcaattatctactttgcttgatagacctttgaaaatatatttgattctaaaaatttcttctcacagaagagtttcctcaatgtgactagatatttttttgaatctccatgtccttatctgctactttcattgccatgtgaaagtgggtatcattgagggtggctcttttaaaactatttttagccttagacaaagacagccaagaattggctaagtgcccccccgagacacttttcattaggtttgagcactgaccttttatcttgcctgggtgttcgctttagctagggccacccacacttgccagtttgcttagaagtttgttcaactttactttttatgttttcattgagctttaatattggcatattttaaagttacagaatgaaaatcattgtttgcagagcaaactacagataatttatttgtagaaatgtgtgattcaaatggcctccatcagtgtgtaaggaaaatggatgtgccgcagtcaagaatacgtcgaggcagacatccagttcagcatgacccagcgagtttggagtgcaggctcccaactccactcattatgtaaccacgccacatgaggcgcattaggtgtccacccacatgagctcgtgctttgctcagagccactattgtctgtaaaaggtataattaccctgctgacactacatgcagcttgtgccccagtcggcttgttcgtgccaagagacagaataaagccacgttgaaaccccctacgattccttgagtgttctttcagctgtccaccactcatccacccactcctcagtcctcagcttgggctggaacctaacacttggcatgacacttggcatagtcagcaggatactgaggagagagagccttcggtccccactgattccaggttgggcatgtgactgcaacatgagttatggtgcccagtggcagctgtactgcttaatgggctctggtggaaacctaggtggtggcagtaaatcggtcccccacgagcatggaagaggtgctgaagcagctgcaagtgcaaagccctgagaaggagtgagcttttgctggcagagttggataggcatttttgaatgcactatgaaaagtacacacccagtccctgagggatgcagcagaagtaagggccctccaggtgcaggctgggtgcctggaggcctggctacacagctcagcaaaagatttagaagctgccgtaagtggggaccttcaggtgcaggcagggtgcctggaggccaggctacagagctcggaaaaggaattagaggctgctgtgaatgcaggcctggggctgtcgtctcagctggagacccccactctgataccgaggaggctgttagtgagaccgaggggtctgctccataaagaaggggaagatgccctgcctgcaggggtccccccactggagaacagggggccccaacaagtgacatgctcagagatgtggattgatttggttttggccaggattgactgagagaaaattgataaacagccaaatgaagtactcttaactttgtgcaattccagaaaatgccccaatgggagaaggacattgctgcacaacctggtcccacctgggcgcttcagctcaaagactccgtatgtgctacagccaggtgggggtgtaaagccttttctgtatgatgagggaactggctgaggttcgacttaggggaacaccagatgactggaggccacatgtggagttgacagtccattgttaccccaccaacatatagcaagtgctggtgctggtagacaccagcacagataacgttttgggcatggatatttcacatggcttggcagccatgctgtctatcagtgggcttgacaaaactgagacagtaccactttgtggtggacttggccaatgcattcttttccagagagccaggagcagtttgccttcatgggagggcaacagtggactttcacagtgttgctgcagggctatgtgcatagccccaccatatgtcatggtcttgttaatgatattatgctaacttctgattctcttgcagatttagaagtgacaatgctccccttgcctagatttaagatggtgcggctgagaccaccttcctggcagccaggtgggctattcagcaggcacaagccctacgggtagttgaccaggggtacctgtttgagctggatgtgcatgtgaccacagatagttttggctggggcctttagcagcgcatggagcgcttgagaatgccagtaggcttttggtcccaactgtggaaaggagctgcgctccagtattcactgttagagaagcagttagtaactgcatatgctgcccttcaggctcgtgagagtacggcaggatgggctacagtcgtcgtgcggatgacttagctgatagcgggatggatgcattcatggataatgactccctgaaatgggctagcacagacatccactttagcaaagtgtggtgcctacttggagcagcagagtacactgaatacaagtcccttagcagcagagtacactgaatacaagtcccttagcagcagagtacactgaatacaagtcccttagcagcagagttgcaagaggtcttgggacttgtagtcctaatggaagataaggccatggggcctgaggcacccctccattcctgatagagcatggtatacgaatgggtctagctggggtgctgctattgcctggactgctgtcacagttcactctagtactgacgccatatggtttgataccaagtgtggacaaagtagctaatgggctgaaatcaggacagcatgaatggtgatcaccaaggtggtgacacctacggtaatctgcaccgacagcttggcagtttattgaggcttagccttgtggttaactatctaaaagtaacagaagtggccagttggtcactggcccatatagggccaagccatgtggcaaaacctatgggaggaaggatgacctcctctgaccaggtacagagatgaatggtaacctgttgttgcctgccccagtgctcctaaaggcagggaaataaaagcttggctaaatgtacaaagcaacattggtgtaatgtcaccatggggtggttgcccaccataacctggagttgtttttccctgtattactgctgtggcctctgggtccagggtttcaccctttgggcatgtgtccccactagaaaaactccctctgcctagggggtggaatgtaagacctatgtgttgggcctgagtgtctggggcctgtgtacctagagcctatgtgtaaggtcttgtgtcggacctgtgtgtctggggcctggcttgcatgcccagaggctatgtatgaggcctgtgtgttggagctgtgtgtccaaggcctatgtctcccttggcctagggggtggagtgtaaggaaaatggatctgctgtggtcaagaataggccaaggcagacatccggtcttgcatgtgagtctggagtttggagcgcatgtacacaattccactccttacataaccacgtcacgtgaggtgcattaggtgatcacccatgtgaggtcgtgcttggcttggagccactattgtctgtaaaaggtataattatcctgctgacgctgtacatatggcttgcgcctgggttggctcgcgcccaggtttgcacccacagttcacgcccaggctcactcacaccaagagagagaataaagccatgtcacaactccccatgattcctcgagtgttctttcagctgctcgtcattcatccaccccctccccttggtctcccgcttggtctggaacctgacacttggcgtgacacagtgtctgggtgcagttcatcctattgatgatgtggaatttgtgcaaaaataaaagttaaaaagacattagcattataggttagtttgcttttgctgctgtaacaagttgccacagtgtagtagcttaaaacaacagaaatcttactttttgggtctgaaatttgaagtggttttcactgggctgaaagcaaggtgttagcagagctgtattctctacagaggccatagggaaagataatttctttgacttttccagctcttagaggccacctacattccttggctcatggcctgttcccctgtcttcaaatctttgtcatctctgatctgtcctttgttgtcatgtatccatctctccttgtgcttccattgttacatcactttcttgtactctgagccccctccttctttcattaaggacacgattacattgggcccatctggctaattcaatataatcttcctatctttttatttaatcacatctacaaaatctcttttgccgtgtaagattccagggattagtacatgaacacctttgctaggagtcattattcagccctaccacatattagaatacaatttttaaattcctttttagcctttgtttttatgttttctcagattgcccttggaatttccagaaacatgtactctgcaatctgttgtttggataaaaatgtgttggtaaaaaatacacatttctataaaaatagagaagatgtcttatatttaactgtaaaatttaagttggtgaaaaaagaatgtaaatacttgttatttctttgagggcagagagaatttctcaagttttgaatctttttttttttttttttgagagagtcttactctgtcgccaggctggagtgcagtggtgcaatctcggctcactgcaacctctgcctcccgggttcaagcaattctcctgcctcagcctctcaaatagctggaactacaggcgcacaccaccacacccagctaatttttgtatttttagtagagacagggtttcactatgtttgccaggatggtcttgatctcttgaccttgtgatccgtctgcctcggcctcccaagttttgaatctttcacttaacaatgtcaaaattatggtagatgcttgtcaaaacttgctaagtgacaaatgtgattcttaagtgattgctctgccacatttcttgggtctttagtcattttaacaagtgttctggacacacacacatatgcacttctgcacacaaacatggctgtgctgaggtattacctagcaggtgtttggtttaccgtggtcttccagactttaatttccagtagttctcacttcagtacctttctttgtcctggccaggcttctctcattaatcactattccacctacacctgagtcagagtcctgtttggccttagaaagatgcagtctgagtctgttgcaagcaagatgctattggctctttatcacttctctccttttagtcaaattccccacccctcaaaacaaatgaatacaaaatgttcatagtcacaagacttatgaacacagactgagaaatgggtttgtcttgtatttatgggctaccatttatctataaaaatgatatgaaaatacagtgatattttaattaatgttacatgcaattttattgttggctgtgaccgtcaccattactgtttaattctcatgtttttttttctctctttgtatatacaaatgaaggagtgaattaaaagtatatgatgccagctgaaattcaagtagattatatagactttataaagcataaaatggaaacagctcagaagtaggccatatacatgagccatctttgtgcctgggattgatcacagataggaagtgcttggaatgctacagttgattactttgagagttgcatttattcatatagttctttaactatgaaaggacgagatcactttcatcatctaagtgtgcaggggtttgtgagtctttcagacaaagcaaaagagtgttaaataatccagagacatgtaattgatggattggattgctagtctttaccagttttgcatcccagtgaggcatattagcaggcactgagctgtgggagagcaaggctggcatcttgtttgcttttgcattctcatatctgatgctcgaaagttttttgaatgcatacattgaaaaagtattttaaatgtgcacatttttatttacagctgctgctgaagggaaaggcagaagtggggaagacttttttcaaaaggtaagttgtcttttactcttgtcatggtgataagtaagaggaaatatacttatctcaacagctaccctagaagccaccgaacgctccccttcatgtggaggagaacaggtttctatacgggagctggaaacactcagagctagccaggaaaagaggggatgctgtatgaaacttaaccattccaagaaggctccttccagggaaaatctaatgaaatttttgcttaaaggcaaataagcaaaatgtaagagggctcagaggtggatcaattcatgtggcattcacacttcatttggctggcatgtgacataggaaggggttattgtgcaaggtaaggtacactatcctatatggtgaatatggtgggggagcttttctaaagatatttaaattaaaacaaattttaaaatgttctactggccaaatagaatgtgccagactgctagttttccatcctttgctaaatttataggctcaggctgatgcagtttaggtactgtaccccctgacttggtgttatctgacattggttaatctccaacttatactgaatacccgagcatttctaagtgccctggccttagctggggcaggcttagcaacaagggtaagacaagagaagacgaataggctggatgcagtggctcatgcctgtaatcccaccactttgagaggccgaggctatcagattacttgagtccaggaatcaaagaccagcctggggcagggcatggtggtgtgtgcctataatcctagtgctttgggaagctgaggcaggtggatcacttgaggtcaggagtttgagaccagcctggccaaaagcctgtctctactaaaaatataaaagttagcccggtgtggtcgcagatgcctgtaatcccagttacttggaaggctgaggcacgagagtcacttgaacccggaagacagaggttgcagtgagctgagattgtgccactgcactccagcctgggcaacagagtgagactttgtctctaaaattagaatagaatagaatagaatagaatagaatagaatagaatagaatagaatagaatagaatagaataatccagcctgggcaacatggagaaatctctcctctaccacaaaaacaaacaaaaaacccaaattagccaggtgtgatgatgtgcacctgtagttccagctcctctgaaggctgaggtgagaggatcacctgagcccaggaagttgagactgcagtgagccatgatcgtgccactgcactccagcctgggtgacagagtaagtccctgtctcaaagaaaaaaaaaatgaaaagaaaacaaatagcagaaatcatagatttcccttgggttggctctgatggtaaaaatagatgctgtcagtggaaggattcttcttcattgttcttctttaactcacagatagatgtaaaaaacagatgctccacctttgtgatttcagacaatttaaaagctgagtcaaaatatggtgtatatgatcataaaggactttcattcttagatttcctaatatttctcactgtttgcagagacatatatacattccagcagtttaaatggaaacacatgtttgaatccaggaacatgtgtgcgtcccacagactatgagttagagtcatagattctattcttggtcacagattaatgaggtctctgaataactagatgggagtacattttatcttctcatttgtttctttagttcaatgggaactgtcttttccatagataggtgtccgtataggatttgcatactcatccagcaaaaaatctctaacttagaaacagcccaaattccagagagtcatttttctgctattttgactggacagaagtagacattatggttcatctacagtagaatgaagtaatggagaaatactgaattgtcctccaggaacttgcatgcagtcacatgtattctagttttacatgacattttgggaagcatttaagaaataggctacatagctgttcactagcatcttcgtatttttctctctctaaaataatgcaaatatgaaggatctaggcttgtgattggaatgtttcttagtttttactttgaggtgtgcatgacaaaagttaaaacctctctttagctgagtttaaacttcagctactcaacttttctaagcctggaaggatatctacctagcttcatagtgcctctccctatgtagagatttgagaaggagtgtgagacttttcatatgtaactttatgtttttttgtaccataaaaatatatgtaaaatcataatgactatactaaattttgctcaatttaattaattgctctcattaaagttttcgaattagaaaataataaaattaattttaaaaatcttccaaaataagaattggtatatttccataaagagcttgcatttcagtttaacagataataagattgtgaaacatattatctcaaatttgaggctgtaatagtagttgttaagcttattatacacttcttccattgagtcaacgttactgttttttccagagatctacccagttttctatacactgttttgctgcatgggtttgaaatgatatatttcccaaacacaataaaggataaaatgtaaaagcctaagatgttatagcaaaaaatccccaaaaccccaacaatatagtgtcttaaagagcagagtcattcgttgtcctcttatgtaacgttctaaggagagtcttccagctgggttggtagctgtgtcccatgctgtcattcagtgacccaggctccttctaagacatatctggattgtccctaagcatgaccttcatctccgttgttgaagcttggtcacaaccatgtccaattgtgtgttggtgagggagatagaatattgaagagaggcacgccatggttgtaacgcccaggcctgaatgtggcacctgtcacttcctctcacactctatgggagaaaacttagttatgtagtcttacctaatagcaacaatagaggggagggaggggctgggacatttggagaaaacaattgattttgcaggcactattcaccacaaatgagattgttagggaaaaaaaaaagtctgtgatcaaagtgtaatttctttgtgtggtgtactttgaaactttttgtatttgttagggctcccataccacaaactgggtggcttaactgtgggagggagaatctgttccatgcctttctttagcttcccatggtttgctggtgatctttggtgttccttggcttgtggaagcaacacgtggatctctgccttgatcttcatatggcattttctctgtgtgcctgtctctatgtccaaataaagacaccaattatattggattagcagcccaccctactctggtgtgtgttcatcttattatacatctgcagtgaccctatttccaaatatcacattctgaggtcccaggcattagtacttcaacatacgactttttggaggacagttcaaactataataccttttaatggagaaaataattctgtagaaaaatttactaagactgtagatgttatttgtcacattttgatactcagtctgatctatagatatttaactgcctagtcatttatactaaatctatttttttaatcacaagtcatttctaaattgtctacaatgagtatataattgacatgcaaaaagagaaaaaagtaatctgtaatcttgcctttttgtttttgttttttgtgtttttttgagacagagtcttgctgtgttgcccaggctggagtacactggcgtgatctcagctcactgtaacccctgcctcccgggttcaagtgattctcctgcctcagcctccctggtagctgggattacaggcatgcgccaccacgcccagttaatttttgtgtttttagtagagatgggctttcaccatgttgaccaggctggtcttgaacttctgacctccagtgatacacccacctcagcctcccaaagtgctgggattacagacatgagccacagtgcctgaactgtaatcttgcctttgaaagagaactatttgtacacccttggtcttttttctgtgtatattaaaaatatatataaagtgatttttaatattccctgtttgatgggattacagattaaactatgtatttgcattggatccattctgtgttaaaactttgcaaagttatcctgtaatagtactttttattcttcggctctgactacacttataaaaggcgggaatggatataactttatcagtactctccgtccactcctgatggcagctctatctaatggaaacacatggaaacaatcttccagttttttacagttctttgggcagttgttcatggcttactcactgtctgtcctatttccttttaatcagttctttttttctttctcttgtgaaatgactatggtcagatcttggaggggaaaatgggttacagtattttaggtggggatagggtcagtgattgtattacacatgtgactcatcaaagcaaactgcattaggaatctgtaatcccaatggttggagaagacaaaatacagtcagcattgtaattgatgaaagccaggtttttttttgttgcattgggttatgtacagtatttttcctcaaagtatacatcatttattttaatgtaggactatgttatattctttgaatatattggatgtttatttggaaaactgacctataaaccatggcttgtcacaaaggctaacagtaagactaaaacaatgagatattgatggcttatgtggtttatttttaaaactttcaaactcattgtttttagacaaacattacttttggtgttttcagactggaaaatagcaagtgttgtcttctgggggaaattcctgggataaataatttggttccctctgtacctaaaaatgggtgcattagatggtcttagatggggactaggtgagtccttttattgaggggcagcagagttaataaagttactctggctttctccactagcgattatttttatatttcgagtgggttatttcctctagtaatggatataagttttggtttaattatttaaaagtgaattcagttaactctggctcatgaatgtgctttttctaatactgagtctgtgcttaaacacaaatcaaatttaatttaaataagatccagatattttaaagctttaattttagtatttatttcaataggtaatacacgtacatggctcacaattcaaatttataaaagggtatgcagtgaagagtatttgatatcttgatggtttctgaaggttcactgagaaagctgtgcagcattacattgttggtcccaagcttgggtaaagatgatcatcaatgtgcgtcattactaatgaaaacttagggcctaaagctaacattctgtgagttcttattaccgatcactatactattgccctgagaatgttccagtgacagaatccgtgatcatgttttctttatactactgtctagataggaataactggctgcttgtaagacttagaaaagaagagtaactttccaccccgtaaaggttgtttagtcatcatctagaaagttactaaagatgagaatggagcttatttttataccttatgatttactcaccttctatcaagaatctagtaaatcagggttagtgagaagagattaagaaaaagatcaagtaatttgctcatcattctcctagtctttcaagttttgttcttgtgttcatttgaacacaggaagactgggttttgagtctatattctcttagcatgttgtagagtcacctgcttcgagttgcattgtaatggtatattcttttatttcatcagtcatttcacacaacctctttatgaaaaccacatttcctgtattattcctttttctaaaaccatggaagcaaggaatgtcattgagattgtttaaaaatgtatgtttaatggccaggcacagcagctcatgcctgtaatcccagcactttgggaggccgaggtgggcagatcacctgaggtcaggagttcgagaccagcctgaccaacatggagaaaccccgtctctgataaaaatacaaagttagctgggcgatggtgcatgcctataatccgatctactcgggaggctgaggcaggagaatcgcttgaacctgggaggcagaggttacagtgagccaagattgtgccattgcactccagcctgggcaacaagagcaaaactccatctcaaaaaaaaaaaagtatgttcaatgatagtgaacgtaacttaattactactgcagtttgttcaattgaataatctttaatcaacatctgatgaaagtttagtcattattgattaaaatggttccttgaaaccaaactcaatgcattggatcatgtagaaaatgaaattgaattcatgaaaataggtcttttaagaagggtcacaagacaggaccctggattacacacttgtagtgcaagtaaccatggaaaggtctagttaagagacttattggcattagtttaaaaaggtttgtatattattttgtaaagtgttctccctttatgacttaaatgcctacattaattcctgtacttgtcggcatttcccttaatcgaaagatcttgagatacagacttcctcatttatggttgatattaagattttggaactatttcgacattatgtagataaaaattaccctaactgataatatgcaaacgtaaacatttttgtgtgggtcagaagcaacttttgaagagggtggcattagctgtttgtgaggaaggagtgcatttgattagttccaattttagccttgcctttgcattgtgtgtctatttaattgtcttttcaatgtcatgtgattcaaattgtttttatatcttagcgggggcataggacaaacttggtcttaatatattacgtagaacattatcagagatgtgtctgaaaatccatatataaagatattcattgtcacaatattgtaataattaaaataaaattaaaaataacctaagtactcagccatgtaatatttgaaatgtggtatatcagacattggattattatgtaggcattaaaaatcatactttttggaaatatttaatgacatgttgaaattggttactagataggtacaaaaattaggacaaaaggcatataaatagcttgactcaaattttgttatatatgtttatgcctaataaatgactgggcaagaattatgccaaaatgttaaccgtgactctcagtggtgagattgtgattggtttttattttctttctgtactttcctacaatggacctccattacttttataatcaggattaaaaacaactaccatcttatgaagaaaaacagataacaataactaagatagattgaagttgttaatggattaattattgcagtttaagagcatgcagtttttttgctgaaaaacatttaagaagtcagacttcccatcatactgaggttacttctgtgtcttttatataacagttataaagacagaacaagtttcagatcatcaaggtggatcatttctaggtagtgttaatttttagaaaaatgtcccccctttcatccatttgcccttgttttgacattcagaggtgtaaaatttttttaagatttttttacatctctgtgccttcttttcttcagaccaaagatacttagtttcttatttatcatatgacttagttttcagacccttatcattcttttcgctttcagtagcaagatcagtgtcccattttaaaagtggcaacaatatctgggtatagtgttttggatagagcctggccagtgcaattataatgaggccataatattcataatattaaggtgatccagaagtacctaaatattatataacctttaggcactgttacattggtcactgacatgaagaatcgacattacttgtcattcttcacccaactgaagagaaaaggttggctccaatgtcattgctaggtacataacataaaatgaggatacttctagactgttgactggctggtaaaggcctccatagatgtcactcatatgttgtgcctgtcactctaagctcttgacctgacatgtagcttggagacaatgtggcagatgtggtggctagactgtgaaagtgtggaaagcctcactctgggagatttcacatggtttggacattgaattgatagtgagaactcctgcatgcttttttcttctctctggactccttgagttagctgggggaaaggactcagccacagggtgacagtctaagatgatgggctgggtgtagtgccttttaatctggctaaagtaacatgtagtaaagaactttaagctttactgatttaaaatgacttcacagaagaatcaatgcagtttaaagctggatgtggtattgtctttttcttctagtcggggatatcgtggtctaaatagtcgtagattgatttttttttttcaagtttatacaggttgttggtggcagccagaacttagcgatattctgactttatgcttggctactattaatacaagataaatgtttttatttaaatcggcaattatcatgcccacattaatgggctatgcatctatagtgagagaggttctgcctaaaactgtaagttttgctaagtagggctctgaattagggtcattgtggcatattagagggacaaccaaaaggctgggggcaaattaatatactaaataaatgtatggattttgtagtactttgtattttgtttaaatagattcagaatcacactaaggtttatcattttgaagtttgtacctttggtaccttactttttaaatttcatctaggagatttacagtaatgatttgttgtcatctcatgaatcgtttctaaatttgagtttgggaatctttctggtttcttaacaatgatctttggcttgatgtatttgatgtttttgcattttatcttggcaaagtatgttgcgttaaaatttgttttttggccaattcaattctttaacctttaggcactgttattcaattcaacttgctttcctttctaaatagcccttttaaatttctaggctttgtagtttacatgattatagctcctaccttgctgcatgaaaaaggagaggagaaggccttattttgcaccactcgactctgcttccctgctcttccagccacagctgcttgggccaggatgtgggtgccacatgcagcaacaaaccttctctatacagtgtacgtgacctatgtggcatgctctgtgaactcagctgagccagactcatctctattgagttaggaagctaagatcaagagtgggaatgagaagagaatggggagggtcatgaggtagcatggagtgagggagaggccaggagtggtgctgttgatcatgggaaagctggggttaggagagggagaagctgtgaataagtggtgaagacccatccacggagggaagcatgaagcagaagacagagggggaaaaagatgttccagagtgagcgatgctcctacttggagttggcacagtttgggatgcatctcaggttcttttcctgtttttgttttgttttgtttaaagagatgggttttgctctgttgcccaggctggagtgtggtggcctgatcatagctcactacagcctagaactcctgggctccagccatcctcccaccttagcctcctgagtagctgagactattgacatgcgccaccacgcctagctttcaggttctgatctataggtgtccctagagtcttccccttctcctgatgtagttgggaaactctacaaggcctaaatcatgaattcaactgtgatgcataaaagacattcagttaactgggataattgcataatccccttttcttcaaagggtttatgcattcacatgttaacaaaatttggtgtttgtagagtagtttagctcctcagtgagtgccccaaattaagttatatctttaaaggagcagtgctctttatataaaaggtatttctgtcaaatctgtcatttaaaatatgtatactgcagcaatactacggtaaaatattagaccatactataccagtgtatggtgaactctctccatatattacatatatactataaagtatatatgtttctttttgctagtcagttaccagcattattcaagaaataatggggttattgacgttaatatgttaggtgaaaaaagtgagtgctgtccttttatgttactgagcttttatcctgcatatcagaatttcctttctctttgtcattggcattaatattgttttcatccctcttacacttctgtgggaagtttgtagacagccaacatgcagaaaggttagcatggcagataaatattttctatttttcttattgatagttacggagaatgctttgttactctatgcctctctaagtaacatgatccttgaatagatgtattaaatatcctagtgttactctctcattttatatgtttaacagttgcggcttgtcccaaactggctctttggcaggtttttttctttctttttttttaaattcattggatgtaaatttcttcctaaaaggagttgtcttttggcattttaagtagtggaaaaataaatttcattatctttcttctttctttttttttgtgaaatcaaaattatcaagaaatgtgtacatatggcttttcttcttagcatttgctacttttgttacttttgtcaccctggattatccagttattcaaattttctgcttctcaatgggcaaagtaccgataagtagggaaggagggaatttagccaaagttgtaactgacaataagcaaaatatagaggcctctgtgtttcctgcttggttctctttcttgagttcatcactaattttatgaaagaagaaaacaaaacagaaaaataaccagcttcaatttccacgtgcctgtttattctggagttaccaggaaaccttaatctccagtgaataagaacactttaaacccaaagttgtttgggtttgttttcttaaatagaacttcttcctgttatgttttcctattggcatttgtaaaacaatgattcatgtgtaaatcagtaggaggtgctctttgagaagcttcctaggttggtaggttccagagcctaagcttttcttggcttcagtcagtatgttgagaggggaaggtattaacaagatcaaggaagtgatagttttcggtatgtagttggaaagtgggtatgtgtgtcttctcatttgaatatcactttgttgtccttttcatatattaatatgatgggctacctcataatctgggaatccaaaaattatcctgccttcttctaaattccatgagaatactaaagaagaagtaattttaactttcaaagagcttttattctgaagggaaaagatgcttgtaagatggtgttagcatgcatgtgtgcaggcttcacagagctgctaaggacgccattcatgagacattattgccctccctctgagccagacactataccatgtacagttctacagagggggaagggtggccctatggcttctctcctcaagaggggcatactccagaggagaagtggcacagaagtgccatccagtgtggcgagagctttacaatggaggaaacggagggagtgatttttttttttttcccctattctgaggactcagggaagatggatttcttgggagaaagtgtttgaggtgcgttttgaggactaggtaaaaggaatttaactagtatgttgggtgaagtgaggaaaggctttgtggcacagtttctgagcagggggcagtttagattagattaagatgccttccagacctgtgactccatgacctgaatgtcctaatggagacaaaataggcatttccagcagaaagaaccaactgattgcctttgcaaaggcagaataaaggacagaggagactgtttttttctcatatagcccagaaaacagattaaaggttttacatagatagatagatagatggatagatagatagatagatagatatcacttcatctgagctagttatttaaaaattctttaagtgaaaggtttagaggatatgtagaaggatttgaaatctaaaagttaggagatcatattgtttctattcattattgatatggtttggctgtgttcccacccaaatctcaccttggattgtaataatccccacgtgtcaagggtggggccaggtggagataactgaatcatgggggatgtttcccctatacttttcttgtgatagtgaataagtctgggagatctgatggttttttaaatgggagttcccctgcacaagccctgtaagacatgactttgctccccatttgccttccaccacgattgtgaggcctctgcagccatgtgcaactgtgagccaattaaacctctttctttgataaattacccggtcttgggtatgtgtttattagcagcatgagaacaaactaatacaattgtctactcaaagaggatgagaattaaaaatgatagccagggtgaccaaacattttgcagtatagttgctttgcagcatctgacttcattagtgccaggtaagggacaaattattacttttttccactaccttcctaaatgataaatgcattcctagcaagattaacttttaactatgctttgaaacatgagttttcagctattgtgatgccatcattacattctgaatgataaaattgccaagttcagaatgacagctgtaaaataaatggcatcatttaattaagttctgaacttttgatgatatgcagtttaaaaaaaatgtattttccaggaaaacagttggaagtttcgactttgtggtttacttttggctgtgttttatggaaatcacatgaaaacttctgagaaaaagagacaaatgattcaaattttgcaagtaatagaaaattgggttccatttgtataaaagattccctgaaatcattcactatcagtttagcacactctggtattagcatttaaccaccagtatattgatgaacaagtacagaggagaaagccaaggatatttgagatccagtatcatatgcagaataaatgtaataacttttaggggcggaatttcttttctttttcttttttttttttcttttctttttttttttttttttagatggagttttgctctcgttgcccaagctggagtgcaatggcgcaatgtcagctcactgcaacctccacctcccaggttcaagcaattctgcctcagcctcctgagtagctgggattacaggtgcacgccaccacgactggctaattttttgtatttttagtagaaacagcatttcactatgttagccagactgttctcaaactcctgacctcaggtgatccaccgcctcggcctgccaaagtgctgggattacaggtgtgagccaccacgcctggcctaggggcagattttcagttgaattattaactggaattcatgttcctgttcccatttctccagttctaccgtcagccattttagtgatagtaaactcttaatctagagcaccattcttaaccccaggtacaggtttgtctgaggaacttttaaaaattattgatgctttaactagagattctgatttatttgttctgaaagtaaggccttagcattagtattttttggaaaagctcctcaggtgacattactctgtagctaaggttgggaactactgatgtgcagtatgggtaggtacaaagaaaagttgtaaattcttgttggtctctacctctgataaaaggaaaggaattacattttactcttgaacaacacagtggcgagggttgccagcccccaccccactgtgcagtcaaaaatttgtgtataattttctctccccaaaagctgaactattgatagcctagtgttgaccagaagccttactgataaaatcatcaaataacatgcattttgtatgttatatatatggtataacgtattcttacaataatctagagaaaataaaatatttttaagaaaatcgtaaggaagagaaaatacattaattattcattaagtggaagtggatcatcataaaggtctttatcctcatcatattcatgttgagtaggctgagaaggtggaaaaagaggagaggttggtcttgtctcaggggtggcagaggcaaaagaaaatctgtggtagacccgtcacagtttaaactcctgttgttcaagagtcaactgtatatgtattttgtgtatgtgtgtcaattactgatggatttaactttctgttcagtttcattctcttagagggtatactgtgagatactagttctgcactatcttaataaatatatgaaaaaagttccatggtaagataagtttgagaaatacaggcatttacagttaaaaaatagttctttcctataaaactggttgcaaacttaaatgtgctggttatttgcattttatgcatttgttacagaaatatgtaatttgtggcacttcccagtattgtttgatgaaatgatttctttttcttgctagaaactccattctacaaaattaaacaatcagtgaatcagttggaaattcatttttttcatttactgagatctgtgttaggaatggatgtgatgtagctatacaacagaggctctcttgaaaagttcctcagtgagccttatcagaagggtgagagtgtaaattattccaaggtacacaattcttttctaaaagacaactgttacctttttatatccatgctcagaatttctctgacaactcaccattgccttccaggtaaaattaaataaatatccacctttgacatcaaatgtttattatagtctgatcccttcctactgatataactttgtttcccattgcccctcaactcaagcctttctcttgtcaaccagtggtatccccaagccctgatcgttcttgactctaacagcgatacataaaaatatatccccaactagaacgtctttttttcctctttgtctctggccctctccattagttatatatttaaaagtccgtcatttggcattttctggactagcccagcctgtgatgacagttcccacttctttatatgttaaacttacatatctgtggtcactttgtttggattttcttagaaagtcaattttcttgttttgttctcttgttatgagttgatacactaatagtccaactagtttctgaatcttgaattgagacactcaaatgttttgggacctaacacattgttctgtgtatttggtggggtgaagtaactctgtagaattgtgatgttgtgggactgtatgggaccttaaagatttcctagtttagcaagtgtacaaaggaggataagacctagcatttttaagtgatttatctgagtcatatgactagccatttgttgaatctggggagaaaacccaattcaacactgtttattacactgacaattcataactttaaaaaatctgtgctctttcaagagaaattaaatttcgtatttgtctttcttaatgggaaaacacagtaaattaaatattattaaagcaataagaggtagtgctatcttgtcccatcctcctgcctccccacctcctccccaacacacaaaaagatcctatgggtgttcttaaggagctgttgtctgagatagggcctaggaagtaggtttttaaaacttgggtgatccagagcggatgatgatatgcattcttccatacacatcattgtctcctcctcctcctcctccttctcccttttttccttccccaattcatgccaggctgtcattttgaatcaataagtgaatgtaacaaataagagatgttaatactatgaagaatactgaactaggagccatgagttctggctttgaattccagtacagtcaccagctgtgaaatcttgggcaagtcatttgacaactgagcttcagttctcctgcttagaaaatggggataattcctcatagaattgatgttaaaattggttgaaatatgcactcaaaagtgctttataaacagtaaagcattgagcaaatgcgagagatgatttgattctttagagaagaccctttcattctagtgtttgcatcctctggctggggggaaggctgtgtggctgatgtaggatgaggcaccttccatatctttagttgcttgaaaaaaaccacacacagttctataatatttttggcaatttgtctcagtttaaagctgtgatcgtaacttttatttggggatactactttcttgattcttatatggggaaaaattccatttgttggtttccttttatttaaatatgtttatgtattttgcattttagaataaaaacatttccttctcgagtgaagattttttttcttttcttttgaggtggtggttaagttctcatgtaataggatagttggttgctattagaaatatgttttttcctttgttatgaaatggaaaattgtcagaaactgataggctgtggttagatgaggtttgctaccaataaagaattatcagggtaaactgaactttcatttaggatgcaaaaatatttgttttgcttggcagcatggcataaaaagaaaatccaagaaacttcttgtttcaggagctgccagttctctctgtggctcaaagaacgtttcgtgtctcagccacaagaatttgccgctggttctgatgttcattgtcttccctcctcacgcacgctttgctttcagcttttggctttacagccctttgctataagatgatgaaagtccttccagggctactcattaactttcccttctacatcttactggtatgaatagtgggagcctttcatctttattgttatgaaagcttttatagaatattgaatgcagggcactgtgttagagctctgtaaaacatgataacatagtagattctgtcagttattggctgtgagtagaggtagtttgttgaggatcagtataggtaccagtggcataacttataaattgggacaggcatggtggaccagaggggatctagtaactaagcactgtgatagccaggggaatcacttaaacaggaccagtaaggtacagaaggcctgggaatttgggggaggtatgcgaacaggaagataaagggactgatattaggaaattagaaggaagaatcttggatgtaggatgtagtggaatgaagtggattttaaagtttctaatactaaatgacagacatagtaacatctagcaggagggctgttttggaggaaaaaaagaatgtaattttaactaatacgatgacttttaagtctaggtggtaaggtttagagtaacagagcagggctggaaatagtgacttattaggaattaacttgcattccagaaattgagggttcatgtagaattgcctgtaagccaggagttttcttattcatctctttaatgttatagaaaataacatctgtactttatggtaagtaattacagagttaaaaaaaaaggccatttgaaaaaaacagcttaaaaatgtcaaataggaaatgtggggataagtgtattcttttcaaaatgtggttctgaattggactaactcaagctgcagttaaaggaaaaaaggctcgtttatttgactcttgccttctttgctttctccctgtctcaggctcctttccccaacgcctctcccctttttggtctcagtgcttctgaaatgtagacactggtctacacatgggtcacccagagttcacagacttgaaagtcctcttattcccaagagctgtgtgtgcctcatcagccttctctgggttttgtggcagggggtgatgagaaaggatgcccagaggctacttgtaccaataagagccaccgcttgttgtgaaaagagcaccaatgaggagaaagcaggcagagatagtcccggcactgggtatctcttcaaggcctctggttccgttattcgtcaaaggaggggtagaactaagcatatggtctctaaagctttgaaattcttttttcttttcttttcttttcttttttctcttctcttttttctcttctcttttttcttttcttttcctttttcttccctccctccctccctcgtttgctttcatctttttctttcttgcagttgacaaataaaaattgtatatatttatggtgtacatatttcattgtatatatgtacattgtggaatagctaaatcaagctaattaacgtatgcattacttcatataattatcttttttgtggtaagaacacctaaaatctactcagcaattttcaagtataaaatacattgttattaactagtcaccatgttgtataatagatctctgaattattcctcctaactgaaaatttttttagtgtgcagaagatccatatctataccctaagtgttcccaataaatcaaaatagtgtccaagaagcagctcacagagcatatttgttttcaatgtgagatttatgtagcacttttatatttgccaaagcttttattttcctaaattccccagtgaagtagggcaacaagaagatcatcagtggtgagtctgccatttaaatttttttttttttttttgagacagagtctcacactcacccaggctggagtgcagtggtgcaatctcggctcactgcaacctctgcctcctgggttcaagcaattctcctgcctcagcctcccaagtagtagctgggattacaggcgcctgccaccacacccagctaattgtttttttttttttttttttttgtatttttagtagcgatggggtttcaccatgttggccagcctggtctcgaactcctgacctcaggtgatccacctgccttgacctcccaaagttctggaattacaggtatgagccactgtgcccggccaaatttttttttttttttttttttttgagacagggtccttcgtctcccaggctggggtacatcttggctcaatgaagcctcaacctcccaggctcaagtgatcctcctacctcagcctcccgagtagctgggactaaaggcatgtgccaccatgcctggctaatttttgtattttttgtagagacagggtttcgccatgttgcccagactggctgccattgaaattaatccagtgtaatcttctcaaatgcagtgtagtattgagaaacggggtccagtgcaacaaagagtttatgattttccctgagcctcatccctaagatcttgttaaccaaattttggacagaaatggtaatttttcagtaagcataagataacattactttttattcttttttttctgatgggagtactgatcagtaaattaagcaatataagcttcttagaaaagattgggttggaaaaagaattgaatccacactgtagttttgttctggatttacattatatgccctgcctgtgtttactgacaacattcctcgagcattttatttgctatttggatataaaaaggtgtcagttgtataggaagaaaccaaagttataatagagtgtttgtaccaaaatgtttacctataaacaggtagggctgtcatgaaatgcaataactaatccttatccatactgaagaaagctgcattgtggcttttttacatgcaaagtcttaaggtgttataacttaagttagattttaaataaattatggactgcccttcttccctttgtgacctcttaaatctctgagaccaaaaatatttacatatgcagcttatagacatttgttaaaccctaagatggttattgcagccatgggatactcaattaactgtgcatttactcaccaaaaattgtttttgagcccactagtgtgtggcaggtactgagttgggcctttggaatacagtggtgagcagttatgacatggattctgccattatggagcaaacataaatttcactgaagaatgcagacaaagtatagagaaatgagtagatagaataattactgattataatgtgtctacgaaagaaacaacttggaagggacctattacatggtgaacacatcaagtaaaaagctcttcaatttttaaacaaaataattttgagggacagctaaattttcatcacttgctttggatagataaaaagctttcttaagtgtctatttcaactttcaaaagcagttctttgcttttccacttagaaaaacacatttaaaaattcttgcccattgaggatataattgtattttctttcaattgtctttattggaattcttttacaattcttccaaaacaataatacattccttagagctgagcctcagcaggaaaaatgaagcatctcatttgatgtattattccattacctatgatgtcaaggcagttggtaaataatttctttttatagagcaaccacaggggttgctaacagtgcaatccccaggaaatgattttgggaagctctatcatgcgatggctgctattcattatctactctgtgttggacaggctcggggttttgtttgccttttaaatcagggcaacacttgcattgtggttttgccgtcgtgcccttgcttcatgttggaatttttctaggacttattgcagattcagaggcagatgtttgtcttcctgaggttaggagatgatttggcgccatctaggttgacttcttttttttctttcctttttttttttgctttcctggaacaaacactattaccaaatacatttcaagcaatgaaaatagctcagtagaaatggtatggtggtgccttcatacccttggctattcgagtattgactagtcttagagagattaatcatttgtaattttaagttctaataatacagcgaaggttatcatttgtattttaggaaactttatagcctctgtactttgtaatggagaatgagttggctgtggggttaacaatgtggttatatagataaaacctcttttgagagattcttttttcaagaaattgtggtaaaacacacataaaagttaccattttaaccatttttaagtatacagtctagtggtgttagcattgttgggattcacattgtgttaggaattcacattgtgattcacattgtgttggaatgtgaatcacagcagtatgaatgtacctaacgttgctattttgacgtctaaatggccacatgttttcagagaaaataatttaacattgaaacatagttacaaaatatcttgcagggaagacacaatttgaaattgtaatagcagtgctgcaagtttatagtaaaactggaatagccaggtctcttcaaggccagctttgcacatttaagtgaatagtaaatagttactctaaagctggcatttagaattattaattaattggtaagtgctgaatacctggaaaatagcccagggaagtatctgcattttgtgaggtgtgagttaggctctgcactttcggggtgaatgaaaatgaacagcagctactcatggtggcttcttattcctgagttccgaaagaggctgggggtgttttcatgtactgagtactgtcattatgtagatcttagcttgtcttccctgaaatgtttattaaatctctatgtgttgtgttccagggtgtggaagagtgactttggttggttagaggaagaggtcagaatgatgagttctaggttggcattattcctggaatgtcatggaacttttcctgtaatgagttcctggtgacttgagaacatttgcaaaaccgtgccctcaacgtctagctgtgcagtcatcctttctgttccactcagccagtggtctcccaggaaagtgtggttgactgtacaacccatcattctattgcaccagtcaccaaaaacacatatgctcctgacaatatgaaccatttattattattattattattattattattattattattattattattattattattgaggcaggatcttgctctgccacccaggttggagtgcagtgatgtgatcacggcttactgcagtcttgacctcctgggcttaggcaattctccccactcagcctcctgagtagctgggactacatgtgtgtgcaaccatgctcggctaattttttttactatttttgtagagatggggtctttgttgcccaggccagtcgcaaactccttggctcaagcaatcctcctgcctcggcctcccaaagtgctaggattacaggcatgagccactgcgtctggccctgtctttattattcttgtaaacttaatgtctgcaaggtgttatttaccaaagaggtttgtaaaccagatgtctcttctcttgaacactaatgaataaaatcttgtattttttggctttctcagctaatcattacttaaaccttcagcttaaaaactggggaattgaaatccctgtggctggctagtcctctgaaggctttgtgatgatgtcactctcagatcgggacagaagcattcaagagagggataatactcttgcttatgtgacagctgtatgtgtccaagagcatttggctacattcagtgatttgatggccttgttctgattacagagctctttgctatcttcttcctttgcattgaattttgtcaaatttcccaggtattctctgaagaaagttcctctttagttgtcaatcaccacctgtccatcagagaaatcttttagctacctctaaatgtgagcttggctgggctaggttgaatgatagaattcttgtatttttagagtgaattctgaatagcagaatggtcaggacttacagtacattattttatcctttgttccaaaaaggggtttgaagtggcttaacaatttacatttagtaatacagactgaaaaataaatagaagaggaaattgttgtgaagggaaaataagtgttggaaaataatttgagaggaggaacaataagatttgtacacaacacacaccaacaggatctgagcttcctccatggccacagcagaaaaggaagcctgaccatttaggagaaccacaaggtccatgagattaaaaataaattagtggctctggaagatcacaggctttattgctacaggaaccttggaggagcttctgttaattacctaatgagacactgcagtgtgtgtctggcagaatatgtcctcaacagcacctaccctgctgaaatatggttgtttcctgttatgtgtcagtataggaaataatatagtttgctttctattgtgtgctaatatgacttaaatcagttctaaaaaagttagaaatttttttggaatatctacgatgagatatatacctgtcagtcctccatgaatttctcccagctgagttagataaggtggttatctggcctttagaatattattattgctaataattattacagtagcaccagttacaacacatagctactctttcccaagtacctataatgttttaagcatcatactagggcacttgctacagaagagatctctcaattctcagggaaaccgcgtggctttattcttattttagagaaagaaaattggctcaaagactttgactgacttggccaggtttgcctggctaccactccctgtgtgcctggccccgattcttctacctgagacccagaagttgtgtaaggaagacagtttagctcttttgagtcaactccctaaaacaatcgatccttttctcctgttagtctgtgcagcacagaaacagaactccacccgtccccgtgcctgggaagtctctggtttttgtttaaggcatgtgtatcctatacgtgccttgtggcaattccacagctggctccctttaggctccatggaattgtacatctagggccacgttagagtgatcgaaaaaactagataaggataagtattttcttgttttaactttttaaatgttcttaagcttcgaaaattgaattgaatttaatttggccaacgttgtcaggaagggcaagcttataaaaagaaaaaaataacctttcatgtaaagttatttgaaatctcataatatttctactgtgcctttttgattaaaaatttaagttaaaagcagtgatagattttgcctatcattttgattttttaagtttatgttcaaaagtatgcctatatatattttaagtcagagctggggttacttttaaataccggttcttaataacaataaaaggtcatcaaatagtattatgttcacattctaaaaggtttagtctgtgtctaaacaaaaaaaattttctttatatggacagaaagaactccccgccccaccaatacacaccctctttcttacactttgtagtaccctaggtcaaagtagggaagctcatgatatgttttaaagagggaaaaggtggccaggcgcggtggctcacgcctgtaatcccagcactttgggagaccgaggtgggtggatcacgaggtcaggagatcgagaccatcctgactaactcggtgaaactttgtctctattaaaaatacaaaaaattagctgggtgtggtggtgggcgcctgtagtcccagctactcgggaggctgaggcaggagaatggtgaacccgggaggcggagcttgcagtgagccgagatcgcgccactgcgctccagcctgggcgacagagcgagactccatctcaaaaaaaaaaaaaaaaaaaaaaaaaaaaagagggaaaaggtatgcaattagaaccagattggcattttggcaggtatttatttttccaggatgaacgtgctttcaaaaattgccagtagttgctaggcagacttcaacaaacacaaaagacatttcccaagcatctaacctggctggtttctccatttatattttgtgatcctggctcgcagtgtagtaaaccctattactatttgaactcgaaatacagaatacttctgccagcagtcccattggcattttgcggcagtcatgaagttaaattttcttcgccaggaggccagttgactaactttaaacgaaggcacattgtccaagattgtgggcagatcatttgaactgccttgaagttgaatagaaactatataaagaaaacaactccatcttgccagaagcagttgcctttttatttggtgttctcctttctgatcactgaattttcctgctgagtttatgcttattgtatctttctctttcctctggcaaatgaacagaaccctcacatacgcagttatggtcagtcctttacttaaataactttgctggatgaatttggaacaatgccagagaaactgaagaaacccttgtttttctggaatagcaattagatttgcaatgcttttttttttttttcctgaagaactgtttaaccatagatctgtccatttccttattttttgtttgttcattcgtttttgttttccactacttgtccaggccagcttttcctaagaatagtattatgccatttactaatagatgggaaatgcagactaattttgaaggctaacagtttaaaagtcagcatcttttaaatgcgttgatcatattggggcaaagtgctaataaatataattttccttccacatagagtaagcatgcacagctgggataagattgcaaaatatttatcctgacttgtagtggtagtaaatgacctatttgtttgggctaaaagtctccataatatagtaacagttttaccatattttctagtaagttatgactatcatatattctttaaaaaaggttttagggtcttgcaggctgtctgcattgtatttggatattcattacctaaaaatgagggtatggatttccttctgcatgtataacctcttattactattaaccctttatatttagtctcatgtgtctggaacattttgattgagactagcatgatatctctgtgcctcctgtatagaacttcttaggaaactcatagccgaaatgacgggagaaacaattttattttaggccatggagattcttgtgaaaaatgttaacaagtaggtagtgctgtagttgggagatatatgttctttctttcttgcctgttcctgattttttttaaattaaatactacagtcaattttagggggttgacatgctagttttaaatacaacagaaggtatttcttttcgtaggttaatattctatttggaaacatagcctttttccttctttctctctttctttcctttctgtttttaagtaaaaatggtatatacttatagaaagaaaaaaattacagaaaaatccacagcaggaagtaaagaacagccaaattctctccccaaagatactgttatacattttggaagcatctttctaatcatcttcctatggtagatatacctgcatataccactttaatttaattgtcatttactctgtaaactagtctgtattctgtttttttctaaccatcaacttttcttgttcgtaaatacagatttacaaaatcctttttagttatagtctcacatcaaaaaatatcattgttttatttagtaagaaaagtagcattaaacattcactatttgcctatagtaactattgaaaacagaatattccaaatttctactgtaagaaatttagttcataaaacattgaaagtgtattattttaggaaagagcatgaatgtcaaaataacttcgctgctttggagaaccaaaaatctttggcctttagcttatttcagaagtttggaagaacttaaagataattcatgagtttcagaagcattttaataccataaaatgctacttatctggaatccagagaaatgaatcatagtggttacagtatcaaagagtgagtgatttttttccccaaggtgatttttccacactcctaaaaaccatcatcttcacgataacctgtgtcttttcacttgtcagcacattgaaatataagacttttccaaatcccagaaccctctttggctgctcatagctacttttcaatctttttgatggggtttaaagagctaccctgcaccattgcaagaatgtgtgcttaagggatttgaagagggctttctcagaaaaaaaaaaaaatgtgtataatcacgtaaaggaagcatggctctgcaaacatgaaactagctgaatttttctccagcttccttcagtgtttagctgtgaccagaattacagagaaagttgataagcatggtccatcatctactgattttgtaagtgttgtaaactgttggagaatacactgcattagtaatgcattttccagaaaccacatatttttttctacctttatgacatgctaagttattgtcttaacttgatctggtggtttcttgccttactttaattagaaaagattttcggaaatacacatgacacaatcaactgcatttaaaaaaaaatgctttgcttttctagcaggccattaggcataagtaagggcagtgtctgctcttttgaccaagactgtctcctccggtagagcatggctgaagccgtctgctttaggagggtgtagtgttttgcagctgtagatgctgttatatataaaaatattttcacaactgccctctttgaactgtgttctcatatgtaacagattgtacacaactcagtgcttcacccttgtactgatccttcagtgttttttgtgttcacctatgttaaatgtcatttctctctgtcctttgccagagaggcttttgaatctaagccaaaaaaggcatttattatacacagagttatgttctctggcatgtagaatactcttgtatgctggccactccactcggacttagtgtattcctataaatatgtctgttgctttcaaaggctatgatatggagggaacaatggtatgtttagtgcctctctctctctctttctctctctctttctctcttacagagacacacacagaggatctcatatctttaggcatcagaacgctaaggtacagaatgcctctacactgttggaaatcctctctgttgtttgaccataatgctacttgctactcctgtcttttatcttaatcatgatgactcctgatcactctgcttttctctttcctttctgctttttcattttctcttgatagttgcactatgcatgttagtatcacatgatttgagtaggaccttgcttgttatcccataattggcaactaagattcagaatggagagccatgtggccctggcattctgaagagtgctttgaaagatctgccaacacttgaaggcatacacttctccttcacacttaatgagaggtggcagaaacttctctaataacaacagccactattacaaaccaccctactaccctgaacaccttctccccaataagaagattaaagagagaagaaagaagtacaaagtcattggtgataaaagtggtgggaaatgggtaggccccataaaggcgagtagatgatctcttgggagaaagaactttccaaggaaatctctcttaaatattgggcatgtctacaagaggaggaggccagagtttctttccctggttgcacaactgcttaagtgacagacttgttgatgtgccccaatgcctatgaaaagagacttgaagagagaattggggagaaactctcccgcagtgtagcataagtcaagtaggtatcactgaatgaagctgggcttgtgctctctctctgataacccacccacgaagcctgcctgctaggttagtaaagcccagcaactagagaccatcagatattctgctggtatcagagggtaaggagacatgggagataccgattttctcatgttagtgaagtatgcaatgggaaccctcatgggtgtcttttaaaaaaaactcttcaactcccacgagagagctgcacctgtggaggctgtcagcagccagttaatattagagaagcactgggaagcagtggaaagagaattgtgactgcatccaggtaagtaaggagatatttgctttttctttgatccctttttcctctgaatagctaatctctattggtactattccatgggctttccagatattggctcatctaatccttctagcaacatgggattacataggttctactgttgttcttttgcatgtataggaactaaggcacagaaaggtttgttacctaggatttggattcagggggtctggcttccaagaccatgctatcactaccacattgtacttgtactgccctaccacccaatattgagataaatcactttcaaatatttttttgaatataaccgtaagaaatatattgacccactacttgactcactacgtagctacataaaaataatgaaacaacatttcatgaaacaatacttatatgtaatataaccttatcattttgtcttgttttctcttacattaacgatgctagtcactatctactgaagagatgatctgcagccctgaagaagtttgaaaggagaaaagaacagtgccattcctaatgtatatttcctctctctgtctctttctccctgtcttcttcctttactccactgcctcccttgcaaacctgagtttcctgagctgttaactctagctggtcatgtggagtaggttaactttgaattaactggttatgagagtggagtgttacatttcactggactgagtttctgatactacaagtgaccagaactttatggaatcttaccttaatgttaatacatgagaaagagggattccagagagcacagttaaaaacagtgatggtgtcctatccccaccaaatgatgattattttagtgagctggttgtatcagccttcaactgtttggactatgtgaggggcttgcagtccagtcaggatgaccctgtcttcaaggggttgtgcctatcatccatggaacattggctacactattcttattcatggctcaaatggggctgtcaggattctaattccagacctcaagctactttgtgttactagcctagagtaggctttactgaaatagcttattttgctaagtcagacttgtttattactgcatttattatgtgcagcacactcatattcattcattcctccttggcttataatttcttttcaataaaactcaggctcctcgtatcctttttataagcttttcaagttaacctggagctccccttgttaaaaataaataaataagtcaaaatgaaaagatgtcttggtaggagaaggtgaaaccaactgcagtcagtctttgaaaatttacaagacatacaaatgttaatggtaacacttctgttagagtttgtggaatcatgctttttaaagaccaaaaaactactgggctccctcctcaccccactcccagcttacaaattacttttgtagacgatgaggaatgcctgccctgagcactttccaggctaaaatgattgctaccacgctctaagctttgtgaccttaattgcccatttgtctggaagttggagtaaagccagactcttctctaagggagattttggccttgttcacaaatacttcctctgcacagtgagatgggttgtctgtcttggttttatttggcatgaggccatctgcctgtgttgcgagacagtgagcagaaaagacccagcacacaccactattgtggaggacatcacccaccacatcacagactggactctatgaaaaaccgccggggaaactgcctgcagatcttcataccagcagcatctgtgcttccatcctgaaagagtggtttgctttttagctatggacaatgtgaatcctgttcagatgttgtttctctctttgcttgagggacatgggagtaaaatttgcagcccaaaatagcggccattcaagccctgtgtagtgaaattcagtgttccaatcctaacctttgttttattatttccctatcctgattttccttatgagattctctcagttctttattttatgtttttgtttcttttgtgcttttttagacacctccagtcctcttggtgaaatacatacatctagagtgctgttgccaagtaaatacagtgtgtttttaaagctttagtcttttttaacctgctacataaaatagtgattctatttgaaaataagttatttccccaaatttatagtggatgactgaaatcataacttttctagaaatcttgagatcttgttgtaagcttggcaaaggtagacatgattaagtaaaagtgcatccttttcttgagataacaggattaagatggttgaaaagtcatgttaattgctcaatagaccttgttggtattaaaatttatggaaccacccagagggccattccaaattcggtaatgaactgagatagaaagcatatttaaagttcatatttaatagttcagaagacaaaaatggagttggaggcattgatactgagaagcaagagacctattagctgggttacttaggtcattttacctttttttaaattggtcatttcatctataacatgaagaaactagatgaacataaccaatctatcatctctagagttttgtgatttatttttcaaatgcagctgaaatagaccctcaaaaagaaaatttactattattgcttggataagtaaaaatttgggaatcctgagttttgaggtccttagcggtagccaaattaatatgttaattcacagaccctcattgctgtctcttggcacagtgtctggggctctagacacagtcttttgctcgtaaatctgaacatataatagtaatttataataaagcaaattgaagaagttctgtatacacacacttgcatgcatgtgtgattacagtagttaccagaaagattacctgctcatagttctcttcttggtaagttttaaaatacccatcattagcattcaataaatatttattgttttgatttgaaattatacatcattatccacgtaacacggtcaattatataatgtcttgttgccttaccttggaattaattttcttttaattttttaaggatgataaaattttaatattgtttacctcgttaaacatttttgtttcatgattttgggggaggagattgtttaatattattactgtctagtggaatgtggcttctttttacttattttagaactcttaaacttatcttacacgtgtaatagaggaaggtaagcactgcacctagcacagaattggagttcagtaaatgttcttttcctcctttctttgaatcagtgtttgctgttagtagaagtcttcacagctagaaatctgtacacatggaggctgagcagaggtttccttgataccatgttatatacactggaacattttgggcatgcaggtgaggggtttaatcaccaacgtaagagacatacagaaaacaaattagtacaaagttattaccttagagctaatcattgatttttttatgaagtaaataagagtgtagtatttaaaagttaagttactctaaaatatgaagtatatttagctaggttgaattgattttgatggtttatgctgctgatggtagctgccatatttcacaaaagagaatgctttttcactgagatgggcagaagcaaacactgccctgattttggccaagtaaccagaaatagttttgggattcatggagctgtctccaaaattccagagatattgcatcatcttggtgggtctggtttgttttcagttcttttagaaactgagccctgctgatgggacaaatgcttgataaatcacattcacaccaagactgtggacaccaaagacagtcacagaaatttaaagcccatttcataagcatcaaactgtgcaccccacttctgaagagtggctttatttcagtgaaaatgtggttcagcatttcttcaaaatatgtgaagtttggactcaaaatagttcaacatggaaaactgctgaagtgttgtcttcatctgccatctgttcaatccacacgtcttgtttgaaccagggcagtgcacatccttttacaagtattgttctttctttttttttttattattatgctttaagttttagggtacatgtgcacattgtgcagtttagttacatatgtatacatgtgccatgctggtgtgctgcacccactaactcgtcatctagcattaggtatatctcccaatgctatccctcccccctccccccaccccaccacagtcctcagagtgtgatattccccttcctgtgtccatgtgatctcattgttcaattcccacctatgagtgagactatgcggtgtttggttttttgttcttgtgatagtttattgagaatgatgatttccaatttcatccatgtccctacaaaggacatgaactcatcattttttatggctgcatagtattccatgatgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaattgccacactgacttccacaatggttgaactagtttacagtaccaccaacagtgtgaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggtcgtttgtttttttcttgtaaatttgtttgagttcattgtagattctggatattagccctttgtcagatgagtaggttgcgacaattttctcccattttgtaggttgcctgttcactctgatagtagtttcttttgctgtgcagaagctctttagtttaattagatcccatttgtcaatgttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcggatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaagattgccttggcgatgcgggctcttttttggttccatatgaactttaaagtagttttttccaattctgtgaagaaagtcattcgtagctttgtggggatggcattgaatctgtaaattaccttgggcagtttggccattttcacgatattgattcttcctacccatgagcatggaatgttcttcaatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatatgtcccatcaatgcctaatttattgagagtttttagcatgaagggttgttgaaaggagctggttttttgaaaggatcaacaaaattgatagaccgctagcaagactaataaagaaaaaaagagagaagaatcaaatagacgcaataaaaaatgataaaggggatatcaccaccgatcccacagaaatacagactacccatcagagaatactacagacacctctacgcaaataaactggaaaatctagaagaaatggataaattccttgacacatacactctcccaagactaaaccaggaagaagttgaatctctgaatagaccaataacaggagctgaaattgtggcaataatcaattgtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccaggcagagacacaaccaaaaaagagatttttagaccaatatccttgatgaacattgatgcaaaattcctcaataaaatactggcaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcagcaacccttcatgtattgttctttctttgtcccagcttgacctcagtaaaaaatatcatcctttaatcatagaggctctaataagttcagttctaaaattttattccctaagttccttgatctgagaatacaactcaattacttcatgtttttacagccagctgaaagaatttaaatgacacctccatactctaccagcggaacttccgaccttcagtaaatcacagatggttaattttatctcggcataacagtttataatcttgacaatgtctccatgacttagaaggtcacacactggttggacatctattaggagattgacagtgacccagtctgggatttgcttgattattgaggcacttctaccttctgcgctagcctccctccagccccatctttctccattcctctatcttaagtaggtgctgttgtcaaaatgagctgctagcttctcctcacgtgcgccattccatctacctgaatgctctcctactatccctactcttgcctgggcgagatgcattattcttgaaaggccaactcaaatgccatttttttccatgaagtctttcttcatcacagggagctggaaatgatcactgtctattgaaatgttctgtgttgtagtgcaccatcttctcactcattggcgtttttgtctgcatgcatcactgctctgcattataataggtgtgctatagtcaggtaaaggtaaggattgctgtttttgcttttttgtatgttcctgaggaacgtgcactagtagtttttgtgtatctcagtaggagctcagtatcattgagtgactgaacattcccttgattgaactggcaccacctgcaggtacactgtgattgagagtagtaggagtggtctggagccactcaagttaccttagggtaggaagatttttctgaaagtgaaattgttttgtttacatgttaatttaaattcttgcttagttaatgtattttcaagattcaggattcaaaatgtacaaaggggtatatataatgttaaaagagcttcagtctcctttctttgcctggcatgtacttaacatttccacttttgaatttgcttttaactttttgaatttttgttaactttaaccataaatctagaaacttattccaattgatatataaagatcactcatatttttttttcttcttgctgcatattacatattattacaatgtgtggatatagcgtaaagaattcaaccagtccccagttgatatgtcttcagttgtacaactatttattgttagaggagtgaattttcaaccatttgcaaaactggaggaggattctgtactcttctcagtgtgtcaccttaggaaaaattgtgtcaatctgtccttccactagtggtaactgtgattacctaaccaagttggtgaatgatgagttttttcactacgacaccaccattatcccctttgtaattaattagcaccttgtgcagagatgttctcatattatgccaatttctgttcatcaagtcttcacctacaagccggagctttcattaacagctctctgcttttttttgagacagagtctcagtctgtcacccaggctggagtgcattggtgtgatctctgttcactgcagcctctgccatctgagtttaagcgattctcctgccttagcctcctgagtaggtgggattgtaggtgcacgccaccaagtccagctaactttttgtatttttagtagagacggggtttcaccatgttggccaggctgttctcgaactcctgatctcagtgatccacctgcttggcttcccaaagtgctgggattaagggtatgagccactgcacccagcctctctactttttaaatgtagattaccactatgatagttgccaaatggtgattaattttattatgccatctgtgtttgttacttagcattgtataataaagagcgctcttttattccctgtttatcaaattgtttattcgtttaatgggtttatggacttccattttattcagtggataaatactggataatggataaataatatcagtatttgatgcccaaattgttccaaatttggccagtaggagacctttcaggttggcttctgtgtccttttgacatgctcccatcattcctggagcattttcctggtttctggcacaagcagatgttccaggttttttcttgtactttctgtgccccagctctgatcctttttgtgtagtggaggatggcaacaagaagtcatgatctgggcctcagtgggttaattggcactagagtgtaattggttctgcaccctcccagcagatagaactaggacatgtatctgcatgtgtatgaatgtgtgtatgtatacacgtacgtatatctatgactaattctatatgtgtctatataacttttttaaaagagttcattctgggctattaaaaagtcaaaaaataacagatctggtaaggttgttgaaaaaagggaacgcttatacactgctggtgagaatgtaaattagttcagccattatggaaagcagtttggtgatttttcaaagagctcaataccattcaacccagcaatcccataattgggtatgtacccgaaggaatagaaatctttctaccataaagatgcatatgtatgttcattgtagcactattcacaataacaaagacatggaatcaacctaaatgtccatcaatggtagactggataaagaaaatgtggtacatatacaccatggaatactacacacccataaaaaaagaacaagattatattctttgcagcaacatggatggagctggaggtcattatcctaagtgaactaacacaggagcagaaaaccaaacaccatgtattctcacttataagtgggagctaaactttgagtacacatggatgcggcctaactgagggtggagggagggaggagggtgaggatccaaaaactacctaattggattctatgcttattacctgggtggtgaacttactggtacacggaacgcgcatgacacacagtttacctgtataacaaacctgcacatgtacccctgaaaccaagttaaaaaaaagactgtctttcagaatttctgggaaaattttatgtcaagtgactgataaaagtagaagcccagaaaatagtagttattggtgaaaatttcagagagtaaaataaaaatctgagaaacagaagcacttgagaagaaggtaaaaatatattattatagcaacaaagtaacagtactaatactgttattattattatactgtgctgacatgtagtattatattgtgctggcatggaggtagttttgtgtggttcttataaggaggattgtctaaaaaggactctgagagttctctctgaattgcctaaacaatgagctagttagcactggggcttaccccttctcctagcaagaagagctcctcattgtcagctgcctgtgggtctaggggccctttgctccagcagaaggtgctgcagtgagccacaggactccaaatcaccaggtgctgagcagctaatattcccagacagcccttataaacagcagcacccaaacctggagtacttggtgctcaagtagtgtatttgtcttctccccgacaacacaggcaattaacaaggccaccttcccttgtttgtcaaataaggagagtatagtaataggggacacatttcctgccctaaaatcatttctccagcagcataccctggccctggatcacctctcctcaggaataatgagagatttcaggattgtgtatcttcttttcttgctgtgactcttgttttataaatttcctgaaaaaagttcattccttaacccattaaaaaaaaaaaagagttcattctgatagttcacattctaaccaaatactttagtgtacttctagcccgtctcttctcagaaggtgagaaagctggtttccaggatcctcagtgtattaactttatgcctaattaattagttaattgtgctgaacataaccagtattccaactactcaagactccttctgacatctttgtaccctcccattacctcccttccttggctaccagtctcataggactgatgcctctgcctggcaactccaccccatcccattgcacctcctcaggaggagaggagagaaaagggaaagagaaagtcaccccaggcgacttcatgtgctgccaaggttgaaagccactgtatttaacatttacacacattatgtctctttaaatatttcaaagcctagatgctttccacatggagtagtagagatttaagaaaagtatatttttatcagcttctctttttataatttgtccatttctcccacaagtggaatagagaggtaagttctcattaattgtgaggctgtagtggggtgttgatggctggattttattcgaatgttttcatttcctctgtggttttagggcagtggttttccaaatggtctgatctagtgcattggtagcaacctgatgctgtcaggttttttaagggggaagattcttattttcaaattcgtaattttttaaagggctcgcatatcgagcttgaatttttttttttttttttgtccctgaagttctctcatgccaatccttgtttctgcttctttgctcaattcagaatactggtattcagttagttccatgtcatttctctctggagtttagaaatggcattttaaaggcatcaggcatcccctagcctaaccccacctcctttaggaaaactggaaggagaaaaggtagagggtcactggcctagattataaaaatcaaagcaccaaacctgattatagtcaaaagaatcctaagagtgatctgaagctaaattccatggctgtgtgattcatgatgatctaagacctttcatctgtttttcattttctgaagattgttaagttggttgctattattgacaatgtttaggtttaaacaattagaattaaggtatagagttacctacatatgctgtgttcgggttgtgctcatttgttggcacaagttgattctgcaaaggttatgtggcaaaagtttaatttaggtcatctcttgcatagtggaaatagctgaagtcattggaggataacagtgctttaagtaaatttttacttaaaaatttgattaagtattattgaatttatacttcaaatctgatataatttggcttttaacatatgaggcattgaaatttggtatagttttaaaagatgaaatcaagaaagtaaaatcagaaaaattcgagtgtaggttgagaaaaaattggaaaaatatagaaaactatactttttaaccttagaactgtcacattttggaatttaaaaattgttatgaagaataaaatgttccatctcttatgttctaaatttccatgtattgtgttttctctgcagtgaggtcctttgagaggcacatatgggcgtgcagttccattctcttagtgtgtgcctgtgtattgagtagcacctgcctctggtgtacttgaagaaaacttaagtggctatagaattagtagtccctccaggccaaaatacaaatgacacatatcttggacatcttctactagaagaatataaaaatcccaatggcctttaaaaaattagaataatgttaaaaaacacaatttataatttcgtttctaaaattatctgaaggaattggaaggatattccatttttaaatgcccaaatgaaataatccttttaaacaagggttttccacccatgatgaaggaggttaaattaaaaacttaactaaaatgagaacaattgtgttgttctttagttcttgcattaggaatgtgaaaccagaagtcagctaagtctccatagcaagcatctgtatttacaagatgagtaacacaagtctgaatgttgcgaaagctctcgaaaggtgaaaaaagttcagaatatcagacgttttgactagaaactctgtcactgattatctcgtattacaatgagaagggcatgacatgacccctgattacttttacacctttcttgcttctgaatccttgtttttgaaacataggaaagaactattttgttgacaacattgcagtttcatatagttcatcctaataaatgtataacaaaactatcatgagataatataggagattttgtaacaatctggtaagaaaggaaaagtattgcgagttctgaacattcagttacatgtggaaaacttgtataaagtgaatttattgcatttgttgtcatcacttttctgaaaaagagaactcttgcaactaaaataaaattcttttttatccagtgtctagaatagtacctgccacactgtaggcactcaataatgttttgttgaataaataaatgaaagatgtcatttttatttgtagttggctttgaacatccaatttttttctttttctttttctttttcttttttttttttttttttgagacggagtcttactctgttgcccaggctgcagtgcagtggcactatctcggctcactgcaacctttgcttcctgggttgacgccattctcctgcctcagcctcctgagtagctgggacttcatgttcatgccaccatacctggctaatttttttatttttagtagagacagggtttcaccatgttgaccaggctggtctcgaactcctgtcctcaggtgatccacccacctcggcctcccaaagtgctggggttacaggtgtgaatcaccacatccggcccaatttttaggttttatttaacagacattttcttcctcccaacttctagcactggacaacctctggtgtgttttctctttcttttccaacatgtcatttaaatcaggggtccccagcccccaggctgtgcactggtatcggcctgttaggaattgggtcacacagcaggaggtgagcggtagccaagtgagcattactgcctgagctccccttcctgtcagatcagcggcagcattagattctcataggagcatgaaccctattgtgaactgtgcattcaagggatctaggttatgcactccttatgagaatctaatgcctgatgatctgcggtgggacagtttcatcccgaaaccatctccctgcccctgcattcggtgaaaaaattgtcttccatgaaactggtccctgatgccaaaaaggttggagatggttggtttaaatagaatcatatgctatagtcttttgtcttcttttatttattaaatcctttgagattcatctcatttgaggttgttgggtgtgtcagtagttcattgctttggttctgagtagtggtctattgtatgggtatatcacattaaaaacattcattcactagttgatggaatttgagtcatttttaatttaaggcttttatgaatgaaggtgctgtaaaatgcacatagaggtctttgtgtaaacatatattttcacttcttttgtatgagtgccttggagtgtaattgttggctcatgtaagtgtgtgtttcactttctaagaaagtgccagattattttctaaagtagctatgccatttcaaattcccaccagcaatataggagagttttagttgtttcacatccttgtcagcacctgttattatctatcttttgaaatgttagtcattctggtggatacttagtagtttctgattgtggacttatttgcatttctctgagaaccaatatcgagcattttttaatgtgcttaatcattgtttcctttggtgaagtatatgtttgagattttgctaattttttattggattaaaaagcattaagagttctggatataggttcttcataagatataggttttgtaaatagctttttcctcagtctgtggctttgttctgcatttcagacatttttcattggattattttatagtttttatgtctctggtaaaatttccctttctatacagacacattgataatatttttcattagatccttatattaattgtagttattttaaaagttctatctgatatttacaagtctgggccatcttgaggtctatttcatttgactatgctatctgttgatgataggcttgtgggttttttttttccctccacttttgtgtcttgtaattttttattgaatattggtattgtgtgttaaagagcaatagtctgtggtaaataaaattaatacccacaatggttactttttttgtttcttcagttcgttaatataggggagtgtgtcagtagtcagtattgtcagcagttgagctgggtttgaattttgctgttgctgtagttaccttgagtgcaaacagacttcagatttctccagtggtggatggattgctgctgctacattgagcttaatatgagtcccggagtgtggtacagttttctgtgttcctgatctacctttggctttctgccagctctgtacagctgtgccacaggggtctgtgttattgccacttccccagtagtagactactgcttgttattacttggtaaaaagttcatggaagggtaagtgggtggtttggtagtctgtcacttcccagcctcagttttagtcaggtcttgtgtgccgaagcctcaggaaaggggcattctcagtgttcccacctctctcaaaaacaaccatttttgaaatctgcaagatcaattttaatagtatcttgttcccttaacatacttttgataacttctcttgtgtttttaagcataagtattctgtataatattattatagtgcctgcattattttagtggtctttttctgttgactctcactaatcatggcttttcctctcatatctttggtggtttgattgtacttgttgaagcccgtatttaaactccttggcctcagagagtatttttgtctttatctgcctgggaatacagccataactaaatgaatctgttttgctttgttcatgaattctatcgccaatagtgcataaatacaatcttgtgtttaggaattcagaggagagaggtttttcattccccttgcttcaccaaggcaaaaccaggcactcatctacactgtgaatcactaagggaaagttttattttatttcatcttctgagactttatgtgttttgatctgaaatttattttctattctttaaacattttttaaaacccacgctgtagaccaccaggtattagtggacattttgctggcaaatgctggctctagccctaatttacccgtctatttctttgttatcatttctgatctctaatgaattttataaccttgcaaaagtatggttttatattttactcagcattttgagatattttctgtttaaacatgtatagtcggtttcatctgaacatccagtttaccctcttgctagacgtacaagttccttatgttctcatacttctggccaagcagttgatatattatattggtaaaataaaaacttcagccaaattaaatttaaaggagcttaattgagcaatgaatgatttgcaaatcgggcagtccccagaatcacagcagattcagagactccaggggtgccttgtggtcagaacaaatttatagacaaaaaaacgtaaaatgacctactttcactttcagaagtgaggtgcagaaagagtgagattggttacagctcggcatttgccttgtttgaacacaggttgaacattcagcagactgtgagtggttgaagtaggccactgagattggccaacactcagctattgtttcaggtgcatattactaagttaggttttcaattttgtctcactgttaagctaggttatagttcatctataaggactcaaatatagaagtactgagtccttctcaggccatatttagtttgctttaacaatatcctaattatgttcttttccttcagccagcattttaattctaataggttgctgaatgtgacttttaatttttgaatccttatccaagcacacagaaggtgggaagaagtgtgatgtagtataaaagtgcttggatttttcattcaagtgtatatatgctggaaatacaaaatcagcatttattagctgtatgctcttgggcaagttacttagtgtttgaatctctttcttcacctgttaaatggaatagtgaggccttccttttatgggactaaagacagaaaaccaatctacctaaaacctcctaccttgcatgacccctcccaccatgcatagtagccattcaattgctgatatggcactctttttctctttcttaattgaattatttaggatatacttgttttttccttgagttcctccctggaaacaactttaaataagatactaaaaaatttcagctatttgctcctatttaacttgtctacttaatatttaaattcctttgataaatatattagacataatgggttattctcacttttcaataatgatctagatgaaagaggcttacaatttggtcagctagaaggaaaaaatttcaatttagtgccactgacagttttaaggaaggcaaattacttaccaaactaggatttcattttattttcaaactaattactgtgtgtttgtacctctgtagattatataagtaggctccagaagaaactacttgcttattcttcttggccttttagtccttttaaaagctaatttgtaaagaatgacatgtaagtttagatatacaatttctcatagctattaatgatatttctttaccaaactatgagaacacagtaatgattttttaaagtgaaggtatgaggtatttgagggaattttatgaagtctggtcccatttgttcactggaattatgaaaaaaatatagcaaaagtagaagtctttggatactcttataattcttagggaaggtagttttaaccttaattctcagggttcaaggaattcttatatttccctttcaaaggtctggatggtgttaccaataccaaaacacacttttaagtactctttttttttggcagctccttttttcttaaaccattctgtggaattagtaaagaacagtgaaattggataaaggcaaaggcaatagggtagaggggaggaagtaagcctgaacatctattaccagtctctgaaagatcaaatttaccttttaaagtaactacagggttcacttgagtctatttattttgtctatgaggaaatagagtgtcagagagatgacatatctatatgaactaatagctactccttggagaagccaggactggaggatgctcctaactcatagctaggtgatcttaaatctctctaaacttccttttcaaatgttaaatggggagcatgcctgcttaatcaggttaagtagattaagcagaggtaaagcacatatttatgaagtgttcatggataccagatgttcaataaaagtttttttcctttgtctcatcttggcttactgtaaattttttaaaaaacataataaattaaaaattggtagtaaacagtttacacagaatgaaatatttcacggtcatccggcttttaagaaaatgcatagcatgcaaactggaagcaaaagttctttgggaagagtccttgagtcatttgaatttggaaaggaaaggaagttttacgtcatctgtagatgctctgatttcagttggtgcattattgccttgggccaggtgcaccaatttatacaaaaagtagttttaaaaacttttcctctccatttcttttatgaattcatcttgtgtgagcttttgatcctcactgaatgaccttataaaataaagggaaaaatcaataaagcttaaaacttatacttttcactcaatttttttttccagatgaattcacagtgctctgaatctcacctttaggtttgaccctgactgaaaaacatctcaaaattttacttttgcacaacaacctgtatcccagtaatcatatttgagctgcacttttacttcatttgcccttttaaagaacacacattgcaaggattgcatcaatttaaatggacatagcatgtgactagaaattatcttatttgggaaaagtgttttattgataacagagagttctggtgttggtttactcatttgttgatgatcgttacttcattttgggccagttacagtaaaccagaacctaggaacttgcaaagccagattatttttccttctcttctactaatggtgcatctagttcagtatttttcctgatcagattaaagaaaaacttagaaactcaggagttgggaccagccttgagctcacttagctttttctccctaccatccagccccactctgtctttaacagtgggaatctaacaagaaatagtgcctatttgagggatgtttatttgaaggattaataaacatttattttgaaatctaaaaggattgtaaaaagtttttgagcagttaaagcccatgtttttactgtagtttgtatagtaagagaaactaatatctaagaatatttcccagattatttgttaagaataaaaccttatctactgaaaataagcaataaaatatagtttcttaggtagtgtatatgaataggcaattaaaatacttgtgctactaaatgacagttcttttttttttaaatatacccagttgagcatctcaaacctcaatccaaaatgctccaatgagcatttcctttgagcctcatgtaagcgcacaaaaagttttgggttccaaaggattttggattttggattttggacacttaacctgatacgtatacaggaatgcttgccatttaataaactctatgtattggttgagaatgatgagagtctatttggagcatctgaatttgtagttggttttgaaaattcaaattatgagttttaattaaaaggacaatttgacccttatattttgaagatgaatttttagtaaaatttaactaagcttttaataaattgtagttgctaatttttgcaaagaaagacctggggtgtttttatgtacaaactattgtatttgatagtggaaattaaggctagaaacaatattcctagggaaacatgcaaaaatacgttgagtaacataatgtgacatttgagatgccagtgatagttatctactataaaataggtcccacatagctgccagagtataaaaataacaaaacagaatcccttaaaacgttacataattcagaataactgttattttccctaatgagctagaactttacccatatatttttttctgaattaacatggtgttaaaatatttctgtttcactcttttgctgcaaagtaaatgttttgggcttttgataatgatttcaaacggcattaaaattctttgtcattgcattgctcacaaatccattagtagtaaacattcatgaattcttaataaaagtgaagatgtgaaggaaaggaagaagaatgtgctctgtttatgttattgtaaagttttagatcgtgcttttaaagaaatgcagcttggttaaagtttttttaacattctaatgggaaaatgcacaaaagttgagataattttgcatggaataccagatatccactacctaaattctaaaattatttttaaaaatatttgctttatcacatatccaatcttctatctgttcatcaatccatcttattttttgatgcatttcaaactaatgcgcagaaatatccctacacttcacctcatcagcgtgcataccaattactagtgtcaatatttcttacatagcttttttgggggtggttgttgttaaacattcataaagtaaatgtagcattcaatgtgtttctacaaatgtatatatctatttcacccaaactcctatgacgatatagaccattattatcacattatcatcctacgccttccaaaaaactccactgaatatcctgtccccatctgccatggcaacaaaaatacccctatggcactagggcaaagtgagtaaatgtgaagaagagaatactggcaggactttgggtctgatcacatgggaggagtcagggacaggcagtggtcaaggatgacactgaagactgtgacttgaacagtagagggaatggcagtgccatttactgaaataaagacttgtggaaaagatatacatttagatgagctcaattttgaacattctgatttttaagttcctgtgagatcatcaaatggaaatacctagcaagtaaaagacttgtttttggcatctttattcatgaaagccaaaaactgaaagcatccaggtgtccatagagtggataaacaaactggtgggtttcatacaatgtaaccatactcattaataaaaaggaaggacctactgacacatgcaacaatatggatgaaacctgaaaaagcgttatgctgggtgaaagaagcctcaccccatagagcaggcactgtatgtttccatttatatgatattctagaacaagcaaaacatggctctacgtggtttgccttctctctcgtcttccctttttcttgtctttctaaccacatggttttgcatgaccctcgtccttcccatgtaaggcggtttccctctgccttgtctctttaatgagatcattcccatttctacagagtcatattctagtgtctccaagaaaaccttcttatattagttgggattagaattgtctgcagacatagaaaaccaaagcaaaacaaaataaccattgtttaaataagttggaagggtatttgttatgaaaaaactctgtagcaaggtagtccaggtctggtgtggtggctgttttccagagacctcagtaacccaagattcttccacctttactgttcccatctggagggtatggcccttatcttcataatccaagttggaactgtggatatcacagtccagttggcaggctggagggagacacaaaagacattgacaagctgaatgatgagatttcttagaatctgctaaaatttccctggacagaacttagttatgtgccttgggtgttacctgtcttcaaggaaggcagggtacttaagtgtccatgtgtccagctaaaaatggggttccaattgggacaaattggaaattagggtgggctgcttaactacttccatgcttcccttgatttcacattatcctccagccattgtcctgtttctctgctgcttgttagaattgatacttcttgaaagagttatctactcataacattctattatacttcccaaattgccttgttttttcaactcactccagcttctgcactcactcttccatgtaaatggctatcaagggtacccatgatctgtttcaaaatgtaagagatactttaaagttctcatcttatttggtttctcatcagcattcaattcttttccttttcttgagattccctgtaaaaggaacagcctcgagtttttcatttgtcgtctatgactttgttgttgtctaccaccattctggaagctcgttccctgtcatttttctagcatttcctgttctgtgcagtgtctaaatgttggaattttttaaggtttagtttttattgtggtagcatatacataacatgaaatttaccattttaaccattttaaagtgtacatttcagtggcattgagtatattcacattgttgtgcaaccatcatcaccatccatctccagaactttttcattatccacaactgaaattccatacccatttaacaataatcacccatttctccctcctcccagtccctagcaaccaccattctactttcttctctctcattcagacttactggagtaagtctctcagtagatttactttttaaattctattcactattatatacctaatgcttaacataaggacgggcacttatttagtatgcagtagatgtttgtgaattgagtgaatgctaatctccctggcatgttttgtgttaccccatttgatggaaccatgcttcatattgcagcttagaaaaggtagccttttctgattattagactagttggggtctgtatgtcagatgatatcattgcactttgtaaatttttcatgacacttaactttgtaattatatatcggcaagtggtgtttgacagtttgtttccctgtatgtactataagcctcacaagagcagggaccaaggctgtcttggccaccatcctttccccggtgggaaatatagtctcacactcaccttgttttataaatgaatgctcagtgataaaaataaacctctttaactggttacatttcctaatacctgaaaactgtatgccattttattctttgtgactaggtgttggaaattgaggttatattgagggaatttgaatttcttgaaaccagagtttggaaagtttagtggtttttaattggatcctctttaaatgttgagaagctaaagattcaccaggggaaagccattttgaaacttttactataagaatcacatgaagaggtctgatatattgccaaatctaattctgcactgttgcagatgaatgcaatcttaggacatctgtgtgtttgtctttctagctctcccttgtgacatcattagtgcacttaagcctccagagtagcttctttggaaattttcattaccaattaaactcatttttgaaatgtataaattctttgaatattactaataactttttataggctccacatttttttcctatatcaggaagatttaaaattacttttgcagaaacatacatgtagagtgcagtaggtattttctaccatgctgtaccaaattcaatagggtaacaatttttctggcatcctctgggaaggaatcagttccaatatttattcaggaagtattattgaattcctaccatgtgcaaggggatttacatataacccttgccttaggcttaattggactcagttttctagcagcctttagccctgtgcctccccaccaaatgctttagcctgtaagacaggtgctggactataaagctgtctgttccttcttcctaagatcaaaatccagctagttataaaatgccgtggagcacaagcttttatgattctggtagtagcaccatctactcactttgagtattaccacattcttgttatttttttcatttttattttttgtgattgagtctccctgtgtcacacaggctggagtgcagtggcacgatcttagctcactgcaacctccaccccctgggttcaagcgattctcctgcctcagcttccccgagtagctgggactacaggtgtgtgctaccacgcccagctttttttttttttttgtatttttagtagagacgaggtttcaccatgttgagctaggctggtctcgaactcttgacctcaggtgatccgtctgccttggcctcccaaagtgctgggattacaggtatgagccaccatgcccagcctatttttcttttaatctatctcaggtaaacactcaagctaatagcttgctggttgtatttgtcatacaagttatgttcactgtaggccatattgtgtttgtctgaataatggttttgaaataaatcatttagctaccaacattttagaattaaggagatttacataccaatttggttttgtagcttctcttggaaaatctgaatgtctggctattttgtgccagcatttgcacgtgatagctggagctggtgtttgcaagcttaggcagggacagtccctatcctatttgctgcacctctgaccactctttattatttccctgaaactcagatcaagtgtcagttaccatttatccttgtcattgtactattggtttttttttttcgtggtagagtgaaataatttttgtaccatgtctgcaggtcaaggggaaatattagtgaaggggtgttagtgaatgccaagaaaatgagacaatatatttctttgggcaaatgagtaattttcctgtgtctgtgtttttcttttgtggaacatatatttatgttaaaaccatgcacttctgcccattcattcctcactgttctttctctggcttttctagacatctgagtcaggcactcttgattagatgcatgattgtacaaaaggaaagtgattctacctgagggccgcttgaaggaccaattcaaatagagtagtaatacatcataactatcataagaggtgatatagcagctcagaggaaggagagattacgggaatcttgatgttgcttttatagttgctgttgaacaacatgtagaaattcagcagcaggagacagtgggacaaaaggacagtttgaataaagcaaaaaaagaaaaaaggaggattgggtgaggataggacagtggctagttataagtagggagctctgagagaagtaaaacttaagaggctggttgtggcctggttatggatagtcttaaatgttaggctgagagacagataacagttaacctctgagagatgttgtaattaggggagggaaatatcaaattaacgacttgtatgagaaaaggctggatgtgccaccatcaagcatgaaatcctctgtgtaagtactcacggatggtaattatctggatagaagattgtcttggattatggacatggttttggagagggaattgctaggtctgtgcaacttattagatatggttgtggtgggggttgaggacagttggaggagaagctgggagagaggagagaacaaggatttgaacacagatatctgaggagagcatggaaatcaaaaggaagacctggtttggaaggagtatccaataggatgcatttagcctcaactaacaggctggcatcaacaatatgcatgtgtattggctcatattactgaaaagtgcagaagtacagtgggttttggaatagttaatcaagaagttctggaagatgaatggataaagaaattgtggtatatatatataataaaataatatttagccataaaagagaaggaaatcctgcaatttgcaacaacaagggtgaacctctaggacattatgctaagtgaaataaaccagacatggaaaggcagataccatctgttatgaattatatgtggaaaataaaaaaaaatcaaacttacagaagagggtagaaccatggctgccagtggggtggaggaaacggtgaaatttgggtcaaagggtacaaactttgaattataagaggaacccagttctggtgtacagcatgagtggcgatggatgtgttaattaattagattgtgataatcattacagaatgtaaacatataccaaatcattattttgtacaccttgaatatatcccatctttacttgataattaaacattttaaaatttaaaaagacatgagggattcctgggcaagatggctgaattagaatagttctggtctgcagctcccagagagactaacgcagaaggcgggtgatttctgcatttccaactgaggtacccggttcatctcagtgggactggttagacagtgggtgcagcccacggagagtgagcagaagcagggtggggagtcgcctcacctgggaagtgcaaggggttggggaactccctcccctagccaagggaagctatgagtgagggatggtgctatctggcccagatactacatttttcccactgtcttcacaacccgcagaccaggagattccctagggtgcctacaccaccagggccctgggtttcaagcacaaaactgggtggctgtttgggcagacaccgaactagctgcaggagtgttttttcataccctagtggcacctggaactccagtgagacagaactgttcactaccctggaaggggggctgaagccaggatgccaagtggtcttgctcagcagatcccaccccgatggagcccaacaagctaagatctactggcttgaaattcttgctggcagcacagcattctcaagtcaatctgggatgctcgagcttggtagggggaagggcatccgccattactgaggcttacgcaaagcttctgtagccagattcctctctagattcctcctctctgggcagggaatctctgaaaggcaacagccccagtcaggggcttatagctaaaactctcatctccctgggacagagcacctggggaaaggggtggctgtgggtacagcatcagcaggcttaaatgttcctgcctgctggctctgaagagagcagcggatctcccagcacagcgttcaagctctgctaaggggcagactgcctcctcaagtgggtctctgacccccccgtgcctcctgactgggagacacctccctacaggggtcgacagaaaactcatacaggagagctctggctggcatctggcgggtgtccctctgggaaaaagcttccagaggaaggagcaggcagtaatttttgctgttctgcagcctccgctggtgatatcgaggcaaacagggtctgcagtggacctccagcaaacaccagcaggcctgcagaagaggggcctgactattagaaggaaaactaacaaatagaaagcagtagcctcaacgtcaacaaaaaggacaaccacacaaaaaccccatctgaaggtcaccagcatcaaagaccaaaggtagataaatccctgaagatgaggaaaaagcagcgcaaaaaggctgaaaattccaaaaaccagaatgcctcttctcctccaaaggagcacaactcctcgccagcaaaggaacaaaactgaacagagaatgagtttgatgaattgacagaagtaggcttcagaaggtaggtaataacagactcctccaagctaaaggagcatgttctaacccaatgcaaaggaagctgagaaccttgttaaaggttacaggaactgctaactaaaataatcagtttagagaacaacataaatgacctgatgcagctgaagaacacagcacaagaacttcgcgaagcatatacaagtatcaagaaccaaattgatcagttggaagaaaggatatcggagatggaagatcagcttaataaagtgtgaagataagattagagaaaaaagaataaaaaggaatgaagaaagcctccaagatatatgggactatgtgaaaagaccaaacctacgtttgattggtgtacctgaaattgatggggagaatggaaccaagttggaaaacacacttcaggctgttctccaggagaactttcccaacctagcaagataggccaacattcaaattcaggaaatacagagaacaccacaaagttactcctagagaagagcaaccccaagacacataattgtcatattcaccaaggttgaaatgaaggaaaaaaatcttaagggcagccagaaaaaggttgggttacccacaaagagaagcccatcaggctaacagcaaatctctctgctgaaatcctacaaaccagaaagagtggaggccaatattcaacattcttaaaagaattttcaacccagaatttcgtatccagccaaactaagcttcataagtgagggagaaataaaatcctttacagacaagcaactgctgagggatattgtcaccaccaggcctgtcttacaagagctcctgaaggaagcactaaatatggaaaggaaaaaacgggaccagctgctgcaaaaacataccaaattataaacaccatcgatgctaggaagaaactgcatcaactaacaggcaaaataacgggcaaaatagcgtcataatgacagggtcaaattcacacataacaatattaaccttaaatgtaaatgggctaaatgccccaattaaaaggcacagactggcaaattggataaagactcaagacccatcagtgtgctgtactcaggagacctgtctcacgtgcaaagacacacatagtctcaaaataaagggatggaggaagttttatcaagcaaatggaaagcaaaaaaaagcaggggttgcaattctagtctctgataaaacagactttaaaccaacaaagatcaaaaaagacaaggacattacaaaatgacaaagggtgcaaaaagaggagctaactgtcctaaatatatatgcacccaatacaggagcacccagattcataaagcaagttcttcaagacctacaaagaacttagatccccacacaataatagtggggattttaacaccccactgtcagtattagacagatcaacgagatagaaaattaacaaggatattcaggacttgaactcagctctggaccaaggagacctaatagacatctacagaactctccactgcaaatcaacagaatatgcattcttctcagcagcacatcacacttattctaaaactgaccacataattggaagtaaaacactcctcagcaaatgtaaaagaatggaaatcataacaatcagtctctcagaccacagtgcaatcaaactagaacttaggattaagaaactcactcaaaactgcacaaatacatggaaactgaacaacctgttcctgaatgactactgggtaaataacaaaattaggcagaaataaataagttctttgaaaccaatgtgaacgaagacacaatgtaccagaatctctgggacacagctagagcagtgtttagagtgaaatatatggcactaaattctcacaggaggaagcaggaaagatctaaaattgacaccctaacatcacaattaaaagaactagagaagcaagaataaacaaattcaaaatctagcaaaagagaagaaatagctaagatcagagcagaactgaaggagatagagacactaaaaacccttaaaaaaatcagtgaatccaggagctggttttttgaaaagatcaacaaaatagatagactgctagccagactaataaataagacaagagagaagaatcaaatagacaaaattaaaaaagataaaggggatctcactactgattgcacagaaatacaaactaccatcagaaaatactataagcacctgtatgcaaataaactaggttatctagaagaaatggataaattcctggacacatacaccctccaaagactaaaccaggaagaaatcgaatccctaaatagaccaataacgagttctgaaattgaggcagtaattaatagcttaccaaccaaaaaaagcccaggaccagatggattcacagccgaattgtaccagaggtacaaagaggagctggtaccattccttctgaaactattccaaacaatggaaaaagagagactcctctctaactcattttatgagatcagcatcatcctgatgccaaaacctggcagagagacaataaataaagaaaatttcaggccggtacccctgatgaacatcaatgcaaaaatcctcaataaaatactggcaaaccggatccagcagcacattaaaaagcttatccaccatgatcatgttggctttatccctgggatgcgcaaggcaggttcaacatatgcaaatcaataaacataattcatcatataaacagaaccaatgacaaaaaccacatgattacctcaatagatgtagaaaaggccttcgataaaattcaacaccccttcatgctaaaaacactcaataaactaggtatagatggaacgtatctcaaaataatgagctatttatgacaaacccacagccaatatcatactgaatgggcatttcaaagtattccctttgaaaaccagcacaagacaaggatgcccttcgtcaccattcctgtgtattggaagttctggccagggcaatcaggcaagagaaagaaataacaggcattcaaataggaagagaggaagtcacgttatttctgtttgcagatgacatgcctgtatatgtttgtatatttggaaaaccccgtcatctcagcccaaaaactccttaagctgataagcagcttcagcaaggtctcaggatacaaaatgtgcaaaaatcacaagcattcctatacgccaataacagacagccaaatcataagtgaactcccattcacagttgctacaaaaagaataaaatacctaggaatacaacttacaaggaatgtgaaggacctcttcaaggataactacaaaccactgcacaaggaaataagagaggacacaaacaaacggaaaaacattccatgctcatggataggaagaatcaatatcatgaaaatggccatactgtccaaagtaatttatagattcaatgatattcccatcaagctaccattgactttcttcacagaattagaaaaatctactttaaatttcatgtggaaccaaaaagagcctgtatagccaagacaattctaagcaaaaagaacaaagctggagcgtcatgctacctgacttcaaactatactacaaggctacagtaaccaaaacagcatagtactcataccaaaacagatatatagaccaatggaacagaacagaggcctctgaaataggtccacatgtctacaaccatctgatctttgacaaacctgacaaaaacaagcaatggtgaaaggattccctatttaataaatggtgttgggaaaactggctagccatatgcagaaaattgaaactggaccccttccttacaccttatgcaaaaattaactcaagatggattaaggttttaaatgtaagacctaaagccatagaaagcctagaagaaaacctaggcaataccattcaggacagtggtatgggcaaagacttcatgactaaaacaccaaaagcaatggcaacaaaagccaaaattgacaagtgggatctaattaaagagcttctgcctagcaaaagcaactgtcgtcagagtgaacaggcaacctacagaatgggagaaaatttttgcaatctatccatctgacaaaggcctaatatacagaatctacaaggaacttagactaataagaaaataactccatcaaaaagtgggtgaaggatatgaacagacactttcaaaagaagacatttatatggccaacagacatatgaaaaaagctcatcatcactggtcattaaagaaatgcaaataaaaaccacaatgagataccatctccagttagaatggtgatcattaaaatgtcaggaaacagcagatgctggagaggatgtggagaaataggaatggttctatactgttggtgggagtgtaaattagttcagccattgtggaagacactgtggggattcctcaaggatctagaactagaaataccatttgactcagtgtgcctggaattggttccttccggtgggttcttggtctcactgacttcaagaacgaagccgtggaccctcgcggtgagtgtttcagttcttaaagatggtgtatccagagtttgttccttcagatgttcagaggtgtccagagtttcttccttccggtggtttcgtggtcttgctgacttcaggagtgaagctgcagaccttcacagtgagtgttacagctctctctttcttttttttttaaattatactttaagttctagggtacatgtgcacaacgtgcaggtttgtcacatatgtatacatgtggcatattggtgtgctgcacccgttaactcatcatttacattaggtatttctcctaatgctatccctccctccctccccccaccccatgacaggccctggtgtgtgatgttcctcaccctgtgtccaagtgttctcattgttcagttcccacctgtgagtgagaacatgcaatggttggttttctgtcctggcgatagtttgctcagaatgatggtttccagcttcatccatgtccctacaaaggacatgaactcattcttttctatggctgcatagtattccatggtgtatatgtgccacattttcttaatccagtctatcattgatgaacatttgggttggttccaagtctttgctattgtgaatagtgccacaatagacatacatgtgcatttatcttgatagcagcatgatttatattcctttgggtatatacctagtaataggatggctgggtcagatggtatttctagttctagatccttgaggaattgccacactgtcttccacagtggttgaactagtttacattcccaccagcagtgtaaaagtgttcctgtttctccacatcctctccagcacctgttgtttcctgactttttaatgattgccattctaactggtgtgagatggtatctcgttgtggttttgatttgcatttctctgatggccagtgatgatgagcattttttcatgtgtcatgtgtctgtttcatgtgtctgcataaatgtcttcttttgagaagtgtctgttcatatccttcgcccactttttgatggggttgtttgattttttcttgtaaatttgttgaagttctttgtagattctggatattagccctttgtcagataggtagattgtgaaaattttctcccattctgtaggttgcctgttcactctgatggtagtttcttttgctgtgtgcagaagatatttagtttaattagatcccatttgtcaattttggcttttgttgccattgctttggtgttttagtcatgaagtccttgcccatgcctatgtcctgaatggtattgcctaggttttcttctagggtttttatggttttaggtctaacaattaagtctttaatccatcttgaattaatttttgtgtaaggtgtaaggaagggatccagtttcagctttctacatatggctagccagttttcccagcaccatttattaaatagggaatcctttccccatttcttgtatttgtcagctttgtcaaagatcagatggttgtagatgtgtggtattatttctgagggttctgttctgttccattggtctatatctctgttttggtaccagtaccatgctgttttggttaccatagccttgtaatatagtttgaagtcaggtagtgtgatgtgtccagttttgttctttttgcttaggattgtcttggcaatgcgggctcttttttggatccatatgaactttaaagtagttttgcaattctgtgaagaaagtcattggtagcttgatggggatggcattgaatctataaattatcttgggcagtatggccattttcacgatattgattcttcctatccatgagcatggaatgttcttccatttgtttgtgtcctcttttatttcgttgagcagtggtttgtaattctccttgaagaggtccttcacaaacttttaagttggattcctaggtattttattctctttgaagcaattgtgaataggagttcactcatgatttggctgtctgtctgttattggtgtataggagtgcttgtgattttgcacacagattttgtatcctgagatttgctgaagttgcttatcagcttaaggagcttttgggatgagacgatatggttttctaaatatacaatcatgtcatctgcaaacagggacaatttgatttcctcttttcctaattgaataccctttatttctttctcctgcctgattgccctggccagaacttccaacactttgttgaataggagtggtgagagagggcatccctgtcttgtgccagttttcaaagggaatacttccagtttttgcccattcagtataaaattggctgtggatttgtcataaatagcttttattattttgagatacgttccaccaatacctagtttattgagagtttttagcatgaagcgctgttgaatttcgtcgaaggccttttctgcatctgttgagataatcgtatggtttttctctttggttttgtttatatgatggattatgtttattggtttgcgtatgttgaaccagccttgtatcccagggatgaagccaacttgatcatggtggataatctttttgatgtgctgctggattcagtttgccagtattttattgaggatttttgcatcgatgtcatcagggatattggtctaaaattctcttttttttgttgtgtctctgccaggctttggtatcaggatgatgctggcctcataaaatgagttagggaggattccctctttttcttttgattggaatagttttagaaggaatggtaccagctcctctttgtacctctggtagaaatcggctgtgaatccatctagtcttggactttttttggttggtaggctattaattattgcctcaatttcagagcctgttattagtctattcagagattcaacttcttcctggtttagtcttgggagggtgtatgtgtcaaggaatttatccatttcttctagattttctaatttatttgcatagaggtgtttatagtattctctgatggtagtttgtatttctgtgggatcggtggtgatatcccctttatcattttttattgcatctatttgattcttctctcttctttattagtcttgcctagtggtctatccgttttgttgatgttttcaaaaaaccagctcctgaattcattgactttttgaagggtttttttgtgtctcttatctccttcagttctgctctgatcttagttattgccttctgctagcttttgaatgtgtttgttcttgcttctctagttcttttaattgtgatgttagggtgtccatttcagatctttcctgctttctcttgtgggcatttagtgctataaatttccctctacacactgctttaaatgtgtcccagagactctggtatgttgtgtctttgttctcattggtttcaaagaacatctttatttctgccttcattttgttatgtacccagttttcattcaggagcaggttgttcagtttctatgtagttgaggggttttgagtgagtttcttaatcctgagttctagtttgattgcactgtggtctgagagacagtttgttataatttctgttcttttacatttgctgaggagtgctttacttccaactgtgtggtcagttttggaataagtgtgatgtgctgagaagaatgtatattctgttgattgggggtggagagctctgtagatgtctattaggtccgcttggtgcagagttgagttcaattcctgaatatccttgttaactttttgtctcattgttgtgtctaatgttgacagtagggtgttaaaatcttccgttattattttgtgggagtctaagtctctttgtaggtctctaagggcttgctttatgaatctgggtgctcctgtattgggtgcatgtatatttaggagagttagctcttcttgtggaattgatcccttttccattatgtaatggccttctttgtctcttttgatctctgttgacttgaagtctgttttatcatagactaagattgcaacccctgctttttttgttttccatttgcttggtagatctccctccatccctttattttgagcctatgtgtgtctctgcacatgagatgggtctcctgaatacagcacactaatggctcttgactgtatccaatttgccagtctgtgtcttttaattggagcatttagcacatttacatttaaggttagtattgttatgtgtgattttgatcctgttattatgatgttagctggtacttttgttcattagttgatgcagtttcttcctagcatcaatggtctttacaatttggcacgtttctgcagtggctggtaccagttgttcctttccttggttagtgcttccttcaggagctcttgtaaggcaggcctggtggtgacaaaatctctcagcatttgtttgtctgtaaaggattttatttctccttcacttatgaagcttagtttggctggatatgaaattctgggttgaaaattcttttctttaagaatgttgaatattggaccccactctattctggcttgtagagtttctgccgagagatctgctgttagtctgatgggattccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagtttggggaaatttccctggataatatcctgaagaatgttttccaatttggttccattctccccatcactttcaggtacaccagtcaaatgtagatttggtcttttcacatagtcctgtatttcttggaggctttgttcatcatgtctttttactctttttttctaaacttctcttcttacttcatttcattcatttgatcttcaatcacttataccctttcttacccttgatcaaatcggctactgaagcttgtgcatgcgtcatgtagttcttgtgccatggttttcagtttcataaggttatttaaggtcttctctacactgtttattctagttagccattcgtctaatcttttttcaaggttttcagcttctttgcgatgggttcgaacatccttctttagctcagagaagtttgttattaccaatcgtctgaagccttcttctttcaactcgtcaaagtcattgtccatctagctttgttccattgctggcgaggaggcgcgttctttttggagaagaggcgctctgatttttagaattttcagcttttctgctcgggtttctccccatctttgtggttttatctacctctggtctttgatgatggtgatgtacagatggggttttggtatggatgtcctttctgtttgttagttttctttcttacagtcaggaccctcagctgcaggtctgttggattttgccggagatccactccagaccctgtttgcctgggtatcaccagcggagctgcagaacagcaaatattgctgaacagcaaatgttgctgcctgatccttcttctggaagttttgtctcagaggggcacccggctgtatgacatgtgagtcggcctccactgggaggtgtctcccagttaggctactcagggatcagggacccacttgaggcagtctgtctgttctcagatctgaaactccatgctgggagaaccactactgtcttcaaagctgtcagacagggacgtttaagtctgcagaagtttctgctgccttttgttcagctatgccctgcccccagaggtggagtctacagagggaggcaggcctccttgagctgaggtgggctccacccagtttgagcttcctggccactttgtttatgtactcaagcctcagcaatggtagacaccccttccccagcctcgctgccaccttgcagttcgagctcagactgctgtgctggcagtgagtgaggctccgtgggcatgggatcttccaagcctggcacgggatataatctcttggtgtgccatttgctaagaccattggaaaagcgcagtattagggtgggagtgtcctgattttccaggtactattctgtcacggcttccctttgctaggaaagggaattccctgatcctttgtgcttcctgggtgaggcaatgccccactctggtccgtgggctgcacccactgtccgacaagccccagtgagatgaacccagtacctcagttggaaatgcagaaattacccatcttctgtcgctcacgctgggagctgtggactggagttgttcctatttggccatcttggaacctcccccgagtgttacagctcttaaaggtggcgcatacgtagttgtttgttcctcccggtgggttcgtggtcttgccgacttcacgagtgaagctgcagacctttacaatgagtgttacagctcttaaagttagcgtggacccaaagagtgagcagcagcaagatttattatgaagagtgaaggaacaaagcttccacagtgtggaaggggacccaagtgggttgccgctgctggctcgggtggccagctttaattcccttatttggtgccgccacgtcctgctgattggtccatttcactgaccactcattgggctgttttacagagtgctgattggtgcatttacaaacctttagctagacacagagcactgattggtgcgtttttacagagtgctgattggtgtgtttacaaacctttagctagacaaacagcactgattggtgcgtttacaatcttccagctagacagaaaatttctccaagtccccccctgacccagaagcccagccggcttcacctctcaccggcaatctcattactgggtatatacccaaaggattataaatcattttgctataaagacacatgcacacgtatgtttattgcagcactatttacaatagcaaagacttgtaaccacccgaaatgcccatcaatgattgactggataaagaaaatatggcatatatacaccatgtaatactatgcagccataaaaaataatgagttcatgtcctttgcagggacgtggatgaagctggaaaccatcattcccaggaaactacacaggaacataaaaccaaccaccacacattctcactcataagtgggagctgaacaatgagaacatatgggcacagggaggagaacatcacacactggggcctgttggggagtggggggctaggggagggatagcattaggagaaatacctaatgtagatgtcgggttgatgggtgcagcaaactaccatggcacatgtatacctgtgtaacaaacctgcacattctgcacatgtatcccagaacttaaagtataataacaacaacaacaacaaaaaacaagaaaacatgtattaagaaagaaagaaaggtttttggtgctaatgatcaagaacctttctgcgatatcatctaggatctaggatccaggatccaggtgttttctgactctgtctttcacactgatggttggtactccttatggctcatgggtggagcctgtggcatcagggctacctgtgcctttgttcacatgtggtaagagaaagagagaacttagtaattctcttacaaagccagaaagcttcattctcaaaagcttccatgagacctcttctcccttgtctgtggcccagattggatcacgtgcctattggtaaaccaacctatgggaatgggagtggcatcccttttagataatcaggttgattccaggattctgggtagacagcttaaatgttcacttgtgcacagaagattgagtgcagtttaaacatgtcaaggagctggtggcataacaaggttgcaacttgcttcagaggttacatttatgagtctggattctgaaaggagcaatatgtgttttaaaggaaaaaagcaagagacagtgttcttgaattcttcagtgttttcagactctttctgtgaatgtgttactctgaaagtttgtagtagtacagacctggccagttttgtacaagcaaagcggagcaaacattcagtccactgattcccaaggtgctgaggacagaagttagtggaacagtccacggtggtgtaagctgagtactgacactttcctcatttaccagctaattctcccttttaccatttgatttgactttgccgaaattggtcagatgggtaaggtttgggtggctgaagcatatgacacttttcagttttagagctcattaggtgttttttaccagtatttcaacttgatgcattacaaatttgatataattcagggaaaggacctgtatgggataagaagtaatcaaaattattctgacctttttatgtagtgtttcaccataaacatattgtttacttttgtctcttctttaaggaatatatacagcattaaaagatgagagttaagtaaactctgggctatcatacagtggaatatgaataaaatacatacatacacacacccccttccttaatccctccccacacccctaaacttttctggcagaggcagtcgtgcccaccaaatattctaattgctttccgcatttcccagccacctttcagttgcgtgggcatgtgtctcatgatggacaatgggctgtgaaagagatacatttttcttacaggccatggcagtaaaagatccatgcagaattcttcctgtttttctcccatgaggagactgaagggaccatggattccagatgggcagctataaaatggaaggatctctgttagtttgagtcgctgagtgactgtgtgaagcctgtgtggagctgagcctcttgttgacccttgtaggccatttaacatgggggagaaatgaacttttgttctgttcatccactggcatttggaattgttacaggagcacaatgaatacatacctcctttcaatatttactctttgtctggaagcacctttctcaaacctaatccttacctccttgcctgctcacccagtagagcctacataaaagtttctctctttttgatatctcagtgttgccattatagatctcagttattgtgctgatctgttattactcatcagcatagatgccatcaggacctactaagctaagtagggtcatttgctttaagagatgaactgagttgagtagtaaaatgtattccctaaaaaagcatgtgtgaatctacagtaactggagtaactagtcttatgaaaaattggagactagaaaattgcattcaaggtttggtagcttgatattttgttaaatcagtactatttccgttcctcccccaagtttgtttagtttcattttttaaaaagactttattgaggataatcgacataagaaggtgtacatatttaatgtatacaacttgatgagtttggaaataagtatatatccaagagaccatcaccacaagctatccaccctctctgaaagtttcctcctgtcctctttattattgtttttttcctgagaaaaacacttcatataatatctaccctcttagcaaattaagtatacagtacagtgttgttatctccaggcagtgtgctttacagtagatctctaggaattatttgtgttgtccaaattatacactgttgtattcaagttatatacaagttgtaccttgatagttcaagtttaataaatctctttgtagttacccatgagatctgatagaagatctggctaatatttctgaagaaattattccttggagaatgaagtagcttttagaaacatatttttatgtcccagaggaaccccaagacctgttcttcactaacattataggccgtcataaataacctacccacacaccacgaaaattgtctttggtttggagcagaggtcaaaaagtgggacccatgcttgctttggcccacaaagtggtttttgcataaggaaaataggtgccaacatttagaaatcaggaaatttaacacaaaactctagatttctggctgctcttttaaaatgggtggatgtggccactctgagcctgtgttagcagaaggttggaatggaaacaacagaactgaggcatcccattttccacagccctcgcttggctcggtttgcctctcactcactgcactcaccccactactgcaggcattttggttggagggtttttttctccattatcatgcacatatttcctgggagaatcctgccagtgatttaggacttactttcatctaataaatattcacttagtattcacttagtttcacttactctggtaagcagtccacgtgacatataattggaaagccttacataattgttgcctcttctgttctcttcatgttatctcctttatcactatagcattaaatttactctaatgatacttattgagatcctatgtgctagattctaagggtttaaaaatgaatgagatacagttgttggccaccaggagcccagcttgttggtgatattgttaaagaaatgagcactataatgttgccacaatatactgagtatgagagagagaaagagagagagagagagacaggtgacctctgatggggagagttttggaggagttttcttagtggaaggcacatttgaactaggttttcattgataagtaggagttctctaaacttttgagataaattagctaagcctgcctatagtgtggaccagtttgaaacttttactaattcttagtgaagcatgaaaggtagtcttcactttgcatggcctatggggacatcaaaatgactacgcaagttgaaactgtgcaaaacactttcatcaatcaatgggaacattaattgatctacagcctttaaaattttttgtcaaaatatttagtctgttttattgtcagtcataaatgtataggaaaatgaaaaaagtaaaactaatatttattcagtacactctatttaaatgttggaaacactgaaaattaacacgtattatttctttgtaaaaacttgttaagttcgaatagtgctttctttttgttgtataatttacaataaggcgagagcatcttttgtaagccttagggaattgtcatactcaggagtctggatcagcttccagtgtttcatcctgtgtgctttcaaagttgtgaaaaatcttctagaatttctttaatgtgaagttttttgtggcatcacttcctcagggatatctccatcttttttttttttgattttttttttaaattttattattattatactttaagttttagggtacatgtgcacaacgtgcaggtttgttacatatgtatacatgtggcatattggtgtgctgcacccattagctcgtcatttagcattaggtgtatctcctaatgctatccctccccactctgcccaccccacaacattcccgaagtgtgatgttccccttcctctatctatgtgttctcattgttcaattcccacctatgagtgagaacatgcggtgtttggttttttgtccttgcgatagtttgctgagaatgatggtttccagtttcatccatgtccctacaaaggacgtgaactcatcattttttatggctgcatagtattccatggtgtatatgtgccacattttcttaatccagtctatcgttgttggacatttagtttggttccaagtctttgctattgtgaatagtgccgctataaacatacatgtgcatgtgtctttatagcagcatgatttataatcctttgggtatatacccagtaatgggatggctgggtcaaatggtatttctagttctagatccttgaggaatcgccacactgacttccacaatggttgaactagtttacagtcccaccaacagagtaaaagtgttcctatttctccacatcctctccagcacctgttgtttcctgacttcttaatgatcgccattctaactgatgtgagatggtatctcattgtggttttgatttgcatttctctgatggccagtgatgatgagcattttttcatgtgtcttttggctgcataaatgtcttcttttgagaagtgtctgttcatatcctttgcccgctttttgatggggttgtttgtttttttcttgtaaatttgtttgagttcactgtagattctagatatcagccatttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgaccatgcctatgtcctgaatggtactggctaggttttcttctagggtttttatggttttaggtcatatctccatcttttttgtcacagccccttccttgctcatatcaataaatgtatcttcactaagttcctatggctgagcatctggagtcactcaaataatcagcaatgtcagcattcccacaatcatctccttctcctgttctcattgacttctgattcagatttcatttccagcattgtcattttttgtttccttgctgcactttcacctttgttggtcagtttccccttttgatttacccatttttgtaaaatgccacgtggttttatgactgggagacaaggagtcatcatgactacttgcgttgccatctgtgcagaactgataacagccatgtcgtgagcagtcaccaacaaacttcagaagagaaatgtgattggtcactgatccagatgagacctgttatttatggactgaagagctggcagtgaaatttgtatttgatgcaacaactcacagtttgtgtatcatggtaatggaaatgtaaacttgtgttgttgagggattggtgggttttcaaccaagctgtggtaactgaaattcatgcgtagtggaactttgtaaagcgtggactatctgtattgacattttgagtggatttgtcctgtcctctgttcagagtttagcaagtataaccctggccacttgacggcattccattaaaacctcctaatcgctgttaacaaccacaatgcttcccatatttcccatatgtgtttgggggtggtggtggggacactaatctagtttgggaaccatttgggggctatctctgggtcatttcatcattaataaggcagggagtgtttggaaatagccactctgctgctgctcagttacttcagcatttatggctgaattctgagaggtggagctttcagagtgacctccccttaagtatgtggtgccttctgcttccttcataggccaagggaggcagaaagagcctcctccacaaggagtcacatgacctggattctagctggactttgccacatatctgtctgccatataacctttttgaatcctaattttcacagctatacagtaagtttatctgatttacaaattattgtgaggaataaatggaaaatgtatgtaaatactgggtgcacatgaggaattgttctgatgatgatgaataactgaatcattggtaggcctttcttggactacaatgaaatatagcagaaccctctaatgtctcagcaaaataaacatcctcagcttttagacgccgcctcgagtgagaagttcacaactttcccatctccgcttagttggctcttttctcacttagctcccttcatggtgaaatgcagcgaatagactaccagtccattattagtccatgaaataactttaaacagcctcctccatgagggacagaccttatttctctattaatataaggaaaatagagcacaaattagttggtcttttagagaaacaggctgcagatggctcccagctggtagccattttgaatgatgaattttgaagagagtataaatgttgagttagagagttcagtgttcttttcctggtccaagaataaatatttttagtaaagttagtataaatagacctgtcttggggtgatctgagatgctgattacttacctgtggatttttaacttaacgtcgggagcgaagaatttggtgaaataagcatgttagtagaatattgctggcttggcaaaggtttccttcatctgtaagatattatccggtaattgctgcaaacctgcgacatatatggtttagtgaacattggtagatatgttctctttccacatggtatactaatctggaatttgttggagatgagataaatctattatgacttgaggattgaagaatatgaatggaaattatttttatcatggatgaaactacttgtagaatttgattagattttacttgtttattttattctaactttaacagtttatttcaagaaagtgaaattacttaaatgattcagtgtaaatctctgaaattttttcaatagcttacagactttcttctaattacaaaaaatttgtaattctagcttttgtaaacattaccttcccttcctatctctacctgccaaagccccacagaaactgaaaagaaaacaggtacatgcaattttatatttatttggtacctttttaatgtggaaaagaagtacttaagtcttggatcagggaacattacttcctatttataaaatttaaatataaagtggaaagttaagataactatttaacttccaaagctgttacatatctatagcatgctatcttcatcagatttttcatgatgaaaaaaaaacttttgcagatgaaatataaaaaaaaattttcttacatcaacaatcttaattttaattgtttcatatattttaaaattgatattctttgggcaagccctttttttactatgaatatttgctattcatcaaatctgatattaccgtaagaatgaagttacacttcaattattagttccctataggaaatgagcacagtaaatctaacaacagaaatttaaaacaattatatattcaaataattacatttttagatggactcctccaaaacctcttcttttcttatgacatataagattgctagtataagagagcagctaaggaaccctaacagagattggtaaaattgagaagagatttcttttgtcaatgaggatgtccggaagttgaaactgacttacctgaaatagcaaaatcatacagcatccagaattatgagttagaacaagagttttaaaatacttaatgtgtgttttaatgttcatagacaatgattcaacatcagatgtttgttctttgagctttcttttggttttgtggtggtgaaaacagggacaatagtaagattttaagaaactggctggaattcactctagggcttcccccacccccctgctgagacgacatcattttcttcgtggagattttgtggctttgcataacttggcattctctaatttaactgacagcatgatatttatagttttgttaccataaggaagtactaattattttaaacgtgtttcccaactttcaggtaacatttcacacaactgggaggcatcagcgtcatattttgggtggggaatgaccagaatgatccgcttaattgaattattccttgaaagcaaactaaacattttggacaacatattgactcacttaaacatatcacatgtttcttggaagtgattttcttgtcagattttttgggaattaattggattgtgagaaatgtacaatatcctcttgaaaaagtgtcagtgtctctgtccatagtagcattcataaaattatctctttatttccatgatgtttttgaaaatgttactttaatgtttatagaaaataattcaaaatcagtagtttattctttcagttttggttttgtgaaggtgcaaatagggacaataatgaaatttttttagagatcaaaaaccaactagttgaaactcactgtggagttttttatttcccctgaaacaaatagtcattttcttctcagcggttttgtagcttctttgatttcagccacatcttcctagccttaccttttccagttccctaatttacctgccttgatgaacatttaggacatatttttgcatagcttgtggatacagaacctctgacttgcttactgccctatctcctgcctttgtgccctttcttccaccccatgccacttgcaggagatgtgcttgtcggcccccagatccagtaacctagctccagtactggggttcctggaccaacctccacccacaccccctgcaggagatgtgcttgtcagcccccggatgcaataatctagctccagtactgaagttcctagaccaaactccacccacaccccctgtagagaccttgtgcttcctcccccacctcccacccccatgacagaatgcgtcacactccactactcccatcactggctgaggctgtcacaaattaatagtgtgccatatcaaagctgtaagaatagacctggagtcattgtagatgatggttttaaaagcttcattgatcacatcctaaggaaaattttgacttcccgaaagtgagtaagtgtggccccttcctatgtgtaatcactgcactggccagaatttatttgtagggagtgtcagttaagcacaggtacttggtggcttctctttctgtcatgaattcaagtcagtttgaagggtattagtgtgcacagccgtaggacagtggggatgacaagagacacgttacctgtcctggatgtgtggggtgagccttgaagcccttcggctgcactgaatcaccctcagggccttgcaggtaccagccctctcttctttttccagacctttccacatgccctcctcctctgcctgggacacattcttcaccttttctccagtgagccaactttttctcctcctttaggtcacggcattagtaagcattttcttgaggtagctttccttgactacccacgaccgggttaggatcccctctgtacatgctcatattgcactgccccattctgaaacatggcacacagtaccatgatggcggttggcttatcttctcccttgttagattctgagctcctgcaaggtaggaattatcttgtttgctgttgtatccctagtatctaggacagtgcctgtctgaccaaaagttattaatatcatcataaatacaagggctaatatcaagcactcagtacgtgccatgctatgtgctttgggttttcttaagttctcacaacaactttagaaatagatacgataaaggattttacagaggaggaaattgagattgatagaagttaagtaattcgctcaacacagcacccctagaaagcagcagagctggtatttgtctccggagtccctgctcataatggctagattacacacaatgatgaacaaataaaggatgtctgcaaaggcatctggccagagctctgtgtggggccagcagcttcatgaatgatccaaagagttggcattagctggccacaaatggtgttccagagagtcactttttttctagtcatataggagaggtcagctccagatgtcaaattctaattactggcaatttgttttctctaagaggtttggcatttactgtggctcatagaactttagaggtcgtgtggtacagtatacagagctctagttttagaattaaggattggaggcttgggcttaccccactttcccttaaacacagtgttgatgtgagtaggttgagagtggtctttgtgaacccacttctctgcacggtatagacagggagttgtagtgtggcttagagggagtgtgtataaagctgtcttcccaacttgatggcagttacctgctgctcttaggatattttctctggcatattattttctgtcatgggcatctattggtgcttaataaaataagtgtacatgcagggttatttctgggcacttctactaatgatttaagatttcagaaagttaggtcttctacacatatgtcaaaaggcaaacttatctattacagtatcataatatggcccttgacttcatttactggattaagcaactgcattatttaattcagaaaaagaaaagcatgtagattgttttcttactgcctccccaccaatagcaacattatagtaagatcttatttttctatctttctttcttttttttttttaaacagtgtctcaatctgtagcccaggctggaatgtggtagcatgatcattgctcactacatccttgaactcctgggctcaagtggtcctcctgctccagcctcctgagatgggactacaggcatgtgccaccacattcagctaatttttgtattttttgtagagacggagtctcactatattgtccaggctggtcacaaactcctggcctcaagcaatcctcctgcctcagtctcccaaagtgctgggattataggcatgagctactgcatgcagccttatttttctatcttatctctttgagagtcttaagtaacttaggggaaaattctgaaactagttaaatccggggcctgctgtatacagggcagagaacttagtttctgttttgcagaaacaggttgtaaataagtaagttcagaaaataagaggatttccacttgcaataagggttaggagggaaataaacacagtgaggtgggaaaaataattgtggttgggttggtgtgagagtagaaaaggatggggagttggacaagatggcagctgaagtctgagcatgagaaggggctgggacaggaaattctgaggaagagataatagtgaatgcagggactcagaaggggagcctgctgggcatgtttttggggtggcatcatggctgatgcagagggagttgagaaagataacattttttcttttttactagtggtttagacttaactaaccaagttaatggtgcaaacagtaaacacattagcagagacaggcatgaatgagagaagcagcagccggggccaggtgctgtaggattaaggtaacgagctcacctgccttcagggccagaccagtaccttgacttagtgaagacagtgtgggcttaacttttgttcaatttttaatagagacataagtgtagagaaatattgctctgagaaaaacagcaaacaccatgataaatggcaagtgagcagtacaatgccatgatgatgatggcaagtggcctttgacctcgcagtcagagaagtagtagggactgggagcagctcagagcctgctggccctgactcaagggggcagctgtttctcagtgccagccaagcattgccatgtgggaatgtgagtggtctgtgctaaatttgccaagttttccagagaaccagaaatctgaattgttctatgaagttcccagatttaaaaatgttggctcaaactttaaaaaaccttacaatgaatagacaaaatgcatctgtgggcttacagtctgaaacatctgctgtaagcccttttatattatgataaagggggctcatgaagtttgatgtatgtgaaccatttccttgtgcccggtacgtagccagtactgaggagaaaaaggtacttattattgattgcacccttgatgtgtttaggttgttttcaccattaatatatttaatgaactctcaatccatattaaagataaatattatcccagtctaattcaagtgattaaattaatacatgatttttttttgctgtttgcatattggttagtagtttgctctattagtttggttaattctatgtttgtcttacatgagcaaacattaatctagtgtaattcacgtaaaattagtgaggaacagaggacgcacattttaaatcctgttcttttcttatttaccgtccatttccgttgctgggcagtcgttgcttccctcacttgtcctggtgcttccactcattcaggtcttgagacctcctagacagtgttagctgcatgtgcaagtgggaaggacctttggcaaaaatgccattctgaaccaggcaaaggatgatggggaatgcagtcttacgacgtgatgtcgcgtttagagggttttcatcagttttaatgaaatacaaatgcacccaaagcaagttattttttcccccagggaaaaaaatcttcatttagtatggtctaactcatgcagttttgtattacaggaatcatgtttggtgtgttgcaatcccttggcaattgtcttggggaattttattcagcacaagcatctctgatggttctggcatcaagttgggttaattacttgttcatgtactttttggtttgtgtctatgttaaaattctgaagcattgtggagaggaacactgggagtaacaaaatatatttgaatatttctaatagattaaaggcttataaaaacatctcttttccccccagggttttttttttctttgcattgttttcaaatgagatcattttgtatgaacatgaacttaggaacttgaaaataaacttttttgtgtgtgaaaaatcttatctgtaaatacaagtttttaattgagtcaatatttctctcaatttttgttacagatcatggaggaaacaaatacgcagattgcttggccatcaaaactgaagatcggagccaaatccaagaaaggtaaattgtgagagggcaagaaataggtggttttgataactgagattatggaattactgcaggtttgctggggagaaaactaacctttattcttaacacttttgtcccaaaatgtttgttaagtagcagtctttcaggaggattttcataattaaaaattatagtttttatccaacaacagaaaaatattaactattaacattatgatagaaatgtaattatgaaagatatagcaacctgtgatttcaaggatgcttattcgattgatatccatgagtcatggtaactcttcacatgtttttaacacataaatttctattgtttatatttcagggttcttttttatgtactacacagatttaatagctggttttttttttccctccagtatgatatgaaccttagatttcaggtctcgagtgctgcttgtcttcatctatcagacagcaaagaacccactagatttctcttttaggctgagtgtttcccttgcctggttttaccctatgggacactacccagtgcatagatgttcagaaatgaaactaaaggcctccctagttttctccctggattacatagtgttttcaaatgtgacctgccaatatatatttttatggatagtttttaaagtatgaccttagtctcaacaaactttgtggagtatatttcattagaagaatgcagatgcatgtagttgtcaggatgtaatgacaaataccatcaaacaattaaaaaataattgcagtctgagctgcaattatccatcatggtctggcattgttattgctgctgtttagtttcgtatttgctgccccttctccccatgacttactactaaatgataacactgtaagatttctcagtttcctttcttacttcagtccagtttgccttcttttaattgcatttcgttagagttactcatcacatggaataaaaattattttagttatttagtgagtgttgttagctggacttgaattgactggaattcctgtagaaactcctatcttgctactttttttttttttttttggagacagggtctcactctgtcacccaggctggagtgcagtggcacgatcatggctcactgcagccttaccctcccaggctcaagccatcctcccaccacagactcaagtagctgggactataggacaccaccatgcttgggtaatgtttgcattttttgtagagatggagtttcactatatgttgctcaggctggtcttgaactcctgagttcaagcaattctcctgccttgatcttccagagtgttgggattacaggtgtgagccaccgcacccagccttgttaccttcttaattgttatcatgggcggcaaggaattgggaacttatatgctaaataatcataagaagacatggtgaatttgcaagtgcaattctgtatctttgtataagcctgtatttctcaagtggtgtagaatatattcttaattaatcttcagtaatttttgtggtatgttggaatgttttgtactcattatgcagaagaagaaactgccgttcatggattatctagctgtttgcagcatttaaaaatttctgtcctactacttgaataaattggaacttgaacatagactaaatcttctttccctgttgtcaggcatttttacttaaagaataaaattagctttattactagcctaataaaaatgcaacttaatcagtctccaaagaaaatccccaaggaaacatgaacatttaaacaatgctagataactttttatgtcttattctcttgcagtatccatgctgttgttttcctctccccatgccattatcctgagaaactgagaactgattagtttttgttcaaaatgtggtggcaacattagacatttcagaaaatgtggagctgaatagattttattcattggtttcttgtcattgacacttaacccattcaaaatggccaactatattgcacattttgattatatattttgctttggaattaagaatatttcagcagtacattcgagggtgtttggcataatttccacctggttaaaattaacctttggaactatgcctaagaattgatcccttcaggcctggatctatagacatcatttattttgtattatttatgaagtgttatggatgtatatagtactatatgatgcgcagaatgcacttaaagagaacatggaagggagagaatcagaagtttgcctcagaggaatttactgttgagaatttacttgagttgctcttatcatttaagcacacagctgctgaatcagttcttggctaacatccctggtatgtgtatacctatattattttttaaatgattcacttcagagatgcaatttttggaccataatttgtatttaataaaagtgaaatgaaaatggcaggaagaatgttagaaggtaattatttgctctttgatctgatgtggcttttccttctcacccctgagtgttgcagaggaaggaattgttggtctttagagctttttcattccagactattattattcaagagacccaagaatataaatgtatttagggactcatgccgtgttttggatgattattacattctaaatcccatggtgatgtgaaactttggaatatacacataatccccaggctgagctagagagacagtacagccataggtttgtgttgcatttcactttggagtttctaaaatgcatgttggctaaatatttgagcctagacaaacatttttcgtggtcgctgttaccacagtttgcccccttctttaccttactggaatttagtcctgtgtttcctaaattagcttccatagctctgtctaaactttactttttaagccattaatcctttatcgagagcagctgtgtgagtggccgtatggctcacttgcttgaagagctggaaggaagctgcctggcaagaaggcaagcagccaacagcctgaatttgccatcagttagagagttcagattcttctcctctaaagatgttggcttagtagttctgaggctggtactgggagctgctatatttaacaagtttcactacttgttcttatggtcagactgagtttgggaaacacaaatctcaccatctgatatggaaatatcactaagaagaccatgtgttctgaaggcaaagggtgaccactactgagaaacagcagagtccttctacagtcgcttctggataatgcccatcttggcatctatagaactgcatttttatggatgcattaatttcatttttctatcatctttgtagtcagttaatgtggattagtttagagtgatgacaacctcattgttctgtgcctgtgctaaatgttggataaaagaccatctaatttttgtccattccctttcctcctccctttcttatcatctcacttttctttcttacctttcactccactttcattcttctgtgaccgtattctagatggaatatagtaggggcaaaagtaatagaaatattttcatgtgcacagggcattttagggaagtgcatgttttgtgatataaactaaggaactatagaattatttaaactttttttaattttagattcaggggtacatgtgcatattttttacatgggtttattgcatactggtggagattgggcttttagtgttactgttacacagatagtgaacatggtacccaattggtaatttttcaaggccttgccctagaattttttaaaacatctctagagtatttgaaattattggaaggttgagtcatcattagagctggagagaactgagaatttaaggttcagtataatggacatttaaatgggtgactgtagaattgtcttaaagagggtcacgattaagaacaacaaagcaatatttgatatttcttctgtatcacgtaaatttattttgagtggataaaaatttaactccttctgactcttagattgagaatactagaacagtctcctttacattgaaaaatttgaggtttgtgcctgtgaaaccagtatttagggattaaggtgtttaataccatacacccttaccaacagaataacttcaaggactcattaaaattttgaacatgctattctgaatcatagccttaatattttaaaataaatgcagcttcattaaagtacaaattgcattcttaacaaatttgattgttttgccaaatagaagtcctgccagacctgctttaagaaatacataaaaatgatttgcaatgagcatttatcacactggtatattgtgctgtgagcttcatgatgctagataagtttgttttcttaaacaaggtaaacatttttctcacagtcttcttttgctcttaatctgctcatcagtctcttcttagactggcgaaggtgaacggtaaatgatatggtttggctgtgtccccacccaaatctcatcttgaattgtaatcccctttatccccagatgtcaaaggagagatctggtgggaggtgattggatcatgggggtggtttccttccacgctgttctcatgatagtgaatgagttctcacaagatctgatgagtttaaaactgtttgaaagttcttccttcccacgccctctctcccctgctgccatgtaagatgtgcctgctttcccttctgccatgattgtaagtttcctgaggcctccccaggcatgcagaactgtgggtcaattaaagctctttcctttataaattacccaatctcaggtatttctttattgcactatgaaaacagactaatacagtgagtaaaaaaatgtttaaagtttttaagccaaatttcaaataactgaggtcagcatgagtgaagctttattgcagagttaaaccaagtgataggaactaatccctgcaagtggtccttgcatgatgacttaggaaaccccaggactagcaggaatgagaggcattgactgggttacttgatgtttcctggtttggagacaatttggcaccaagtttagccattctcttcctcccagaatcaacaaaagaatcttcgtaattccatgaggttttattgtttttggttacattttatcagaacaagtaggtatctaatagaaaatgttagcatgagaaaaatagtagacagttcgttttgttttttccagaagaaaatgttttgttgagtatgcttacacttttattgggtgttcatagtgaactagttagttgagggctttaacatagttgtacttaaagggctgagggcacggaagaggcatggcagggcatggcatgctggaccaaagtgttgctaatggtgggttgcaacctattcgtgtgtcaggtgttaggttagtgcgtcgcagccaatagtaaaataacccaactaggttaaaaaaaaatagagtgtaagggcattgtttgttattaaatttttattttatattttttgagacagagtctcactctgtcacccaagctggagtgaagtagtgcaatttcacctcactgtgacctccgcctcccgggttcaagcgattctcctgcctcagcctcctgagtagctgggactacaggcacacaccaccacgcccagcttattattattattattatttgagatggagttttgctcttattgcccaggctggagtgcaatggcgcaatctcggctcaccgcaacctccacctcctgggttaagcgattgtcctggctcagcctcccgagtagctgggattacaaggcacctgccaccacgcccggctaattttgtatttttagtagagacagtgtttctccatgttggtcaggctggtctcgagctcccgacctcaggtatttcagccacttcggcctcccaaagtgctgggattacaggtgtgagccaccgcgcctagccagctaatttttttttttttgtatttttagtagagacagggttttaccatgttggccaggctggtcgtgaactcctgacctcaagtgatctgcctgccatggcctcccaaagtgctgggattacaggtgtgagccaccgcgcctagccagccaattttttttttttttgtatttttagtagagacagggttttaccatgttggccaggctggtcttgaactcctgacctcaagtgatctgcctgccatggcctcccaaagtgctgggattacacgtgtgagccaccatgcctggccaatatttaattgatagaatactttacatatttatagagtacagtatgatatttcaatacaagtataccagatgtaatgctccaagtgaagcggcatcattgtctggggtaaattcctgaggttcgttgtctcatgccaaggaaatcaaggacacggacacacatggagtgaggttaagagcagaggtttaataggcaaaagaaagagaaaggagaacagctccctctcctacaagagagacttccagcctgcagtagagtgcacagggttttatagacaggcttgaagaaatggtgtctgatatacatagggcccgaagattggttggaccaggtgtgatgtttacatagcacgtgaagaagctggccactccaccctaatcttttactatgcaaatggggtctctacttggcctgtgccatgttgcctgcttacttactgtgcacgtggttgacaaggaaaggggaagatggagctgccgtgttggacctacctagcccccaggtggtcttttcctagtggcacagttgctggcattcacccatgcaagcttccagcttgcttgtctatgtttgcagctcgattttactggctgctctttgttagacaagaaaatgatttgggggctacttttccttaaaaggaaaaccttactgaggacttcttacccttactatctgcctaaatagtattctcttaactcctatatcacaagcagggtaattagcatatccatcacctccagcatttattattctttgtgttgggaatattaaaaatcctctcttgtagctatttgaaaatatataataaattatatttaactgtagtcaccctacagtgctacagaacactaggatttattcttccaatctagatcttacctttgtaactgttaaccaacctttctctataccaccgtcccacaccacacctttcccagcctctagtactcattgttctgttctctacttctgtgagatcaacttttttctcttccacatatgagtgagaacatgcagtatttatctttctgaacctggcttatttcagtaagggtattgtttagtaaaactttcatatgcgtctgtttatgtgcaaacatacacctgtgcacaaatatattagtaggtcatgatataaaatggatgacaaaggttgtagaacactgtgctaggtggtcagctctccaaagggtaaggagcacgtggattttgtgaatccgtctatccctaacactgtaaccagttcatagttggcactcagtaagtgtttgtagattgagccctcaactcaatcatggaaacagtggaaccactaatacagatgggaatgtatatccctaaggtgtgtcatgtaggaaaaagatttagaattattgccttcccagatgagtgataatcactgttatgaaaattatccactactgatatcttccctatagaccccttaagtaaaaaaatgtgggacatgattgtgactaaaccttctttagtggttctgaatagtcctaatgatgactgcctgcactaatgagggaagtggaaggaaacttagggacaatgacctgatcattgtcattcacaggacacctgaatgagtgaaactccggtgccattctcagtaagcttttaaatgagacttaacaagacacagcctcctggtagacctccagactatagttgttttggttgtggttattttaattagtatttatttacataattagcgattatgtaagtgggtcctaccatttgttgaaacctcctggggtcaggcactgtgctaaatattttatgtacataatcttttcaaattatcagtgagtgataccaccaaactctatgagtgaggtggtagtattttcattttcggatgaagaaactaaagccagtaaaggtaggttagtttgcccatggttttccagttggtaagtagcagacctcaaacccaaattcaggtctgtttgtttccagaactccaaatcactgtactcaaatgccctttcacacccataccttccatggtgcttttccctattccaggaagttccataatgtataataatatctcttcagcaaccattgccaagattagctgatgatgctcagtccagtttcataatgtctcagtccttgcagattacagagattacagagatttgaaggtaggctaaggttagcatttcttgtagacaacacctcttttttcaggggaaattagattttaccgtttaaaaagatgaaaccactcaaaggtgtgtacatttttgaaaagtgcttgcctctgaattttaccttgctatttcatgccatgtgttatttccttaggcagagactttttgatatgtcattaaacaactttgaaaaaatgaatttggaaggaaaataaacccagaatatgttataaattgcttgttgtgttggttttcttttacatgtatatgtgtgtgtgtggtttttttctgtatgtgtggttgaaatcttcgaaagtactgtttgtcacatacctgaggacctgtgtatttcttctgggtagaaaaatgtgtggttttgttgttgttgttcttgtttttgagatagggacttgctcctttgcccaggctggagtgcagtggcatgatcatagctcggtgcagccttggcctccatgacttaagtgatcatctcacctcagcctcccaagtagctgggactacaggtgcaagccaccatacctggctaatgtttaaatttttgtggagttggggtctcgctgcattacccaggctggtctcaaactcctgggctcaagctatcctcccacctcagcctcccaaagtattaggattacaggcatgagcctctgtgcctacagaatattttgtacttaaaacttttgtatatattattaagatcatcacttggtgaatgctaatcgagggccaagagtagaaattcacccaaagagttgaataagttgtatgcaatgtaccaatagtcactgtggctagagagagcatggtctaaataggaccactcagaggagaacagagacctgggccattccagttcttgaagatcccagtatacttcaacaataaaaattttataaaacgactacttttagatattcagtttttcagtgcatctctttctacatgaataactgtatttgtagatagtgccaaacatgcacatttgagatccttttcgaatatgtattttctcacactcacagacatacagcgcacacatcattttacaggtgagacagctcatgttcggtgacctattagcaagactgaggacctgagcttgggttcatttcttgatctccagctagttccgccttcttctcttctgaaggtcccaggtattggcttgtttgcttatcttataactgctgcaaactagctgttctttccaatcttttttctctctctcctgtaccagggtcagagaggaaaatggtctcagcttttcagttatcttctcaagcctaaataagcaaatatatctggtagtttttttttttgttttttttttttaaagatattttcccttaacttagaaatgaaacaaattttcagtggaatagagaggtgagaaagtaagtaaaaaagtgaaaacatcaacagaaagacaagccagagacggggagaaaatatttgcaaaagacacatctgatgaagaactgttactcaaaatatacaaagaactttttaaaacctaacaataagaaaacaacctgattttaaaagtgggtcaaagatcttaacagacacctcaccaaagaagatatacagatggcaaataagcatgtgaaaagatcctcaacatcatgtaccattagagttgcaaattagaaccgttaagatatcactacctacctgttagaatggttgaaatcccaaacactgacaacaccaaatgctggtgagaatgtggagccataggaactctcattcattcttggtgggaatgcaaaatggtacagctactttggaagatggttttgcagtttcttgtagaattaaacatgctgttaccatatgatgcagctgtctctctccttggcatttatccaggggagttgaaaacttatgtctgcacaaaaacctgcacatggaacagaagcttatagcagctttatttgtaattatcaaaactcggaaacaaccaagatgtccttcagtaggtgaatggataaatgtggtacgttgacacaatgaaatattattcagtgctaaaaagatatgagctatcaaactatgaaagggcatggaggattcaatcttaaatgcattatactaagtgaaagaagccagtctggaaaggctacatactttatgatttcaactctatgtcattgtagaaaaagcaaaactttggagacagtaaaaagatcagtggttatcagggacttcgtgggagggaaaaataggcagagcacagagcattcttagggcagtgaaattattctgtatgatttacaatggtgactatatgtcattgtacatttgtcaaggcccatagaacaggttttgaagttgatgtgatgttgacagtccccggggaggctgtgcctgcgtatagaaagcagcgtatgggaattctctgtactttccacttgattttgctctgagccggaaactgccctgaaaaataaagtctatatttaaaagaatagtcgtagatactagacacagcatttttatcagcattttaaaatatactatatgcaaagataatattatatggtcaagaataactccttaatgtataaatttaaaagcaccatgaaatctcttaagaaacaatcagaagttttataaaattttaaaaaaggaaagtgaggaaaatgcctaaattaaacagtaaaacacacccagttattcaacaccaggtggcgactggactgggtctggatttttcttagcttgcctgactctgtgactgctgctctctgctttcttgggctccttctccctcaatcttcctgtttccagaacagatgctttttatgtcctcttgcctgtggtgacatcccaggatcccttccatctgcagttttttcttacctgttaaactttatgaggaggaaaggagaaaatattgattatttacctgttttgtaataggcattataatagatgcctgttgtaatctcttttaatcctcacaataacccacatgaaggagtgttattctccccattatatatattaataactaatgtgaaagatgatataatttgttgaaggccagtgaattgtaagtgatgtagtttggatataaaccttggtttcaaaattcaagacacggtaatctgtccattctgtaagaagcaagcacataagtgctaatgatgagtgtttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctgtcttttaaaaatgttcagcctacgtttatttttattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctactggcatctagagggtagagccgagggccgctgctaaacatcctaccctgcagaagacagccgcctcaacacaaaattatctagcacaaaacgccagtagctcaaggttgagaaatgctgaactagaggtgtgggcttattatcaggatagcatagcactggattcccattagaatccatagtgtcttcatagcactggattcccgttagaacatttcatgcagcctggtgcttcaattacctggcttccctttttgtagcattggcattagaatatagtttagtctgactacagaagggagaaaatacctatgtaacaaaataggtgaactgacagaattttggtaaaagagataaaacatagtagggtgataggtctacacattttaaaagccagtttgcagtcagtgttgaattttatagtttaattgtgcaatttaaactgtttgtttattctccatgagtgtttcacgttatgcctttgtgcctgcttcagtgctgggggacagaccttctaccctcctggttcatgttgcctctgtcttccattcctctttgctggaatgtgtagttgtggtaactgtgacaattcctaaggtttctgacagtttttgaacaccacaatggtgctgtaaattcctgtcttggccaggagatggacaccacattttgatggtttctcaaaccgtgtgtgaccttttcctggtttctctgttctgtcagtcatggcatggctggacagaattcagggacatctatcaggcctctcaggagcaattaaattattttcatgaaggcaatttgcagttgtaaacaatattgaagacactgtgtggcatttctcattagctaaaaaaaaaaaaaaaaagatagtggcaacaatacaggattatctgactcgataattagccaggcatggtggcacacgcctgtaatcccagctactcaggaggctgaggcaggagaattgcttgaacccgggaggtggagtgagccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaataaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaagaagaaaaggctgttagttcaagtcctgactcaccataacattaagaaaaatcaggattcccttataaagaaagtgcaatgtctgaggaaatttcaactgtgaaaactacaacatatttactaacatgcatgaattttcttgtttttagaattattcctggactattcagtagccactcagatgctactgtgtgaaagggccataaatgttgcctgctgcttgaacatctatttttttctcttccagtgcttgataactctgggagataatacactgcagtcatactagtggttaagatatttgggaataaaattaatacttttgactagaaatgtctaaggataaaccaacagaaattgaatctggatacatctttaagatgtaatcagaaatgaccagatgactctagttaaaatttttgaaggagggattacattaatatttcaaaacccttactctgtaagataagtgtagtttaatttttttcccctcgtatacttttatttacctggggaaggagcttttagggttgggggggtggtttgctatctctttagctagcagaatagtgtgcctttgatcctcacacatcctgtattatgaacacagtagccatacttcacggggaggtcagagctggctaccagcagtcttgccctttactgagcttagtgtcatccttggatgctgtcatatgctgctttgagtgaaccagagaaacagccatttgcagcatgagaaagccccaaaagctctgggatttacctccacttcagtaataatgaatattttttagcattagaatgtgttaggtcatttgaattaatttttactacactttggcttgggagaggaattattttaaatagacactggtacttttcgaacttgatagctaaagattctaaaatgcatgttttatactaagttttaaccagtcaggaaaattttatgtaaccagtgatagtttatttttttgtatgaattttgtttaggctacaatgtttagcttttgttaactcctcactcttgctgtcttaagttcattactatgtttaatggcgtacttgccaagatatttagcatgtaaaaagcagggttttgattaaaaaaaaaaaaaaacagcttcatattgaagctgagacttacaataacaagttgagtggcaagcctggtatgctgtgtcttattgccagaatcttagtaaatgtaatgttttaaaagtttattgtctttgtatattaataacaaagtatgacaagttaagtttaaataagagttaaaaaaataagcagagaacttcttctatataagcacgtaaacagtaataccattatttttgtagctgcatgaaataccattgcatgtatatgtaggatatggctataatatacatttcaacagatttgatgacattgggttgttttctcttttgtctacaatgaatttcaaatttagttgcctacttttacacattttttatgttgcgtaaattcttaaaagtagaatttttaggtcacaggatatgagtaactttaatattttttaggattgtcaccttgtccttccaaatgactcttgaactcctactaggcaggggctggattctggaaagagaaacaattgttcttgctcctctttgccaatactgtgctttcctgtcctaggccaatctaaatggtggaaaaaaaaaacaacaacaaaaaaacaaaaaaaacctcatgttgtcatatgcactttcttaatagaaaagttgagcattgtttaatctgtttgtggaacacttatttatatcactctgtgaattgtttgcccttcccttttgttggtttattcatattctttccctatgttagtgagttgttgtcttagttcattttggctactataccaaaataccttagcctgagtaatttgtaaacaacagaaatttattgcttccagttctggagactgggaagtgcaagatcaaggtgctggcagatttggtgtcagggcctgttcctcataggtggcaccttctatgtcttcacatggtagaaggggcaaaaaacctccctcacatcacttttataagggcactaatgctatttaggaggatgcagcccttatgacttaatcaccttccaaagtctccacctcttaatactgtcagcattgggggtaggtttcaacataggaattttgtgggcatataaacattcagactgtagcacttgttcatcttttttttcctggtaaaattagacttttaaattgttttttctattgtttgtcttgcccaaactgttccctcctcgccaccaatgcttatttacaagtaattgatggataatttctatatcaaactagaatgaaatgaattgaccttaaatactaataatgtgttaatttttgaaggactataggaaagtatgtattaacattaaggccattggatttccaaaataaattatctaaagactaggtcctcaatattaatagcatggaaatgtgtgtgtgtgtgtgtgtgtgtgcgcgcgcgcgtgcgcgcgtgcgcacgcccgcgtgcttatgggtatgtgtgtgtgcgtgcatgtttgccctgatatgagaattacttactgtattatacaatagtcattgaatttctgagttttcttggtgtaacagaaagatgatacaataagttgtttggttttatttctatgtgttgggatttgaattctaattttagggtaaaatttctgaattttttctaatccattatattcaagggaaggaggacatataaacttcagtatgttattttgaattggctcatattccatttctactttgtctccatttctagaatggtatccatatgtaaaagtatttaatttttggtatggtttactttctctttaacactcagtttaattaactgagaacaaaattcaccttctgtgctgtgcaacttcagaggtgccaaaatagcaccttatattaaaaaatatcttggaaatatttttgagtgctttgaataaagtttttccagcaacattgatttatattttgttcctcaactcattatgctactttacacctgggttgtgtctgctatggaagggcatcctccatcctcccttttccaactggccaactcctactcatcctcacacatccatcccaggtggcatgtcttcctggaaagcttcacacacacctccagatggagcctaacactctctttcttgcaccagctcagcaccttattcatgcttacatttgggcacttttcttttttttttttgagacggagtctcgctctgtcgcccaggctggagtgcagtggcgggatctcggctcactgcaagctccgcctcatttgggcacttttcatgcttgtattgcatcagcctagacatttgccttttctttggactttgagctcatggacctatgtcaaagaccagtatgtcttattcctttccatgtgcgcagtgcctgccagaaagttggagtgataaattatgagttaaagtttacattatcattagatttaggataaatttgaagttaattcaacagttatttaagttattctgttatcttttgaataacttttgagaaagtaaaaaatggccctggcagctgacaggccacataatgttcccaactgaacataaatacctcttgcagaatataaataatcagacaagcctacttcttgagtatgtctgaaacaagactgagaaaggaccctttccaactacaaaagtaattaaacatccctctcttatgactgacatgaatgattgctgcttctttaccgatgatgactccaactcagctttaatcctctgctttctagattaaatttgccaagataatcagtgaattgtccctacctcctgacagctcccagtccaaacctggcctttagtttcttaaacctttcttggaatcacccaaaacaaactgaaatagtatcctaagtatccaccagtttcttaaaattctccagttactttggtgtactctttcttgctgtcgtaagtgaatgaaagctcaatttatttactacaagagtgttcctggtggtctttgattagtgggcactagagtgagtgttggagtaatttaagaaagaaacatttatctcagtctctgccctttggatacttagagtttgcctggggattctggccctacttgctttaaataaacctttaaagtggcattgtttgctgtcaagactagagtagaggagaagagtgcaagtcacagctaaggaaaatattccttaagtattgataatttctagtgtggatctcaaagggctggggcattctgtgtgggaaaggctgagagctggggagaatcattatgtgttacaggaagagaggagactattttttgaaagggaaagtatttgaagacttggtggccaataaggttggacaggtagaggagatcggtgacagccggtgaccttgtgagaactcatctacagacagtgaaaatcccggggttcggggtggacacaggagataattagtaggaaggggttaaaatactgaaagatgagtatagtaggtcgtatttgatgacaggaggatcagagagtcttttttgaaagatgagtcagcaggacatggtaacttgataagagcaaggaattgggtggtgggctgctgtagcagatgcttttgatatggtcttggcccacctgtgagttcacccacagtggacatctcccatgcatgccaacagctttccatctcaagggcctgatctgtgcttctctaccggagcacattgtcagccctgtggaaatttactcttgctgcagagcagcctcgaagtataacctttactcagtgaagggctggagtcagaacacaaatgcccattttccccttctcttcgtgggacaattctgaagcacattatttatgtcttttcagaacatcctagggacattgacccccagcaggaatgtggcataccacccccttccatggtttttctctctccccagtcaggctttcctcacttcctaacttatgctccctgggatcacctccccagttcactatgccagactaaccaacccaagttcttatctcaaggtgacttttgggggaacccaaactaagatgggtatcttggataattgggttaattattatgccatggaaaaatggaattgggattctttcccaggttaattaatgactgctgtctagtgaaaaaatgactacagtcatctcaagtgtattttatatatcagtgcaggaatatggcaaaatgctttagaattcgtggcttgttttgaggaaaaaaaatatgctccaaaccatctgcaaaagtattacagtgatctcaagtggaacataggcacttgaagcagtttccaggcacattagattgttgtcaacaagaagaaaaatatatgccatggggaggagcaagaagaaagagagggtctagaaatccatgattttagcaagtcaggaaaaataattttcagcacgtaagcagggcaggatccctgagctccttcacctggaagtcatccaggtggtttaagattctcaggctattggcaactatgatgtggctcctgccaggttaaggagcattgatgattgatcacaagggaaaggacccagccatatgattgtttctgtcagcttgtactctcctgaaagtcatggttaatgacttgagccaagttaggaaaaatatttccgttactaacaatatagttgttaagtatgctccatggggattctgaaatatttacttgacagtaatgagctttagaatttcattcttttcctatgattcttcatgatcacatttgcatccagatctttgaacactcagcacttgatggagtttaatagactaatggcaagaaaattgctcataagtaaaggaagcagtgaatccatccggtttccatgagcagtcatacctgagttcttcagcaattggaacagatgcgtcactgaaaagatgcctgcactggggtggtcctatccattacattctcttaggaaatgaagccctggctttccttagccctgtgatctattttgaaccttattctagcggagaaggaatagtgtttattgattttttttctcctgttgtctattatttagagattcttaattctactaaaataagttgggagaacacatattgtttgtttagtatttaataaattttggagaatccatataatcactttacagtattctcatcaatcacatgaattaagtaataaaataataaaacatttgaattcttaggaacatgtattttttaatcagaaaatattcacctccgtggttagcaaacctcatatacaggaaaataaaattaggccatgatcacgttagttatctctgagagagcacttttagaaataataatctagaggacaatgatcagaaaaggaagaagtagcaactaatacttaaggatacctacctatgaaagaagatggtaatagatagggtagtttcttggtgcatcagtgggttgaggtgaaataagtttattttatagttttgtttttgtttcctttaagaataaaggaagcttatttgagtgagcttctagactgaggaagtgtagattgacaatagaggaaattagagggtggtgtttaacctggagcgaccccttgcaggggtagatttaaggtaacaggtgttaaggctgtggttaactagttttgggcttgttcacctcactttgtgaattcttccactgacactttgctcattttattgaaataactgatttcaatttctggtttctagtcttcagttctgctaggtatggtctcagacttaatgatgaaaactgttgattctgccagacacatgcccaataaaatgcttagcttttagcagatcctcaataaatatttattaaaactaatttgaacatattttcctgagtttgggaagaagggagtgagacaaataaaaattataatgtatttgatgtaaactggagaaaattcagtgtaaattccctctactttcctcagtctgtttggagataaagtcatctcctgggagaataaggggatggattagagactcgaagacactggggagtgttcagaacagctgcttatggaaaatgcatggaaaaaaattaaaaacttgccaagatgaactgaatatccagctgaggctgcatggtatgaacttgttgagtttcttaggatagttctatgcctttttctagttctttggtcactcaaaagtggagaaagcagagaggggttatctttggtgagacgggtatggcagaaagcctgaggactggggattttggagtgtttgataaaaagatgaaatgttcagctgaaggttgtgatggcacagagagaatttcaagccagcaggaaggctagagagggcaggggctggagtcataataagctagaaaacttattatgtgttctctagcttgttgcctgtggggttgaggacattcaagattgtgttggtaggaggctgtagccacagaaggaatgatagcttaaaaatcttaagaggttgagtggtctggattgtgataaagtgcaatttacagctgggcttatgggttgctaatgtgtaattactctcacaatttggcaattctcagcatctttaggagtgttgtctagcaaaattaaattagattctttaaacaagcaaaaagaaacttgttaatgaattacaaccaagtaagatggaaacagttagtgtcaacatgatgagtttgtgagattctatgtgactttaagactttgagcagccaagctaatgttcagttcaaagtaattgaatttcatgtatggaagaatgccttatgaaacagccgatcagtgcttttgctagccagttttgaaatgttacatgtccaaacacctcataacttatgcatgttctccagtgagaattacatcataggttgaaagaaaataaatgcatccatgattcttagatgttacataatctaagcacttaataacttcctagttacataatctgtagttattatataatctcatggctctttacaaagggggaaatcaaactattctcagagaaattcaattggatgattggatgaaagaactctgtgtctgtgtgtgtgtgtatatgtgtgtatgtgtgtgtgtgtgtaattttgcacatatacaaatacttaagtgctggttagaattgatctgaccctctccctgactgcttttcccagcccactccaatgaacaactgggtcatctttcagctccagaacattaaaagttgtgacctgtgccatcccaggactatgtacaggattccttggagtcataaggaatgttcttcattcttccagccatttcactctgttcctggcttttggctctgccccagtagttatgcttagccctacttgccctgtcagcagctcctgaaccagttgcaggttcagttggtgacttcaagatggggacactggcttacagactggcagtcaccagaacacatctgtccagagccccggttgccccggtcctgttgaaacaggcgctgcaccttcaggtctctattttccttgcacctccgattactcatcatggtggagtctgggtaagaaggaagttgaagagatgaaagcagatagagttcctgaggatctcattgccagtcgtggctgtctattccctcccttggcagcccagtgtctcatttgaggttagacacctgtctggtgcagatgtaaactgatatacctacctccccatttgcagcaggaatctggagtctcctatggcaattttgtgggggttgattttgggagacttttatctagacatttctgccttgtttaacgtgtggcttactttcctgttctgtgcatgttattatgtattactggcataataacatgcacagaatgcatgttatttccttttggagcacattgttgcaaatatcgatcatgcaagacatgtacatttgtggcagactcttaaatgtgtaaggatgcagtgaggttttacttagcctgatcgttccatctgtgacttccacttccttgccgtccctgccctactacaattcccaactgcagactctgcccagatgtaattcagcaaacattttaaaataccaaattttctctctacctctgtcttgactgtggtcctcattgtgcttctttcaagtatggatcatctagtctccatccttgtttgtgaagttgtcctgtccttcacatatttttaagaggggagaggagcaacgcggaactgtatttcaccgctagagtgaacataccatatcagaaggcagaaatgtgtatttttgtaattacacagcatgtgtttttgtctgtgggtttgcttattttgcaaacaaatccacatggtttacttgctagtcttcttgaatttttcagatggtgagcctgtggatcctcatctcatccaagatgacttcctggccacctcaggccatgttaaacaacctggaatgctagtattactaccagcagtgtctgagggagacatcccagaggctgatggttttctagaatcatgttttcagggaaaagggaataatttttttatgatgaagtaagttcttaaaaaattgccttattcttttggttaatgtttcttaacagctttgtggggaatggttgcacactttataaagtttcctttacaattggggaacttggagaccaactttaatgttgattgttaaggctatttcacttataaaatttagctagctgttaaaaaatttctctgctgtatttcttatatccacaagggattagaatctattgcttttgcaatgtaattttaattagactgcaaattcaatcatctgactaactcttcccttgtcatttaaaattgtttgcaagcttgaatgggaaaagttaaaaatgagaccagataagcatgtgcattttcattcagataagactacccacaatggatttaatcatttaaccagttttaataataataataatagtgaaaattacataatttattgaacactcacctagtcagctgttggattttacatgtcttataatttatctcattcttctgaatagctattcaatgagatgagcatcgcatctcaaagtcgagaacaggcttagagaagttaaaggaacttcatatgtttccattaacttgtaggttctttggctgggatttgcacctacagttcatccatctgggcaacccatcatcttcacagtgcttagagcttctagaataggaccctggcactgccgttgtatactcaagtatcacatgtatatttttaagcactttaattgttaagtctttctgatttcaacaggtaatgttgctattatatgtcatgcacaaataggagacagctgttaggcctccatccatcctgtgtctgttacttacatactgaaaagaaatcagctggttgtgttttatttgggagtgactggaattgatctgtgcccatttttgtgtgtgatcatcttaaaaatatatctgttactatggaatgttctgcagtcacttcttaaggttgaatacacagttgatgggaaatatcttttaatctacatacaaaggaggaagtttaccacagtgaaattcagacgtatagactgttgttgtacaaaatggaactttttcctcctagaatttggcagacttttgagtccaggaggaggaggggtatataggtggatggaagattgaggaaacatgaagttgctttagaaatgtaaggagttgattaaaaagtaagtatagatgcttattttacagagctttgtaactttgtctcactaatgttaacattggcctttaaaaaatgatagaatttagtgttgctcttttctttacaaagaaaactataccatagaaaatggaattttctaggggacagtaagaaaataatatatatatgatttaaattctttattttattcatttaattctctttgagaaaacttagtgcatatgtatccaaagtctgtaaccagattgttaagttaaaaaatggttttcaggctgcgcacaatggctcatgcctatagtcccagtactttgggaggctgaggtgggcagatcacttgagcccaggagttcgagaccagcctgtgtaccatggtgcaaccccatttctactaaaaatatagaaattagcagagtgtggtagtgtgtgcctgcagtcccagctacttgggaggctgaggcaggggaatcacttaagctcgggagactgaggctacagtgagccaagatcatgccactgttctccagcctgggtaacagagcaagatgctgtctcaacaacaaaaaaaaggtggggtggggtgggggcggttcatacttaagaattacaaaaggatttctggcaaagttgtactaaaaaatagatttctttttgtattgaaaatataatctttagaaactggatttatattcctttagcagcaaacctgattaatgtcagttaatagcttcttcttaatcaagtacagacataccttggagacactgcaggtttagttccagactacctcaataaagcaaatacctcattaaagtgagtcacacacatttttagtttaccaatgcatataaaagatatgtttacattacatggtagttgattaagtgtgcaatagcattgtgtctttaaaaaatgtacatactttaattaaaaaaccttttttgctaaaaaatgctagtgatcatctgagctttcagtgagtcttaatctttttgctggtggagggtcttacctcagtgttgatggctactgattgatcagaatgatggttgctgaaggttaggatggctgtggcaatttcttacgaaagtcaacaatgaagtttgccccatcaatggactcttccttccatgaaagatttctctgtagcatgtgatgctgtctaatagcattttattcagagtagaacttcttttacaattgtcatcaatcctctgaaactctgccactgctttatcaactaagtttatatagtattatacatttttggttttcatttcaacaatctttgtagcatcttcatcagaagacaaagaacccatgttctttgcttatccattagaagcaatgtctcatccactcaagttttatcctgagattgcagaaattcatttatatctttaggcttaacttctaattacagttctcttgctgttttcaccaccactgcagctactctctttactgaagtcttgaaccccctcaaagtcatccatgagagttgaaatcaacttcttccaaactcccgttataattgctattttgacctcctcctatgaatcatgaatgatacatagaataatacatcctttccagaggttttcaatttactttgccgcaatccatcagaggaataactgtgtcagctatagtcttacaaaatgtatttcttaaataataataataataatacttgaaagtcataattactcctctatccatggggtacagaaggaatattgtgttagcaggcgtaaaaacattaatctttttgtacatcttcatcagacctcttttgtgaccaggtgcattgtcaatgagcagtaatattttgttttttattttaatattaaaaaaaggaatcttttttttctgagcagtaagtctcaacagtgggcttaaaatattcagcaaatcatactgcaaacacatgtgctgtcatccagactttgttacatttatagagaacaggcagagtagatttagcataattcttgaggattctgggattttgggaatggtaaatgatcattggcttcgacttgtagtcaccagctgcattatcccctgtcaagagcatcagtctgtctttgaaagctttgaaggcagacactgacttctcctttctagctaggaaagttctagatgacacctttttttccaacagaaggctgttttgtctacgttgaaaatttgttgttcagtgtagtcaccttcatcaattttcatagctagatcttctggataacttgctacagcttctacatcagcacttgctgcttcaccttgcattttaaaattatggagatggcatcttttcttaaactttatgaacctgtcagtcttagcctccaacttttcttctttagcttccttacctctctcagcctttagaaaattgaagagagttagggctttgctctggattaggctttgttgtggcttcttacattttctattcagatcactaaaactttcttcatatcagcaataaggcttgtgtttgttcccacacagctttaaagaaatacctgagactgggtaatttataaagaaaagaggtttaattggctcatgattccacaggttttacagaaggtatggtggcatctccttctggggaggcctcagggagcttttactcatggtgaaggccaagtggtagcagccatcttacatgacagaagcaggatgaagagagtgaaagaggcagaggtgctacacacttttaaacaaccacatctcgcaagaattcactcactattgtgacgacagtaccaagggggacgctgttaaatcatccatgaagaatccacccaatggtccagttgcctcccaccaggccccacctccaacattggagattacaattcaacatgaggttttgtgaggacacagatttaaaccatatctttctcccctgaccccacagatctcatatccttctcacattgcaaaatacaatcatgccttcccaacagtcccccaagtcttaactcattcagcattaactaagatgtccaaagtctcaggtctcatttgagacaaggcaagtcccttctgcccatgagcctgtaaaatcaaaaacaagttagttacttccaagatacaatgaaggtataggcattaggtaaaatactccagttccaaaaggtagaaaacagcaaaaaagggggttacaggcactatgcaagtcagaaacccagcaggacagtcattaaatcttaaagctccaaacaaaataatctcctttgacttcatgtcccacatccagggcacactggcatgagaggtgagctcccaaggtcttggggagctctactcctgtggccttgtggggtttagcccctgtggctactgtcatgggctggcattgagtgcctgtggcttttccagtgcagggtgcaagttgccagtggtttacccttccaaggtttggaggacagtggccttctactcacagctccactaggcagtgccccagttgggactctgtgtgggagccccaaccccacatttctcctccacactaccctattagaggttctcagtgagggctctgcccctgtagcaggcttctgcttggacatctaggctttttcatatatcctctaaaatctaggcagaggctcccaagcctcagtctttctttctgtgtccctgtgatcttaacacagtgtagaaaccaccaatgcttctagcctgcaccttctgaagcagagtcctgagtggtacctttgctcttttgagtcagggctgcagctggggcaacagggatactgggagcagtgttctaaggctgtgcggggttgcagggcccttggcctggcccaggaaaccattcagcccccctaggcctccctgcctatgatgggagattatgcaaattcctgcagcctgcttgaattcctcctttgaaaatgggcttttcttttctaacacagaagcaggctgcaaatttttccaaacttttatgttgtgcttcccttttaaataagagtaccagtttcagataacatctttgctcatgcatatgagcatatgttattagaagcagtcaggctatatacttgaatgttttgctgcttagaaactttttttaccagatactctaaatcatctctcacaagtttaaagttccacagatccctagagcaggagaacaaccaggcaagctttttgctaaagcataacaaaagtgactgctggagttcccaaaaagttcctcatctccgtctgagacctcctcagcccggacttcactgtctatgtcactaccagcgttttagttacaaccactcaataagtctctaggaagttccaaacttcccttcatcttccccctcatcttcctgtcttcttctgagccccccatactctttgaacctcttcctattacccagttccaatgttgcttccacattttcaggtatctttgtattaataccccactcctggtagcagttttctgtattagtctgttcttgcactgttataataaaaaaatacatgaaactgagtaattattaaagaaaagaggcttaattgtcttgtggttgacaggctgtgtaggaagcttggcagcatctgcctctggggaggcctcaggaagcttgtactcatggcggaaggcaaagtgggagcaggtgtcttacatgggaggagcaggacaaggggagagagagagagagagagagagagggagggagtgggggagagatgctacacacttttaaacaatcagatctctcaaaaactcactcattgttgtcatgacagtaccaagagggatggtgttaaaccgttcatgaaggatccacctgaatgatccaatcacctcccaccaggccttacctccaacattggagattacaattcaaaatgagattttgtgggaacacagatccaaatcatatcaaggctatttctctttcttatcatttgtgcgttcactggagtggcacttttcatttccttcaagaacttttcatttgcattcataacttggccaactgtttggtttaagaggcttagcttttggcctgttttggctttcaacatgccttgtttactaagcttaatcatttctagcttttcatttaatgtgagaggtgtgtgaatcttccttctgcttgaacatttagaagccattgtagggttattaattgtcctaattttagtattgttctttcttagggaataaggaggcccaaggcggcgggtggggatggggagagagagagagagagagaaagaaggagaagagaggaaagagagaggagaagaggagagagagagagaaagaagaggaagaggagtgtatgtgtgtgtgtgtgtgtgtgtgtatgtatatatatatatatatatatatatatatatatatatatatatatatatatatatatatatactggtcagtggagcaatcagaacacatacatcatttgtcagttaagtttgccttctcagccaggcacattggctcacacctgtaatcccagaactctgggaggctgaggcaggaggattctttgagcccaggagtttgagaccagcctgggcaacatggtgaaaccctgtctctacaaaaaatatgaaaattagccgtgtgtagtgatgcacatctgtagtcccaactacttgggagcctgaggtgggaggattgcttgagcccaggaggtcgaggctgcagtgagctgtattttgcaccactgcattccagcctgtgcaacagagtgagaccttgcctcacacacacacacaaaattgctgtcttatgtggtttggtttgtgatgctccgaaacaatttacaatagtaacatcttctgatcacagatcaccataacaaatataataataatggaaaagtttgaaatattgcaggaattaccaaaacatgacacagaaacacaaagtgagcacattgcttttggaaaaatggcactgacagacttgcttgatgcacgatttccacaaaccttaaatttgtttaaaaaaaaagcccccaaacaaaaaatacagtatctataaagcataataaagcaaagcacaataaaatgaggtatgcttgtaatatttatcactgttactgtgtagggagattaaacatgattgtagctaataaaacatgattttgtaaacacctgtaactctaatttccatgaatctctaaaaatagaactttgtgaaacaatcactagcccttgaggcaatacctagtgcatagtaggtgttcaaaactttttgtgagtgagtgaatgaataatgaatggaagcgtttgtgattatgtgagctttaacatgtcctttcactgccaatgcaatttcttgtgattctaatctgtaaaaaaagtattcctctcttactattccctgttgccttacttgggtatacttagctttatgctcagagaacacacttgcttaaaactagagtaataatcacaggtacaatgtccccaatacatttctgtggaaatttttgtaatctgggttgcattggtagtaaccaagtttcatctagggtagctacagcacctcagatactctccttcaccagtgccatctgctcaagcctgtttctatggtttgctgttgatgcagctgttggagctactctcttggtcacttgcttacccggcttctgagattcctctaaaaatcaatcacatggctaattggctgctgctgttgatcagggccagttggcctagcatcataaatgcattgctggttggcattgatagtcttggaagtggttttctttctgatataagtctctttcactctagtataggatagtagttaggagcatggtgtcttgatgcagaactatgaatgttgtcctgggtcagccagttactagttgtaatttgaaattatgggcaagttattgtacctcactgtaaacatctcagatttctaatctgttaaatggaaagacaagtagtagccacctcttaagggatttgtattgatctctgccctaggtagtgtaacatacacttccatctgtgggaaaagtctgtgactgttgtcactaacctgcacagggatctgggcaaaaatgaggaagactttaacacaaagctgggactgtgtttaagatctgccaccctgcctctgattatcttcacctagtggagggtgagcaccccctctctgtgacttgccgacttggcaaggattttaggtcactgtttctacccagatgccagtatccaattaaactcttgagagtctgtgatcattatgataaaaatgttcattctggaaaagtttgaaaatgctttctggttagaatgagatttttggcatgttttaattgtggtctttggctataaattcctgaaatgctgacatggttgaatttatttttgctttaaacaaaatcgttaacatttccaagtgtccatatgagctcgataaatactttgcctctgcttactgcgtatgtgaaccgagtgaagaggagccatcatgatgtggggaatcttgaacatttttcttcatttagcttgatggggaagtgaattgaaaatacttctttgtcaacataattttggggttttgaaattgtgtttgggttttcaggaaattggtggtaatcttgtattagctgaaaaaaagtgaattttaaaattctcagtgaagaagcaaatgatttatttttcatagaagaagctgcttttttcaagggaatttgctgccaagctgtctgcagtggcttcagacattacttgaccttttggcatatcaagaaattgtggttttttggtctaaatattaaatacctattttaggaaggctgggtactctatggtatatagtgcaagagcagcagaaagagtcagccttgtgcatttccacatctgcaagcaaatttggtttctgtactgtccatcaagcagatcttacagaatgaattttcatcccctcactagttgccatgcaaattctattaatagttctccaagaaataaatcacagtgacccttctgacaaaggtagacagtgaaaaatagtacaaggatatagtacatccacccttaaccagaagcaaattgtgttttccctttttatactacaaaaagagaaaacaatttacaaaaacagtttcttccacacatgtgttatctatgatgtgatagactgttcttttcatagcccttttctgttttggtgactgcaacggggtattatttggaacatgtagtcttctgtttggacaccatactcgggctgtttttcttctcgcagcctgtgctgctggaaatattcccccgtctcatagccatcataagtaaaggacaccttccactgcgacatgctgcatgctgttaaagcccttcgatgccagccaaatgttacaccgtgccttccaggatatctttaattaaacccttatatatgcatttataaccatctgatgaggggattaatattacttgtgcttaacaaatgtgttaattgagaaaggaaaaagaatacaaaataaacatttttaagtaccttccctatcgtagtcactgggctaagttcacagccaccttgccaggcagaagttaccatccccatttatgattgggaactgaaacttgaggcacttttgggaaactcttcaactgattattcgatcgtgtgaaactgaagcccatgtgcaacatcagctgcctccctgagtttcacagtgaaatgtgaaatatttaagatcctcagtgaatattgttgaatgtgaaagatatttactaaattgtaatcagtttctcaaactatgttctttatactacaaggtaactggattaaaatggactttccataggtacctcattcttagctcgaccccaaataaacttgggatctcctcctaaaattgtccccacttcagtgttcccatctcacatgctccagccagaattgcaggagtttcccttgagccccatttccctttctctttccatgttttatcaggcaaaaaagtatcacgattacctacgaagcatcactgccaattgcaggggtgcctgagagagcagcaggacagagcccagtgcagccccacaattcagacctgacacctgtggaaggagatgtgtgtattggggcaggggatgaaatggagcaagatggggacaggagagcttcagactgtgatgcagatcagttctatgtggtcaataagtaaatctgcatattatcattatattacaatacactagccactggagatgcagtgggatataccaccttatgtaatgataataagggacacccaacaaatagctgatgactcactaaaatgagcagtacaaattttattttgtttatcaaatgtttcttctctcagaaaaaacaacatatgtagaattttgtgattaaatttgatgcttgttttaattactaccacatttaatatagtgtgctgtttttccttgcacttagtctttttgtgaaaaatcaagtaccaaatatctaaggtgagtcatcagaggtaaaaagattggtccttctggagtacttgtgaccgactcatttcatgagatttaagaaacactgtaatgccgtctttccattgggtatctccatgatttattgatatgtttttagaaaatgaaaacaagtaaacaaattttaaagttatccccactcttattgaagaaagtctgtgtataaaaatacatatgtatttaaaagtagttaaagtcattgtatgttatcaaattcttgtattaccagaagacttactaaagaacagtagtctttgtgattacctaatactggatggagaggtgagctgagtagtgctaggggaatctaaatctaaattatttgtcgtattcagccaggatgagaaacgttgatttgattgaacaaataaagaaaatagaactaattttattttattttattttatttttttgtctggggcatagaaattttattttcacaaaagtatgctttattacactagaatatttaaaaatgaaatactatatatgtcaacatttgaaaaaaaattttttttgagacagtcatttaatatcatctttattttgtactttctgtgattttttaaaattatactttaagttttagggtacatgtgtacaacgtgcaggtttgttacatatatatacacatgtgccatgttggtgtgctgcacccattaactcgtcatttaacattaggtatatctcccaatgctatccctctcccttccccccaccgcacaacagtccctggtgtgtgatattccccttcctgtgtccatgtgttctcattgttcaatccccacctatgagtgagaacatgcggtgtttggttttttgtccttgcgatagtttgctgagaatgatggtttccagcttcatccatgtccctgcaaagcacatgaactcatccttctttatggctgcatagtattccatggtgtatatgtgcaacattttcttaattcagtctatcattgatggacatttgggttggttccaagtcttcgctattgtgaatagtgccacaataaacataggtgtgcatgtgtctttatagcagcatgatttatattcctttgggtatatacccagcaatgggatggctgggtcaaatggtatttctagttctagatccctgaggaatcgccacactgtcttccacaatggtcgaactagtttacagtaccaccaatggtgctatttctccacatcctccccagcacctgttgtttcctgactttttaatgatcaccattctaactggtgtaaggtggtatctcattttggttttgatttgcatttctctgatggacagtgatgatgagcattttttcatgtgtcttttggctgcataaatgtcttcttttgagaagtgtctgttcatatccttcgcccacttgttggtggggttgtttgattttttcttgtaaattggtttgagttcattgtagattctggatattagccctttgtcagatgagtagattgcgaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgaccatgcctgtgtcctgaatggtattgcctaggttttcttctagggtttttatggttttaggtctaacaattaagtctttaatccatcttgaattgatttttgtataagatgtaaggaagggatccagtttcagctttctccataaggctagccagttttcccagcaccatttattaaatagggaacctttccccatttcttgtttttgtcagatttgtcaaagatcagatagttgtagatatgcggcattgtttctgagggctctgttctgttccattggtctatatctctgtgttggtgccagtaccatgctgttttggttactgtagccttgtagtgtagtttgaagccaggtagcatgatgcctccagctttgttcttttggcttaggattgacttggcaatgcaggctcttttttggttccatatgaactttaaagtagttttttccaattctgtgaagaaagtcattggtagcttgatggggatggcattgaatctataaattacctggggcagtatggccattttcacgatattgattcttcctacccatgagcatggaatgttcttccatttgtttgtatcctctttgatttcattgagcagtggtttgtagttctccttgaagaggtccttcacatctcttgtaagttggattcctaggtattttattctctttgaagcaattgtgaatgggagttcactcatgatttggctctctgtctgttattggtgtataagaatgcttgtgatttttgcacattgattttgtatcctgagactttgctgaatttgcttatcagcttaaggagatttggggctgagacagtggggttttctagatatataatcatgtcatctgcaaacagggacaatttgacttcctcttttcctaattgaataccctttatttccttctcttgcctaattgccctggccagaacttccaacactatgttgaatgggagtggtgagagagggcatccctgtcttgtgccagttttcaaagggaatgcttccagttttccattcaatatgatattggctgtgggtttgtcatagatagctcttattattttgagatgcgtcccatcaatacctaatttattgagagtttttatcatgaagggctgttgtattttgtcaaaggccttttctgcgtctattgagataatcatatggtttttgtctttggttctgtttatatgctggattacatttattgatttgtgtatgttgaaccagccttgcatcccagggatgaagccaacttgatcatggtggataagctttttgatgtgctgctgtattcggtttgccagtattttcttgaggatttttgcatcgatggagctgattttataaaactttagtttaattttttttttactttccttccagatctaatttctctccaacaattcttacatggaagtataatatttttctcctcatttgttcttgagctattatagataaattttaactgaacacttttgttgttagaaccgatctaacttgggtttactgttttgtcaaattaaaaatcaaaatctatatatagatatatgtacacatatcccttcctctagaaaattggtagtttttccctctgttaggaaataaaaaatattttaataatatcacttatcagtttgggaaattagtatataaatcttagatgaatggcttatatctccactggtcaaagaaggttgcccctttgaatttgacagttggaacaagtctttatttactctatagagaagtcatctaatctgtttagctttttggtaatagactttagcttatagaatatatacatgaccttgtgggtcagattgtctgtatttgagtccttgcttgatgatgtctagctgggtttacttaatctttttgatcagtttccttatatgtaaaacaagaataatggttcctacttcataggatggctgtgggatttaaatgcaggaacctgcaggaagtgcctggagtagtcctggcactaggctcccagggaatggtagctattactatgaccagtgcatggaaataacgtgtgtttttatttcccaaattcaaagttaatttttgaaatgaaggtttatttccctgttgaattctaaaagatttgcacatgtataaagaaaagacgattataatttagaaattatattttggaaacttatcagagtcttaaggttttgtgctgttccctgaaactcctttgacatttaaaagttgtcaagacaccatcaggtatttcaaaatgagatcagctctgattcatttggataaatcaaatgatttataaagtttatttgattgtgttggggcttttgtttccatatttccctggatcttatttgatgggtgtatatatgtgtgtgtgtttagtcaagagtcattatggagtggcttggatttgggtgaaaagaaaaaaaacctctttggaaattaataatttctacatcactgtttaaatcttttaactcttattcccaagttttaacagctccttaggacagagtttaaaacaaagtgtcatgggagtccacatgaggagtgactaactcattctggaagacctcctagaagaagtgacatttgagttggccttgaaggatgaattgttcgccagatggagaaagggatgggtgtggggtggctttggccgaccaaaggcgtgacacgtgaatggtgtggctttggcagaccaaaggggtgacacgtgaaaaggcagagctctgaaagcccacatatttcattaaccgtgggaaattaggtgcctggactgtgagagattacaatgtgaacgctgtccctggaaccgtgaaagagtggtttcaaatggtgaggagcatggtcaagagactggaaatggatttgggaccaaattgagacgggcctgtgtcctaaggaatttgttctttacatagaaggcagtgctcacatttgtattttagatttctgggtggagaatcacctgaagagggcagacgagttgttggaaggtgttgaccgtaatacagatgagagatgaactgttgtaatggaaatggcaacccaaggagattaggagcaagatatttaggcaatagaattgatttgcagaaggagaagggatttgaattaatttttatggattatatatgatcaatgtgagctttaaccttgtaacagccccatgaaagaagttagtattttgtgactgattttttcgggggaagaaatattaatacatttctcaaataaggatactgtagtccaagaagtttgggaaacagtagattaaacagagtgagatcatttttgctctatttatattatttctcataacctttaatttggcaatatgtttggcgaattcccaagagagcaatatagaatgacagaaatacatctcaaaaactatttgttagttgaagcttacttttttattttaaaaaatttcttataagactcatgttgagagaggtcttatatctttgcattacaaacgggaaactgagaataagattgagtatcttgtccaaggattgtgtacctagtaagaatccctttatatttaaacccatgccttttatttttcatgatattgtagttctgttgaaattgttggatttagggtttgagcctaggagacgagacgagtcaagactgacttagaggctttagtttgagtgaccatggctgctggcactttgaaccagcaataggaaacttgaataccgaagcagttttggttttgttttgtacatgtaggaatggaatggataatcatttaagccttggacttgttggatttaagatacttggtggagatgcctcgtaggcagttggaatatcaaaaaatgaaaggtatacttttggacttgacacaactataactttttctgttataaaattggccattaaagtttggatgttcaattttattatgacttcatttataagttgatgtctgaaactgccaaagtaggcagtttgaaaacttgtttttttcctaagtgcaagtattacttcacacccaagtgtcatgtttcattttacttgtgtatgttttgtcagaaagctgtctgaagaagtctttaaagggaaaatatttctactcattttcttttcagagaagtatactgtctagctcttacggcatattttaaggatttcttgacattaacaactgtccatgtgaatgaattattatatctcagtggtattctcaagagttagtcacttctgccatgaggtcatgtgtatgctttaattttttttttttttttttttttttgagatggaatctcactctgttgcccaggctggagtgcagtggcacaatctcagctcactgtaacctcttcctcttggggtcaagcagctctcctgccccagcctcccaagtagctgggattacaggtgcccatcaccatgcctgggtaatttttgtatttttagtagagatggcgtttcaccatattggccagtctggtcttgaactcctgacctcaagtgatctgcccacctcagcctcccaaagtgctgggattacaggagtgagccactgttcccagccaaaattctctggtctaactgtgtgtcaacagctttggcttgatgtgcttaaaggtttctactttaatattcttaaatattgattgattgaagctgatattccttaattttctaccattccattatcattattgtcattcaggttactagagaactagctattagattcagagccattgcccacaccttaaatgatcaatagtatcctggagaagtgatgcagacacctgaatactttggtaggcatgaagtaaatgtcaagcaatgtgaataaaatagttaatgtaaattcataagtcatttttgccaggtggcaattgaacctggttttatagattatttactccttgtaggatgatggctcaaaaggcattcgggtggtggtggttgttcgggaaagtcagatatttagcttatttacagaatgacaagcagacatatttggctggaatgcagaattcatggaattgtatatttggacgttggcttaaaattaagtggcttggggccaaattgtggaggactttgtgatatctgatttcttaagaaaatactatctccaggtctctcatcaataccagtctggctgtcacttttctgtggactagtttatcttgtaggccaatgaaacttgagctatagaatggcacacacatgcatccaacaaaatgggaccagggcctcttcccctctctctaaatttttatttctctaccaccatttgctgggatttttttttttttttggatattttgatagtgagctttaggtaagtttaaaggaaaagatgaagttagttgaatttcccttaaaataccagcagaaataaagcaaggagacagcagctgtgaaaacatacaccaaacatctcagttatggtcttatcatgctagcttcagtgcaggctcacagtgtgtgcttctgtttccatggttacctgctaggcagcagaatcccccaggttggtatgctatagagtcaggatttttcatggaaaggaaattcaagtcttttcagagtgaagttaatagttttcttttctttttttttttttttaaagcagatgggttatacatgttttaaaaataaaaatggttactgcaggtttgatttccaaactgtaagtgaagccagactttaaggcagtgttttaatggtttggaaattctagttttcaaatggtttctcctagatggttcccgtgacaacacaacttaagcaggtatcgagtatcatctttgctgtgaaatattcatgccacaaaaattcctttcatttttaattccacgctaatgaactaaggcagaagaagttagcttattcaaggacaaatggacaaatatttcaaaatcattgttgagcttaataaaattgcaattctaagtgagcttttaaaaaattgaatgatgatatcatactttattatattcttaaattgatgttttgttcccttgaaacaagtattatttcaattgctacctggaaaaaatagtattgttttatgatagaaaaatttgaatttcatagttgtagcagaagattgctgttttaataatgcctgttttgtagtgtagttaaaaagctctctcagtgttttggcatatatctttccccactcaatttttcttccaaagaaaaattttattgttaagctaatacttgataaagccattcatttgttaaaagatatgattttttttaaaaaaatagctttcatgcatgcattttaaaactttgttaaaaaattagaatgaggtgccatttaaagaataagcttctaattcattaataaaaattcattaatattttttaattttaaaaagaataattttttcaaaagtgacaattattctttatttgttgtttaatattttattttattagccattgaagaggaagcataaaatcttacattccatgatgaaacttttatgatttgacatctttatccttatcttgagatttgctgatgagaccccctttatcaaattcagatgtctctctctgatattcagtacaatatctgcctctggaccagggttcaaggaaaaggatggatacaggaggtcattgtgaagatactgggtaatagagaacatctggaggtgatcagagatagccttataggaactgaaccatagaaaggaagttcattacagcaaatggatgaagttgatggtccagaagaaatgagaaagattgacccatgttgagagttcttataagagtgtttttatttgggctacttctgcagattcagtcaggccttaaattagattttctatctcctgttatgaccctgttctgctacattcacattcttgattaaatgttatagtaaataactttatttcctttaaccacatgatgactctaatcttctaaagactttccatcacaaaacttcaacttttaaccacaggttatggctgtccataaagtatttttcagtaattttcagtctttcacatcataaagtcctggcttaggggattgggctctggaacttgactaactgggttgaatgctggttccgccacttattggctctgtgacattggacaagttaataacttgtcacagtatcttcaactgtgagatgggaatgataataataatccctcacaggattatgcaggaattaatatatcagaaatatctagtgttagttttctattgctctaacaactgaccacaaacttagctggcttaatacagacacaaatttattatcctatatttttgtaggtcagaattccagcagtcatatcactgggctaaagtcaacgtgaaagcagaaccatgttcccttctggagactgagaatttgtttccttgcctttccagctctaagagccccccaccgccccccccccacatttttttctgatggctccattcctctgttttcaaagccttttcttctgtagtcacatctctctctgcttcttctgcctccctcttccacctttaaggagccttatgattacattagggccacagataacaattagataactttttattttgagatcagctaactttttattttgagatcagctgattagcaaccttaattaccttttgccgtgtagcctaacacaggatttaagggttaggatgtggagatctttgggggatcattgttctgtctgatttgtgtttttacctcatgctatcctattatagggtagatatttgtatatttctgcaattctaatattctatctattttggagcatatatattaccacaggcagatgagagaggttgaaggaagggagaagtaggaagaattatgtcctggtattattttttgcagccacaaagaagtaatttatttgtcatatttttgtagcaatccaaattggccttcccatttggttagtgcctctgaagtttgctaaaagcagttataacgatgtggacagaatttaatctacttagctttgagacatctttttcctactgaaactttattttgcttacatctataaagtatggcctaactacatcaaatattacaatttagggtgagcaaagacttaaaacaatgtattaatatttgtgaagtgcctcagcatttacaaatgttttcataaaaattattttatgtagcctgtcagcatttggagaactaaagcagctcagctctttcagacaacaaggtgtctctgaatatttgctccctcattgcttctgccaaagaggacaggggtaagaaaaacacctaccttcttccttaattaaaatttggcagtggtatgattggtaagaagggggaaaatgattgaggaggtgagttctcagtttcatagctgagcaaactaaggtgagaaacactaaggctgctcattgctatggctgagtttctatcccagactggttacctttgtccttggtgtgaatcagtttgcaggagtaggctaggagaggcattctttccttttcctaaagcagagcatgaatacaggtattcattaagccattgtttcctagctgggtgttcatctactggcattgtcaatgattgcatataacaaaaagggaatggagagaaaaatctgttctgagttcacaaaactcactgaagaaaaaatgtaaagtcagctgatatgtcaacagcagggaaataattcattgtctcttagaaaagcgaatgccaataacaatagccatgattctggcaacagagtagtacttcagagggtcactttcagctcttggctttctcctttccctccatttccaaaggacattctccccagcaacagaaaccaagtgatttatcatggctcatgtcagctgctgaggttcacgggaccacacagagtggttggtcagccaggtctgtctttccatggctgttattacaaaggaagtattcttttataaaaagagaaatataaagtgatatatttgtttgttattaaagcctttttggatgccttagagaagattagcttcagctccagggtgccagagtaaacttgcatttgataaagccatggtcatttctactgctgtctttattgcacccaaatcttacaaggtaaaagatgtgaagaagacagcctttccttaattgtccattttgattatatctttgtatttaaaaaaatacagaaatgaactttaagaccaacttaaataaataagcaaataaatgatgtaagagataagtatgcagaaatagttattcatttcttaggggtttatacattttatttatacctattattatttttgattgaaaaattatcgtatacatttatggggtacaatgtgatgatgttttgatatatgtatatgatgtggaatgattaaatcaaactaacatgtctatcacttcatttacctatcattttttatggtgagacatttgaaatttactctttcagttattttaaaatatacattatggagtatataccttagataacataaacctttatatgctctttctaaaaatggctatttgaaaccctgtgtatagccttttgtctgtatctgtcaacttagtttttaaatataaaaccaataatagttgttagctctcttgctttcatcagggattggcaaaccacatttcacaggccaaatctggccagctgcctgtgtttgtaaataaaaagttttattggaatacagcctcatccatcatttacatatggtctttgtatgctttcgtgttacggaggcagagttgactagctaaagccaagtccaaatggcctacaaagcctaaaatatttactatctggcccttgcagaaaaaactttgacagctgccagacaggtaagttacattatatcatactaggtgatgtgggttcaaaaattatttaagacttagtctttaatagtttataacgtagctggataaaagacataccaaagtttaagtgataatacaagtcagttttaaatttatgttttcattgtctcaaatcgagtgacttttgagagtgtcctatatgccaggcagtgttctagggactgggatgtagatgtaaagaacacagaatttttgccttcatggagcttataacctggtggatcaggcagataataaagaaagaatatatagtataatgctatactatacattcttgatacattgagatttagcccaggtcacattaatagtcttgtctgcctttagcaataaattggttacttttcctaaatatctttttctccagtaagattcatatgaaaaagtggtggggggtggggagaatgaaaatacctcaaaccagtcattgtttctctaagtttgtacacgtggttcagaattcgatttttatcttgacgtagggtggaaaatattataaacctgttctggtatagtagaagaatatttgattgggaaacaggaaacctgtatcttagccctagtttagtctcttcgggctgagtgggcttgtaaagattcttaacttctctggagcatgtagggtattgtactcggtcagtatttctcaaactcgaatgttcgtcagaatcacttggagagtttcacatttttgagccctaccccctgagactctaactaagtggggcctgagaaatttcatttccagtgagttcccaggtgaggcagctgctgctgctgttttgggaacctgcttagagaaggattgcactccatcattgtggaggtccttccagtttctccattatttttaaactccctggagaagctttacagctctttgagcttgcctaggaagattccactaaataatggtttggttaagttgtctacttaatactcagggctatttgctgaggaagagatttcaaagacataagagtttttaaacacttgcttatggtcacatggattgatattcatttaattgatattatgtggtttctttgggaaaattaatgtttgctaattctaagggcagagactattgttcatgatttcttctttgtatcctgagtccatggtatgcgttagatgctcaatactgatctgtttaattgatctaaacttagagaagcacagaatacttctgaaggtcatcttcctgagttcctgttgggtttctgttatgctctatttagaattaagaatcatgaactctactggctgtcaaaactatacgcattattgtatttttgcaatgtgtattggtattatttctatagaaattccagtaagaacttcatattgatattcagtctgtctcctcctttgagtctgaatatacagcaaaataagcagaaacaagacaaacagtataataaataaaagttatccacattttctgttacatataatgtatccacttaatttcgtataattcagatgtttttgttcaaatgtgacttttacagagcatctcttaaaactgtaatgttattaaaataggtttaaaaagtagatactcatttcaacctgtttctcaaatgcccactgtggatctacaaagatgcataagataaaatttctgccattaagtgccctccagacccttagttgaataaatcaaggattgaagaaatgtccaaggagccaggcacccagtgcttcaaagttgggatttttatgactttttaaaatgttggctcaagttaaaaataatcaaaaatgaaaacagtgtggatcaacaaaacctagagttagttaccagctgaattctaacatcaagccttcagtttataagttttgaaacatggatgcacagacataatatttggggatgtttcatatgatctggagtgagaacaaatctaagtgcagagattagaaaaagttgcttagaggacctggtgtttgacatggactttgaaggataaataaagactctagagcaaaatctagagcagtgtgaggataatgagtcctagcagaaacagaccatgagaaacttctaaggcaagtagatggagtcaatgttcagggcattgtgaatagtttattgctcacagcaggagtagaaaaatggtagcgagtgagagagaagactgttaagtgtagttgggattctactgtgtggacccatgatggccagttgaaagttttatactcagtgtgttaggcaacttcaatcaccagccatagacaagcattattaatctggattatatttataccctatttcatcaaatctaaaatgccattgattgttagaaacatataaccactaaggaagaaaaaaaatgccactgttaaactatgacagaatgctgtgttgtcatttggaattattttaagttcataagaactctaagatttgttttgacacaagaaataacgaacctttgtgtcccagtttgtgcttgcatatagatctatgttatgaccgctaccagaccactagctattgcagctatcagtttgaagatgcatcaccacttcatagaagttgaaaggtgcatcctacagtcaataaaatatgataggtgaaaaagtctacatgttggatattatacataatggattgagtggaagattttttaaacaaaatgcctcccatctaggtcataattaccattataatccagctattaccattttcaagtgaaaagcttgttaattgtgacttaatgttccagaaatcggaaacctgctttttaattggaagcagtctttactctcttgaagccacgaatattttcttacctgaagggtgctcattgaaaacagctgattcctatttcgtgtttgtgttcttccttgggaaagtcttttgcatcccaagctttgtttttctttttctctttctctgttaaaaaatgttaagattttatgaaacggaagaacagccctagggaataaactcttaatcacagagctgattgagtgggtttgaaacagaagatgcacacacccaaatcaatagccatagaaggatagcagttctgcaagtctccagtaactattcttaattcagaaaagccaggaaaggtcacaggctccaaataaataaggttgtttttcttgctcctttagtgttttgtttttaaatcacccatgcctgtaacttaactgaaacgttcctttttatttctatactactaaagtgattctaatataaatggtacagttgttgaaacactgatcactgccatttcttaaggttttgatgtggtgtttctgactggtgtcagcctaccatgctatcctttttgagatgttactaataaatatttgtaataaaatataaatgttaaaaactatcagctgttaatttccttaaaacctaatgaagtcctttattaataatacctgggatatgttttgtatttaggaagtaacgtgcccagtgggaactatttcatttgttctctctgtgtgttagggatgtctaactttatctgttgagatgcaaaatatttcactgttaagcagataatattactggagaagaataatttaacatccaggaaatgttatagcccaaaatataactgtttcttactgctagtcaaaatacatattctgcttttatattttaattttttctttattgaaccattaaaaacttcaaattttgtttaggagagacaaactttaatttaacttctttgtatttttaaagtgcctgaagcatatatccattcacatgtaggtttggaaccaaaaaccacaggctcaatatttttagggaatctaatgcatttggaaattgagactgtacatataacatacctatagggtgcatttatttttttccagaaaaccaagtttaataatgtgttaagatgaaaacaagcctccctttctgttataaccttctctacattatacctcactatgatttcacatgagctattgaacttctacagtttttcttatttttagacataaaattggatgttgtatgcatttttaaaatatctcttcagctaaggagagaatgtggaaaaaacaaagagcaaacccactttgctataattatattgctgaatctaaaggatttttcactggcaccgcaaagtgtaaaagagcctcacagtgtgacatttgtgctgttgtggagttgacctaagtatataaatctaggtttttgtcatcagcgcgtattgatggcattttaaatatattggcatgcagttctctgatattaggcatgcccagggatagagtttgagtatctgcttgcaaaacgtctcagtagaaggatctaattctctggcacaattgcaagatttgggccttcctgaacaatcctactgtctgtctggggctgattcttcggaatgccatcagaacctgggttagcagcagttgaaccagggctcaataatgggtgaagagagaaagaacaattttcttttagcatctttatcctacttggctgctaggctgctgtctttcttctcatttctcttcttcctgaatcttcttctgatcccatctccttagttgagtatcttagaggcaccgttgattctagaaatagttttgattattttcaagagcacatctgccctgaatgctaaaggacatttcaaaaccatagtggtgggcaatgttttgttactttgggtatacagcatttactttaccatgcactttcattcgtggctgcaaagaacagaaaacccaaccagtagtagcttccaagagcaaaggtgaattttcccacttagcacaaaaggtctggaggtcagcagtgcaggctggttccattgactgatgatgcaggtgaccagggaccgaggtgcctgctctctagagagctgtgctggctttctttatgcttcccataaagaaaatgtggtcacaactttgtagctgcatctgagtaatcaggaaaaagtggggcgattgaagggctgcagggtgttccactcttccttcctctgcaaatgggtatttacactgcctctgctgggctccccaaagcctagtgtctcaaagtcaacttaatatttttctatttgattttacgttgttgttgtttttgttgttgttgttgttgagatagggcatccctttgtcacccaggctggagtgcagtggcatgatcatgatcatagttttctgcagacccaatttaccaggcttaagcggttcccccacctcagcctcctgagcaattgggaccccaggcacacaccatcaggcctggctgattttttatttttgttagagacagagtctcgctatgttgtccaggcttgtctcaaacctccagggctcaagtgatcctcctgccttggtctcccaaagtgctgggattacaggtataagccaccacgcctggtcagtttacctttcttatgtagacctttgatccatctggaatatgtttttgtatatgatgagagggatccaatttttttccacaagatgagtcagttttcccagcatcagtttctagataatctgtcctttctcacaggcttatgatgccacttctctgcatcggccacacctgctttctttatgatgccacttgttagctaagttggaaaacacacacacagacacacacacacacacagtctcttttctctctttctttttcttcatccctcctttatatttttctggaatttctattcttttccatttttctcttacactttgtaatataccttgatatatgctggacaaaggccctttttgccttgccttgccatttttccctattccgtactatatcatttgtcctgtttcatttttcttccccccctttacttttcttctctttttcttcttaaaattgacagtagatgatatctctgcatactcaccatatgataggacttaatttttgtgtttctctttcattgaccaccaactgtaaagcaaattttgaggtattaggtgtataaaaaggctacattcagcaataacagcctaaaaacagcatactgtgtgtttctaaaaactgtatgtttttggccactacagaaattttgggtttgttttgttttgctttggttttgactgccagatggagcaaagtgttcatgtacagctcaaacatagctctgtataatgttgcctttttttactcttgtctccttacagtcattatctgactaaaagtaattagtgtgttggaaatttagagtgaataactttgagaggaagcacttattttcttttattgcaagtaaaagatgttttttgattcagttgaatagtacttgaaagactgaacgaatgtagcaaattctgtcagcaaactggataatccaaaagttgaaaatgtgggggtctgcaaaaatcagttacagaagattaaagtacctttggtagcacattattaagaaaatccacagctgttttaaagtgggtgtttcctcatggagaaaagtctaaagtctcttgcagttacattctgatttcttcgtagcttgccaaaggttggcaacctttgctcagtacatgcctcacacggcagggagcaggagtgtctcatcatttctggggtgggtggtctccttgggggagcccagggatgccttatgcatggctgagaaattttctttctgtggccctctgtactgtatgggctttagggacaaacttgtgagggggggtgtgtatgtgtgtgtgtgtgtgtgtgtgtgtaaaacactcttcttgagctctgactgcaagaagaaatggtttgagaagacagaggaaggctgagaaaggactttgaatgtgaaaatgctattcttgtagcatccttaatgccattggtccttagctttatagatcaagattgcgagtgagccccttataggtctggggtttattgttgctaataccagatgagttacagtatgtattgcagtccttgtattttaagttacatctggtttctcttaaagttccttagtaaaccaaaactgttggtgagtggaagcctgatgctgaaaattttgaaaagcaactgtgtcagatcacaggatttttctttgttttttgttttcatagagttgttttgggcttggtgactgtttcatttaaatcaagtataaatgcacagaggtaaacagacactcctatttagtcttaagaacttggtttgatttggaattttaactgccagggcccactgtttagtgtctagcctgctttctatttcctgcgctattgttttgcttttggtcaccttaggggaaaggctacagcttccatggtcccaaagtcagtggcgctgtcagattataaactgagaagagctgattccttggtggacaaccagagttcttcatgtgattttagtttacatttagttggatttcacattacagtacatttggtgaattatttcctgaatgagactgagaaatcactgggctctggcaactctgtactgcttcctctgctttagggattttctgtctgaaatcttcagaaaaagttgcaatagagttcatgaaaaccctcagttctaaatggacacatgaagaaacaccttaggtttgaaagggtgttttaaaattacattcctgtcttgtatttttttttctcctttttattttttttttctttttggcctaagtttcaatgacattctggaagatgaatttcagttgggttttgggaaactatttccagcagcggttgagtctggatttgattccacagagttacagccgaggcttctctgcattggccacacctgctttcttgagcaacctgagagacactgcctgtggacattttccactacttagtgattagtcacctcacagttctgctgtttttgccgtgagataatttcactttctccttctgctcctgcgtgttctatgtctgttttcacccatctttgcttttcccattttcctctggatttatttattctgtcccttacatttctttatacatttgcctcttcttatcctgggaacctcacacctctgcttgttccattttcacttgtttctggatgtgttgtatctattcctttgaaaaacgttgctcttttgtaacatgacctgtcccagcatcatcaagatagagacttttaaaaaatactccctttcgtatcttagaaggcaatagatcttctttcccagccaaccagctggaaaggcttttttttgcttttccgttttttgcatttccacgtagactgcgttgctccttgctagagaaaccacaagcattcctgtgtgaaatgaaactcgctgttttgtgattttgtgtgtgggggtggagaggggcatggtaatatttagagtccctggcctttgcctcccaaaggtttgtcattaacattttgttgatttttaagcttgctcttatatttaggaccagtttactgagtttacctcccattccctttctagcaggacacccaagagtcctgtttgctcatttcctcttgtcctggtcccaccctaagggttttccatgggctcgcacttctcaaggagttcttgggatccaggaccctttagcaactactagccttttttttttttttttttttttttttttttttgccagagtcttctccttagcaactgtaatggcatattaagttaccagttaattcctttgtgaggaagcgtagcagtttaatatcgaacaaaggcatgtttgagcaaatattgacaattgaacactttagcaacattaagatgccttttataatggatctgtcttacaaagaaaagcgataactttctagtctcttatgctgtccaaaactcagggacttcgtagatttagataacatgatttccttggtagttggatttcagcaatatcatagactttgatagtgaagcatgcttgtatgctattttcaaataattttcattggtgctaacatttttaaaaattcaattattgtctcactgctttaatttcttagttactctaataacaaagcccttttattgtgcagagaagtaaccgtatgtaatttataatacgggatgctgaacaggacttatcgtgtaacccgctacaagactttagaatatacaaggactgtatataaaataatgagaccaagtctgtggctcaggcatgaaatcagccaccttgttgaatgttaaactacttttatataatgttctgtggatttgtatttgttcatgagtatgtgaacatttctcctctatgaaataaagctgtcaatgagttctatgaaatcgtaacacattttctataggacgagtatttgacgttatggttaaatatagtaccaatttatctacccaactattatcatgtttctatgtttctactggaaaatgcactcctaattgagatgtcagaggtgagaactaaagcctctgtgagactagcatttaagaatgcagaagtaaatatcagtgagtccatgccagagtggagcttatcagtaagtgatgttatggagagtatatattcagagtctctgactaaggtttcagttcctttaagagattgagtccgtaaaaagggacaggaagggcacaggtcttttaatgctgtacacctatgtaatttcacaagagccaggaccccccatccaggtcagccactctcaagatattcaagacataacttccttcagtgattatttgtatgtttaggttgttcttgggtaaactgtgttagaaccagagatgccataaatatcaatgcagtctgtccttaagcctgtggctgccaactcagatcagctgtgtacagctgacctttacatcaaaggcttctctttttgctgccacagcaaaaggtttgaagttcttggcagtcagcaacactgtgaagaacacaaggggaagatgcatttcctatctcagaaacaacccataggaagcaaccttagcagtggtgcttggtttcctaagccattctgcataagacataacatactgacacttaacacatttgcagtatttttccttctactatcttaaaaaaaaatatatgtagttttaaagtcatcctatgaatgattaggcttctgtgagccaaacctaggtcagtagccgtcattaaaaattttttttggttggaaaaatatgttgtatatttcacataaccagttcatataaacacttacagaatataatccattcataagtttgcggttcccaagtgtgtgtttagcatgtgccatatatacttatagatttgacattatataggagcccctcactataagtgcctaaaggttgctagatgattactaatgtattcttcccctaccaaattgacaattctctgctactgaataaaaaatggaacttgtgatgtatcctagaacaggctattaaatcactgccatgagtatgacattcactaagaaaggaattcctggcacatagttcatctagtttttctcctcttccctataaggtctgtgacaaaaaggcagttcactgttcttcttgtccctgcctggttacaaggttagttctaataaccaaactgtgggtctagatagtaattctatttcaaccctgtaaataattacccaaagctgccaagcttaagaaatgttttatcagacatttcttctcatcatcggtaagtctaagataatgaaacaaatggcactaactttttttattttttacttgtgaaacatttctgttttggggaataaaagagcaagagatttttaaagctctgttaagttctgtaaagtctgatcagaaaatggaattaaaattaataaaaactgagcttttgttctaataagattttttttaagctggccacttgcttaagtccaatttagcttcccaaggacagtatctttgatcattaaaatatttatttatttatttatttatttatttatttatttatttattttgagatggagtcttgctttgtcactcaggctggagtgcagtggcacaatctcggctcattgcaatgtctgtctcccgggttcaagtgattcttctgcctcagcctcctgagtagctgggattacaggtgtgtgccaccacacccagctaatttttgtatttttagtagggacggggttttgtcatgttggccaggctggtctcgaactcctgacctcagatgatctgaccacctcagcctcccaaagtgctgcaattacaggagtgagcaaccacacctggcctgatcattaaaatatttaagagagtggcaatataagcaaaaatgattcaatataaacaaatacaaatttcaatataaacaaaaagatttatgaaacctaaaatatttgaaacttttctagagagagaacactagtctaaatatctaggaagcaggcatttaagtccttgtgctggcatatgaaatgggttaattccttgatacaaacagctctgggtatttattgtatgtatttgtatagtggcataaaacattctttactaagttacaagtcaaaacagtaaaggaatgaaaatgactaaattgttcatttgttaatacaatatttcctgtttactctttttctatggtgtaaaagaaactgaacattgactttctgttttgtaaaacctaaaaatataattaagaagaagagagcaggcctggcgcggtggctcacacctgtaatcccagcactttgggaggccgaggcgggtggatcacgaggtcaggagatcgagaccatcctggctaacacggtgaaaccccgtctctactaaaaacacaaaaaattagccgggcttggtggtgggcgcctgtcgtcccagctactcaggaggctgaggcaggggaatggcgtggacctgggaggcggagcttgcagtgagccgagatcgcgctaccacactccagcctgggcagcagagtgagactcgtctcaaaagaaaaagaaaaaaaaaaaaaaaagaagacagcaaagaagtgagaaaggagttttggaaggggttgtgatcatttgcaatgtgacacgatgttagctgcttttcataagcgcgttttaagcaaatgtgttcttagctctgtttttggttttaatagtaattccactgtgaatttgtatgttgtggaatgagagaatagtgttaaaaggtgcctggttgttgccagatctaagaatgggaatgattttctcaggcaactcttattccatcaagtgtgttaaattactgtaaattacaatcatgcaggagattggtggtccccaaatgacgttttccactatttgcagctccttagtgtatctatacctaacagttttgcatcttgttaaaccgcagcattcatatattacgcctcttccacagagaagctcacatgtacattccaggtggaatcccaccgtaatatatacatcacaaccaaacaccatagagtaggttttctgaatcatttatttaattggtatttaatacagaggaatttctgtttgccaaaaaatgttttttgtaatctactgtaagcagacttaaattgtccttgttaatggctttgagaattattttttttaccattaaagaataattttctgggaaaataaaaaatgatgagactcatacagacataaattgaacacgtgttaaagattttatgaatcttattaatggagaactaggaagatgtcataaccattcaaaggagaatcatagatttatatggaataaagaaatgtgagatgaatttacaaatggatctgaagctggctttttctaatgggaggaggaatgtaaattgaacctccaagggacagaatttatttgtattgtctatagaaaagacttactttgctttggtctcatttatctaaaacagagctatgaaatatttcagaggcagtaaaatgccagaatcagaggaccccaaagggtgttctctagacaatgcattgttttccattggaaacacctagtaatcctttttgtttatcaccctgcctggcaaaatttttgtatatttttttttaatagagacagggtttcaccatgttggccaggctggtcttgaactcctggactcaagtgatctgcctgcctcagcctcccaaagtgctgggattacaggcgtgagccactgcacccagcctaagagaccaagaatttatgaacagaatgacaagtttgtgtgaaagtacatgatgctaagatacagatgaaggctaccccacctctgtgctagctgtctacaaaaggagccgagtgcggctggaaagaaagttgcttcctttccaattcgaagaggaggtatacaaatcctagagctgggggcagtgacaaggtttaaaatcgatgtgagagaaacactaaggaatgagtcagtgaaagattttaaactccatcacacccaactcagtttctctttaaaggaaatggcagagatgcccatcaatgtagatttttagagatggtttattgtgatttcccatttatgttaattagctttatctgtcccctttcatttcttttgataaaatcacttagaaaaatgtagacgtagttatgtgtgttaaataatataattcagtgtgacaaggagttgcgtccctgaagatgtgttgttgagaatggatgacaaacagttcaggtcaaccttgagtaagtgtgaggaaaaaataaaaataaataaatgaaggatgtaattgggctcctctcctggagactgaaaagtaaggactggcatggaaatctttgatttttggcagtatatcattatctttagaggtctagaaaaagtgcctacgtcatcctttctatgaacacatttcaggagctgagaagttcctatccatcatgaataaaagcaaccacttgcatgtggcttttctagaaaaaaattcttataaaacattttcatcaggaaagaaccaggagtctaaagtcagatgaaagaacgtcagactgtagaaatcagctttgtaggtatgagtccaggatcagtttgaggtcaaacccctttgcacatgtttttaactttgcaccgccctcgctctcagtgctggctcctccactcatctttgttgctaattcatgtttgagagagtctgcacaaactccccacccaggctggtatgggccttaatgcaagtttgtgtgtccaggagactcacaaatctgatcaatttcaagggcaagtaagtgaaagctggagaatgtacaaacagaaaatcgaaagctatggaaacttgaagagacaaaacgaaaatgtaagaaatgccactaaaatgagaaaatatggtcaaacattgagaactgatttgcagataagctttatgggaatgtctgtgaaatattggagagtgtaggtgtcagatttgctgagtacagcaacaaaaaatatctaaagcatatagtggtagtaccaaaatcaagattcataaggttttacatgatgtagtatctggccaaaaatgtggtcagcgttgttttttgtttgtttgtttgtttgtttccacactatgtggtaaaaggaagaagaacaggttattaagtggccagcattcatctttataatctgtggtgtctgtggtcagtcctgctgcagggaatatccagcctgtatgcttacacatgtggactggttttcatgatggaccatttcagtgccaggtggtgtacatgacattaagcttctgtacacactcttttcaaaattttctttacatgaaaattaacatcagtttttattatgagatggaagttaatagtcattgacaaaacttgaaaatgtactttaaaaactttaaaaaacaaagagttctctctctccagatcaaccttacaagtacatcacaggatttaagcaatttcatcgtaacacaaaggaggcccagtacattcttcagtgccagagccaatccacctgtgttggttagactcaatgaaacagaaagtttataggttctaaatgtaaaatggagccagccctattatgtttgttgttttaaggccctgtgatatattgtttttgtgaatgggggaaatataggaaaaaaaacactgagttttgaattattaacatactatgatttgcttcataattctcagatgtagttctgtcagatcctcaaaatgtgcacaagattgaccatcccttccaggaagaaaaataatatgcttccaataatgaatacactctaaaaatatatggtagttactttaaaaatattggagatattgggaaaaattattaatatatattttttcttttaaatgctgttaagacactagtcactgtagctgatagcatgggttagtcaaccttcacaagtgattttaaaactgtgagagtatagccatagccctgagcttttcccaagacagcatcccaaagaacaagttaaatgtgatttaaatggaagaagaaaatattttgaggtacaagtggactcaataaatttaggaattactatatttgaaggaaaaaagaaagcatagtggttcctactaatggattgtgcctcactgaccattagaattacatacacaggagagatccttgaggagttaagttctgagtacagactagtgtttatattaaaggacaagatcacatgctggtgatctgttaacctttggattgctttttctacagtgttctttcttaaactgtggagatccccattgcaccacccagaaaagagagaagagtaatgaattttggacctggcacgttgaaattaaagagcatgaagaaagtgagaagttgtttactaggcgtttgagactagctgggaggcttggaatagaggcctaaactaggaaactggaattggaaagaatcacaatactagatagtaaagttacacaagtagacgccctaggcaaaaggcctggaagagaataaagccaaagggatcacttctaagagcagaggcagagaagacaggaaactaacaaggaatatcaaatgaagactcacaggcatggaattgctatacatttagtggtgtttgggggccctcagaaggtacaggtacaggtacagtaacacatactgatgtttacttacacttaaaatgaaataggcactattgtcaaaaccatttaatgagtgaggaaactgagttcacttcagtagacccaggactcatacctgtattactctgagaatagccagttgcctacattaggcttttgaaagcttaattagacaaatgatgaaacagagaactagacatgacagtgaattggcagaaacactgtttcttcagaggcccataatcagcttacatacctagagaccctagactgagccatagaagtggaaacaaatctgatttatatgactgtggagaaaatcttgtacttggaatgctgtaccctgttctcgacacattattggcagaaagatacatatcaaggaaaggacctggaattcacttgtggatgaaaaagcaaaagaaataaatgtgtaaggcagtaaaagtatatagaaagtgaaggtgatactcatgtatgtgctgacataacagaaggaaaatgacctgagtaagcataaaactgatgccagagtcaggaagagaaacatagagcctggaaattgatcactaatttccttcttttttttttttttttttttgttctaggcttgacattttccactttctttctcctaaaacaagaaaggggacaggttgtagattttatgtctttaattttctttaattcttgcctaacagtgataaaaacataagatcagtgggctgaaatttagggacactgagggaatgaaaatagaaaactaaacctggataagttcatcagcatgtctgggaataatcaacaggttatatgagaaacaggttttagttaagttactaatctggaataatcaaggtgataactgtaaattaggagaaagtttgaatctaagagcttgtattaaaagaaagttttcttttcctcttttgggttacataaccaaattatggtctaatattcctagggaaactagcttaataattagttgctgcagttttgtaggtagtatgggttttttgtttgtttttttgttttgttttgttttgtttttgagacagtcttgctctgttgcccaggctggagtgcagtggtgcgatctctgctcactgcaacctccgcctctccgttcaagcaatttttgtgcttcggcctcgcaagcctggctaatttttttttctatttttggtagagatggggtttcaacatgttggccaggctggtctcgaactcctgacctcaggccatccacccacctcagcctcccaaaagtgctggcattacaggtgtgagccaccatgcctggcctggtagtgtgtatttttaaatgtgtgcaaagtgggcttccacaggacctatgttgtttgaataggacctctcttgcctaaacatttttatttacattcattcatctatcaaacatgttctttaaagtaacggtgaactccagacttgcacaaaatttttatattattataaattagtgaagttcacattaataaggttgtacgtgataaactccactgtaaatcctgaaacatgtgccctgtcaagacgggagaatcccattaatatctaagatttcaaaacttagcaacaattttggacaggccaaatcataaatgaagtagtctaacattttaccaactaaaattttgtattctaagatgaggactcacagggcaaaaaggcctttcctcttgttctgaacagatacctctggtgctctgcacttactaataatcatgtcaaaaaagctgatgccaatttcatttttcctcttaaagtcactctattaaaggaaaaaaggttctgttaaaatttaatcaacaaaagcaggtgttacagggaggggtagattcgttgaaagctgccagtgaatccaaatactctctcttttccaggcacacaataaagttagtccacaagggcacatgaaatctttccagcccacaatcatattagaatttgcattgtgttactggaagcagcacagaaatattcccttttggctcacttcagttcttcgtcaccccctgaagctgcctcctgctgattcgaaggtcttgatagtttctggcaggacagtggtatcactctccagttatattgctgcttagcatctggtagttgcagaggaggtttatactgcattatgttccaaaaaaaaacccaatctgtgaaccacattaaggccaaatctagtcttggatatagtgccatggggtggggatgaaaaggggatggcagggatactgactggcaaaaaaactggaacttgatggaataacatattggaagaatgacccccatgtgtgtatttttgttttgttatttccctagaagtatgtgggaagggagagtaattagggggcgggcacgagagaaaagcatacacttttttatttagtgatataaataatagtaaaatttggataatctcctgaactgaaggatctagttctcttcaacaacaaatgcttatcaggaatgatttcagcaagatagcagaatagaagttttctatcattgtctccctgtagaagcaccaattttgacaatcactcatggacaagagtacctttgtgggagtctgagagtctagcagagaagttccagctcactgctggagcaaaaaatttaaggagagatgcattgaagaggttaagaagaatagtttcattttacccatgtcacctctcctgtaaagcagcacagttcagtgccaggagagaccctctttgcccatgattcttctcacagggggaaagttagtgttgtgaatacccagctttaccagctgtgtaaaatgctgtccaagaagcccacctcttttttgacccaccgagaacactggaggagattagcatgtctgagtggctgaaagtagggaaaggtggggatgggggtggcggaaatcacagcagataggtcttagaattcaacagctgtttgtatctgactgactgcatctcagactccattaggaggcctgcccatgagctagttgggatgcctgacctataaacccaaccaattccatgggtgcccccatgccccacatgcttcctcccctacccctcctgtggccaattctgatgcacattccttgggtcatgagtacaagcctttacaggtggtttgtagtcagttggcttgactctgggattggaggaaggtacataaactgagcatttcagggcactgccctagggaaagcaaatgaaaggctctcagcacaaagcctggctttgtgagattgagagaaggtacacaatcttaagaattacctcccaagagaaagcaaaaagagtggagggagtgcattcatagaaaatatcgagagtgcctcagaattctagccaggctgactggtgaaggagttcctctccccaaagctagtcagtaaagactggaggagatgactactacttcagatgtgaaaacagcaacacaggacttcacagaacacacacacgcagaaacccgacaccagcaaaagaacacaataatttctcagtaaccatccccaaagaagtagaggtctacaaattacccgacaaggaatttaaaaataattgctttttaaggacacttagcaggctacaataaaactcagtataaatctaaataaaataaaatcagtgtaaatctaaataaaactcggtgtaatcaggaaaacaatatatgaacaaaactgaaagctcaacaaatagatatacatcgtaaaatagaaccaaacaacttctgaagctgaagactgcaatgaatgaaatgaaaaatgcatcagagagagtcaacagcagattcgatcaagcagaagaaaggatctgtgaactcaaatacaaagcatttgaaattatctagtcagagaaggaaaaagaaagcttatgggatttatgcgataccatcaggagaaataatatatgcaatatgagagtcttcaaaggagaaaagaaagaaaagggtagaaatcttacttaaataaataatggctgaaaacttcccatatcatgggaaagatatggacatccaggttatgaggctcaaaggtcctcaggcaggttcaaccaaaataaaacttcaccaagacacataatcttattgtcaataatcaatgacagagaattttgaaaacagcaagagaaaagagactcgtcacacataaaagaagactgtcagttagactatcaataagactatcagttgacttctcagcagaaatcccacgggtcacgaaggagtgggatgatatactcaaagtgctgaaaggaaaaaactgtctttcaatggtactttactcagcaaagctgtcctttgtaaaggaaggagagataaagattatcccagacaaacaaaagctaagagagttcatcaccactaagactgccttacaagaaatggtaaacgaaattgttcaagctgaaatgaaaagacaccaattagtagcatgaaaatatagtatttttactccctggtaaaaataaatatgtaggcaaattcagaatactccaatatcctaatgatggtgtttaaattcattttaactctagtataaatgttaaaagacaaaagtattaaaaataactatagctacaccaatgttaatggagacacaatataaaaaaagtaaatcataacatcaaaaaaaatggggagtaaaagtgtagagttaccagcttcaaatagactcataactataagatgttttgtgtaactccattgtaacatcaaaacagaaatctatagtagatacacaaaagataaagaatcaaaccataccactattgaaaatcatgaaattacaaaggaacataccaagagaggtataaagaaacaaaacaactgcaaaacaatcagaaaacaacaaaatggcaatagtaagtccacaatggaatgttattcagccttagaaaaaaggacatactgccatttgtgacaacatggatgaacctggaggacattatgttaagcgaaataaaccagacacaaacagacaaatactgcataatataacttatatgtcaaatctaagaaagttgaactcatagaaacagagagtagaattgtactaacagggattgagtgtgaggacaatggggagatgttggtcaaaggatacaaactttcatttataagatgaataaattttggagacctagtgtacagtgtggtgactatagctcataatatacccttgaaatttgctaacagggtagattttaaatgttctcaacacacacacacacacacacacacatgcacacgcacagaggtcagtatgtgaagtgatagatatgttgattgtggtaatagttttataatgtatgtgtgtgtgtgtgtgtgtgtgtgtgtgtatatatatatatatatatataatcacagtatatatctttaatagatatactttttatttgtcaatcactcctaagcttgaaaactcaccattttcaaagcagtcactcctttcatgtccacatttcatcagggaatgattttgtcccattattaatataagtaccatttcccatatattgtttgatttaaagatttctgtttctcccatgttttcattgtgcagtctgaactactattggcacaactatatttacataaacagttctaaacctagggatcaattattgttatttttgtttagaaaatatttttatgaatatcaatggctttttcttttgagattctactgtattcatatagtgtactttactacctgtaccttatttatattttaccagctagggagctgaggggaactcaaaatatccaagactttgggcctaaatttctaaaaatggtcattaaaataggaagtattaaaggagtgtgggttgtggactttcgtactgattagcatgaacatttgaaaagcgtaaaagtagtgctacaaaatatttcaggtttacatatctttattatatgttcagtcaaagctgtcaaaatcggttcttacagttttaattataattgcaaaataaaaattttataaatttcggtgtaatcttttataatctttagcagatataagttcatttaatttatttagaagtgttgcataaaactcctttgctatattttctaatatgtaggtatcattgagaggctctgctgtgaaaaaatatatattgtagaaatgttaggaatttgtggtaaattagtcttcattgatttttcaggttttagaatttctattgagtcataatattctagtctgacattttttctttttttgagaaacagtgagatgatggcaaagtgaatatgtcccattttttattgcttttcatcaaatgttactttctcataaactgcagagtgaacctttctccaccaagtaattatgctgatatgttgtacattcttaatactccttaaaagtgagggaaaataaacatatcaaatgtcaaatagtataaaaaaatttctctactaatctgagaataagaattatatgtttggattcccttgatcatatatctctttatgaggatggtaccaacaacccaataggaatttaccataaaaaaaaacacaaacactgatataatacaactaatataagacattttattataatttatactaaaaccataataaaaaggttgtttatacttaatgggacaatccagggaggggaggaatacaaggctgaacaccagttgatatgagaaggctctgagattttggttgttaaaagtcactctgcaccagcatgtgatgtgtctgcaatgctgttataaatgccatcttaggcagatttgacagagggattcggagattatgtagacctgttgggctctgctaatcagaaaacatctctaaaaagatataagaagaaataagagctgaaatggtaactattgtcgtaatccttcatttagttactaataactaacatttatggagtatttactgtgtcaaagacactgctaagcccattatgttatcttacttactatgatttaatccttacaacaatctatttctatggacacctactttattccatagcctatgctagagattgaggattcaaaaaattaaagttgcctgacttagagtgagttcacagaaggacccactgagagaagtagggtgattgattgcccaaagaaaaagtgattgagaatgtaacagttggtggctgtgccagagtctgaagggctgtcatggatatgctaaggggatgacatttttaatatagaggaagggggaataaaggcacaaaaattatgaggaaatagatatcagtcactctagtgaaatccagatagttatctaatgcttgtgttctaaaacttgatacatagtctgttttgtgaggggtataaaaactgggcacagtgtctcccattagatcacagggcctacagactgatgaaagcaggtatatggataatggggtagcatgtaataggccttttaagggaacaagcagtgtcacgggaaaccagcggaggtagagatttactttgcactggaggggcctgacaaaacatgacatttgtgttaaccttaatgtggtgaggattggactgatggagccaaaataatagtacagtatccagtggtttcaggaacagaagcatcaagataggaaattataggacattttggtgcaatggtgagtattttggtttggttgtagtgtgaattttatgaagggaaataatggaagagaaagctaaacagctgggcacagtcctggtcatgaggtctttgaaaaccacagcagacagtttgcaatcttaattctgtgtaattgggaaatcattgaaggcttttggggagaaagatggttttaaggaaatgattttttaacagctcacctttgctttttgataaaatagttttctctctgtcactaaaaatgtgtcagtttagatgatagtttaggaggaatgttacatagaagaaagcatgccaggagtgggaagtttttacatctgtgctcatttactggcttggatcatggtgtcatcttcactgtgactccagtttctagcagtgtctggcccacagtaggcattcggtgagccttggggaaggatgtaaaagacagatagaacttcaagttccattccaggtctgaagttctttgatataattccagaagttaacatagcttctaaaacaagatttcatacaaagatctaattctgtagccaaagcataacagttgtaggatttaaactccaataaaatacacaagatttttttttaaaaaaagagcaagagttaaacaacaattagattcagttgtggcttctctcacttgcctctattgttactgttttctcctgtgtctcttataatagtaactgaaaggaagtaatgattatctcaaatttggtgttgtcctattgattagcattcacgttttaaatataattgctgacattatattaaaaaatataattgttgaaaatttctgaaccaaagataaataccagcttgtagtaatgccaaaccaaaattgaatcctttgaaggtttcaaaatctgttccctgaatgtctgcaaaattccacactacttacagcaggacttagctttcttagcctttctgaaaatcagtagatacactcagaaaagtttaccaatgcacgtgtacatagtctttggatgcagttataggccggtttgtttacaggcccaagaagataatcaatagacatccccacccctcagttggaagcaaattcagtggttacagaaatctcacttcaatgtatttgaggttttcgcaaaaaagatgtgtactgcatatatctttaaagcaatgttttttgagatggaacatacaaataaatgcctttagaggtaaaagttgtatggaagccaagaaaatattaaagaaattcaaaaatgctgctgatccacacatatttctcaaaggtcctataagcattacaacacatttatcaaagaacatttgaaggtgccaagatacttccagtaataagcgtgattatatgattaaaatgcatttgcatagcctttggggaaatggaggagggagacaaggagagagaaaataaagaggaaactgcattagtgattctctgccgttgttgtgaagttgacttgtagaaaaacaccaatttttctaaaaaagtgtatgctaagacctaaggaatattatttttaacctatctaacgtatggagttgaccccctaaaagttagtgcttctgtggagaaaggagaccaacacaaatcttcaccaccccaacccctgcccacacactttctcgttaaaagaagaaaggaattggtggaatgggtgttgtgtcagtctcactctggcagaaaacagagttaactccaaatggtgtaagaaactctaacaacggggctgtttacagtagacagggttaagtgagcaagcaatggatattaatagatgatgaggcacaaaaactggcaacagctggaagccattatcatcacctgagggctgatggggcaaggggaggacaaggtattgtgggagcccagtgaaaaaggaaactgccaagagactactcagtggaattgcagtcatggagccatgcagccactgccaggggtgctggtccagcttgctgggcacgaagcagggcagagccaaagacagaatagccccagggcaggggcaaatggcgcataaccaggtaccgttctcaactctttgacttctctgctgagaagacaaaacatcttttaagttgccatcctggtgaaactatttgttacgagggtactgttctgtgaggtttttattgcttaacgttaataggcggcttaatcacaccctgagaataatacccaaatattgcttttctaaatgtccttgtttgggagacattggaaaattctttaaagaaagagcagtatacccccactacccagattgtcctttttttccatttattccagaaacctttactgcaggaaaagagagatgttgccataaatgtttgaaagaattccttgtgtagttagtggtggccataaacatatggccttcactaactatttgccctctgttccaaccttgtctttccatgacagttaaccccatcattacgtattcctgctccagtttcactggggaattctgtattcagagccaaagtatgtcagtaaaatattaaaagtaacagcacaacaaataaaaagagataaagttgagaaactgcatggcaaaaagcctgtcacagagttgtagagaagaaagaaggaacttttttttagctaattgagaaagcattgttgtcattattgctaacatttaaagttctcaatttttaagggaattcttgaaacattgtactggggaaaacaggaagttctgacttgaatacattttttaaagtaaaggatgtaatttgagtgaattgatctcagactttacagatgatcttttaagatatgagtattttttgtgcattataaaagtatagttgttcataatggaaaatacagaagcgcttagagcataaaataaaatagaaattacctgtgactctgttgcttagaagtaatcactattaatttggttttcttctcttcttaatatatgtgtattcttaaaattatgatattgtgatccttcattgatatttccaaatgactttccagattttctccactggtttttatttccaccaaaagtatgggaatttaactgtatccttcttgggcttgaaattttgaagacctttgccgattttattttaaaaagtgattagtaaggttgaactttattcatagttatatatttatcattttgtattgaattatttatccatgtcttttgcccatttccttaagggacaattagtattttttaaaattatttttaggagctctttgtatgggaagaaatttcagaagatcatctttcttgttagaaaggataggactaattggtcacccttatcaggtgattatttgatgcaatttttgatgccttcttgcttttagaaaaaacagttttaaaggactaagctcaaaatttttgttatttaagatatttaagggctgggtgcggtggctcatgcctgtaatccgagcactttgggaagccaagctgggaggatcacttaaggccaggagttcgagaccagcctggccaacatggagaaactgcatctctactaaaaaatacaaatattagctgggcatggtggcgtgcacctgtagacccagcaacatgggaggctgaggcaggagattcacttgaatctgggaggtggaagttgcagtgagctgagatcgtgccactgcactccagcctgggtgacagagcgagactctgtctcaaaaaaaaacaaaaaacaaaaaacaaaaaaaaacaaacaaaaaaaaacatttaagcaggaactttgcctttgaataagtgcttgatgaattctgacttagaaattgttagctcttaggtaacttttaagatattattcttaagaaaaataaaggattgttttgaagttatttgacaattaaaactttattcccatctcctcgcccaaagatataaatctcttaggactgagagattaggatccttcatttctactttatgagaaaaacaaataatacacagttggggtgaggaataatgcacagttggggagaggaataggcatattgtgccagtatatgtggcttcatgaaaaaactattaacagctgttgttaagctagtctgtagaaagtagagtgagaagaaggcagataggcattttgcaagtgataattttctttaaggaccacttacctaatattaggcctttttaatttttgtgaatattaccaactttgagatcacgaacaagcttgaaacacagtctttagcacacagagtcaattgaacctataattagctgctctttagtgtaacatataaaagttatatgtaacaagtgtaacatacaaaacaaagatgagaaatgtaaagaattttaatgccagtctcaagttgctaagttatttttagaatcgaattcctaaaagttttgctgtttcctgcatgtacctgtaattgttccttgaatctcttcaagagacaggttttccggtttctaaattcttatctgagtagctcagacataaagagatcatgtatatggtatgatgtggtcacctttttatttacgggactttcttagtctaatgtgtgtgaactcttaaatgcatagtgtcttactctgtaacagcaaccagcagttgtgtgttaagatttttcacgaagagtcccagctgttgtaaaaaggaacaatctgccctggctacagattacagtgctttgggtttagactgcaggcaatacctctgggacctgtcatgcacactgtgaacatcagtattcctgggagagagaaggcaaattagtcacttctggctcttagaagttcttgcataacttgctgttatctcagtacaatttcctggggatgctttatcctggcatgtgccccctcctttatcaaaaggaccattgagtattggactgggatgccattgccattgcagagggctggtgttgtttcctcctcttcatcctggatcctcgcattattgtttttgccatgtggggtgtcttggcttcgtctccaccatcacaagagttgcccatctccctctcatacttatgtcaacgacctcccttgcagtaatctagcactacccatgctttctgtagaactgttatatacaaaccattctaatgattccagatttcctcctggcacttcattttctttcctccccttcccagaatcctcttccttatctctggaatatagagctcagatgccaagaggctgcgggaaactaattgagttaggctttttgtttctttctttttccaccctccgtgttccaaagctggatttctcttatgctttggatttttccctgccctcctcctatctgaacagcagctttcagattatgtctggggtgtagtttacactatataagagaaagtggtttataagataaggtagtttatccttttccaattctcacactccttaaatacatctgttgttgattatttcatctggtatgccttgatttttgctttctactttgtttgcatttcattgttcttctctgagattatttctagacttttttgctgagcccccataactctgtttctgattaagtaaacagctttgataagtcacagtggaatcttaacacaaactggcatatgcacaatttacctcttctctccattaagctgcatttcctcctgaagttgaaaagtcagtggagaatagttctaatagcccagcatccttgtattttaaactcttccatcgctgattatattggaaatactggtattccatcaccaaaagctcttacttatcttccagctagttttgaattttctcaagttggtagctcttttttatccaattggtaaaccattcacaggctccaccttggtatgtgaatggacctcccaccctttccttgcattcagcaagaacctgcctgaagtattcattactgtagcgatgagggcacctgctccccaatcattgccaaagagagctgaaaatgcctaaggaatttgccatacttggtttcttacaattcgctcacgtcactcctgccattatcatgtcaaaaatactctttctctgttaaatattaagtttcatttggaaaaaaaaagaatcttgatatgaagttgccatgggacctcactgtgtataggttgatatggatactaatggtaacattaatctcatgaaaattaggtttttgaatttaaaatacatttgtttttgcactgcttgctgtctgttcctcttctcttttagttgactagtaaggagattattttttcagttttaaaataagatattggctgggtgtggtagctcatgcctgtaatcttagcactttgggaggccgagtcaatgggtttcttgagtccaggagtttgaaaccagcctggacaatgtggtgaggcaccccatctctacaaaaaattagccaggcatggtggcccgtgcctgtagtcccagctactcaggaggctgaggtgggaggatcgcttgagtctgggaggcggcagttgcagtgagccgagatcacaccactgcacaccagcctgggtgacagaacaagcctctgtctcaaaaaagtaattaattaattaatttaatttaataagatacataaagatgattttatgctttatcctaaagcaatgttcaggtaagccttgaacaagtggggtcagggatgttgacccaccacacaaaaatacacgcataatttttgactccccaaaaactttattaatagcctgctattgaccagatgcctaccagtaacataaaaggttgattagcatatattttgtgtgttatatgtattatatacagtagtcttaacaataaagtaagctagagaaaagaaattttattaagaaaattataagggggagaaaatagatttactgttaagtggaagtgggtcatcaaaagtcttcatccacatcgtcttcacattgagtagcctgaggaagaagaatgagggggagttcatcttgctgccttaggggcagcagataaattctgactaagtggacctacacagttcaaatccatgttgttcaagggtcaactgtatttagtatagggaaggcctagagcagatgggtttgttctttattctggttatatcacctgacatgttatggctgcccactaacgttttgctttaactatgtgtggcttgggctcttttactcccctcttgaaatatactttgctcttttattagaattcttactgtcaaagaacattccttgaaataatctggaatccatctcactggccacaaaataaatgtaaagtgcacaggcttctagtcgtcctgtttgctctttcaaaatcatttctagtcaggcttaataagtcagttcaggtgttctccatctcttggtaaagtatgtattttcaccgtaaaaaaaatgtgatgttggtatgttatttggcccatgtacagtttttgtttaaaaaagaaagtcaatttcttaagaagccagggggaaacatgtttcaccataaaatatgggcagtggccagttgactatgagtagaattcacttttgctgattactaaagtgacttgccaacctaatagtcatcaaaatagaagccatattagatggctcagatagggtttgaagtagactctcgtctttgtatggggttgtcaatgcatttgttttgtgcctaaaagcacattattcaggaaatgccactggggtgaacactgcctttcatccactttgatacaaaaatcacagattcttaaaatgtgcaaaataagaggaaagccagttgtagatatgtcaccagatttaggctagtttaagcttcttggaaacattttagattttaagtgagctacctaccatgagttatcaaaaattgtaaaataaagttgcttattagtttaagaaccttatagtactattttataccaaagaaatttgcatttatacagaaatacagcagtgatctaactgaatttcctcatttattttttgaggaaactatacttgagtgattcagtgacttttccaaggtgacagagtttgtttatggctaaattgcgattaactgtagacaccacatatttttaccacatcataaaggaaatctgtagtcgattgccacgttaaaggcattaaaaagtaataaattctgtgtgatacattctggcttttcctagcttttccctatatgattccaagtgaactaacgcccttgagaagcctggggctttttctgacacttttttttctttctgagatttttttcacaaaattgtaagcctagggctacattctttcttacataaaaattttggctattattactttggaactacttgccgactgttgacatattcccaatggttgcaaagaatctcagaagaagttggagctgcgcctcagtgtttgtcaacactggccactcttgacagatccaggccccaggtaatgcccgtcttgattatattgtttcagaagtaaagcgcttttggaagaaattaacttgaaacaaacgtgaaagagctccacgccaggggaaagtaaattctgtccactcatctgtttgacagttttgtttatgtacataaaatgtaccacagccatccagatttgaagccatttataatatatggaaattttccctgtaaacagaagtacaactctgatacgataacttttgttttgtttttattgtgagtgggaggcggggaggtagtcaaacaagggatttttctgttgttttctgtctctaaatgtacatgccgagggtggaagacatactgtgaatttagggggttgaatcctgttctcagcagcacttaatcatggagacaggaaagtggctacagatttttgatgaaagattggcctaaattcatcatgtgtctatagcacattactctctgtagcataataaatgcaaatggctgacatgagtattttctgcagattttgctgtggaataggaatgaagtgggaaggaggtttaggggcctgaaggaagaaggaagaggcagtaaaatattcactaatgtttccaggggtgggaatgtttccaaggatggaaaaccacagagtagaaaccagagtaccaagagataatcttttaaaagcataactaaacttcacattaagtcataaaaacattcagtattcttacaatagagtaaggtagagaaaataaaattttaattttaaatattgaaatactttatttttattgaaaatatggtttttagcgggtgtccttacgacaattgttgccttgttaagtccttacagatatccatatgaaagtcacaagaacctttatgttcaaaggtttaacatttttaaaaaggggcatttttttctctttggcattattcacatataaaatacccatttcatatgcatttccattacagcttcctattacttagagaaggttggattaccatctggtcactttctcttcattaggatgacaccagagggatgtgagcagacgggtaggacaggaatctaaaaaccaaaaattgagatgaatatctgacagtttttttgtatttttaaagaggtgctaagatcagaatatttgaactcagaacttttttggaaagtaccacacacacagtcacctaggatatgagctttagactctttctatagacttccatctcctctctctgtatttagccatttcctaaattataggtgccatccgttcattcagcaacagcttattgagtatctaccacttgtttggcactgtggtagttacaaaaccaaattaaacatgacccctgtgttcagggaacttgaggattggttttaaagtagtaaatttttttttaagagtaaatgtctcaaaacctttatgcctaaattgagttcttcaaagcaattaattttgggagggagaagctctacgcttatttcctatttttctgttatgccatcttctaaccctctttatagctgactttttcctcaatttatgtttattaatgtggttaatactttgacttttctctgtcaagtatttgcagagtgggtctaaaggaaatcttaatcccttttggtattacacagacatgtttgaattgtaaactgttaacagtcattgaaaaacagagacctgtatttcaggaattgaaatgaataaattaagatcaacctggaaaaaaggacacatcttgtatgcatcttttaagcaagagccaaaaagggaatgaaaaacacaatgctgctagccactttagcaatctaaaccagaattttgtcatgtttgtttttctctgtccttattaagcttgactatttgaagaaccactttccaaaaaagcactgattcagaccctggaggtaaacgtgttacatgttggtgactgtctctgcatgcatgctcatgtgtctttgtgcccactgataatttatatttttggtcactagatggtgccctttcactttgaatgaaagtgtattttctgttgaggcgtttgctttttattttgcttgttgttctgttgatgcaaagatggtggaaaatcatcttatttcttgatttaagaaaatcacattctctcttaaatcggatacgaggctccctgtccctctatgtatgcataggaattttaatgcgattatccaacctgtaaagtcacacatttgtagattatcataccactcaaaacttactgttaatttgttttgtgggaaaaatacaaatttatcctatagaagcattttgtataatatatataggaccaatacataaatgactacaattgaaatatctatgtggttcaatctgctgtttctgtacttgagttaaccatcacttggaaagccagtgaaatgccagttactgagtcctgaaggcccagaaacctgtattttaacaggcatgttttgagacacattggcttctaatcacccacagtagtagtgaacattttcagtagaggttaacttcattgtcaaccagcagtaactaaaaccaaagttaaggatagttgagagtgaaattttgaaggtagacagctctttaaaacctgattgaaggtagacagcaactggaaaacctgattgaagagggaattaaggaggctagtccccaccctgaggctttggcttggtatctccctctacctggaaggttccagctcagccaagtatcctacctcctttaagcctattgcctagccgagctattatggatgaaataagaattattgaataaaatgatctgtctgtttacataagtgtggtaaaagttggctagagtataacagagaaagggcagtcctggttcttgttaggatgcattagagagcaagcaatgggaatgagatgctgttgggctctctcccaacttgggttggtcagacgccccttgtgccttgctgttaggcccctcatttcataataactgatgcttaacattttggcaagttttaaccactcttaagacctttgaccttcacagtgtccctgtgacaggttaagtgtcaggggagggattacaaaataggataaggaagggtgcttgagaccaagagcagccaccaggagagggtgggggctggaggtggtgacagagactcaaattaggcacagctgctggacatctccccaggaggccagaggcattcctgaactctgaagcttggtgcactgttattaactgtgatttcaccatcctggtcctagcagtgggtagctttaagaaaaatcgtttcctcccttctttccttcctccctcttttttggtgaggggagtggcaattgcccaattgcaacataagaatatgatatgctctctgtggcgttttcacctaggctgtgggatgggggtgggagatcacagtgtcaggggagtatgtgtggtttagataaaatccccacccagtgattctcatgccttatcctagagaatagatgctttaggagttaaaggattcaggcggaactggtggtaaattgtgaaaggtgtgaaaggtgtgaaaggtgctcagtaaacatttactgactctttactgcctggatgcaaagtacaggatataaaagacttagccagtactaactgactttcttagaagtcagtacattgtagacactcagtaaggttgagacatgatcaatggttgtgataatcataatgaattatctctatgttattcagttttatcataaagctgatgggtatagaacttttgacttatcctagaatgatcttgatctgtgtcaaaggctgacctgtaaaataagagaatacctggattgctgggcaacttgaaaacctgattgaagagagaattaaggaggctagtccccaccctgaggctttggctctgatatctccctctacctggaaggttccagtgtcttacctcctttaagcctttactcatatctccttttctctatgaagtctgatactcctcaagactctctcatagctggtacttcctcatctttttgtgttactcttctttttcttttttcataacatgtatgttctgattaattattaattagataatttatttgattaaattatattttgtctctgcagaagagccaagttctttgtggacaggactcttgcttcttcacttatctcttctctctagtccctggaacagtgcctggtacatagtagaagtacagaaaagatttggtgaatgaatgaatgctttcctgtagaaagtttaatggcagtaataaacaatattagtcactcaatactaattctggataaatattgaattaaatattcctgaatgaaagttaaggttttttttctattagccttcactgtggtgatgtcttttaaatgaagttattgcataaagtgtggatccagagttggaagacattggattataatgtccaagcttctgagtggttttctgggagaagttacgaaaccactctgtgctttagtttcctctgtaaacaacgtcatgaatctgtgctgtggattaagtgaattgatgcacttcaacccttagaacagggcggagacttgtagcagaagctcaattaataaatccaatttataaaaaaaaattatatgatatttttattttgcaattacgtgatatacttattttgtaaaaagaaatgtaaatttaaatggtttagccaattttaaggaagaaagtcacagataaatgaaaacgtgggcattttccatattcctgttgttgttacaataacacacctagaattttattataataataatctccaaatgttgagtttattatggaacctcttatgttctagagtcaattttaaaacagagtttttaaaacaattttaaacagagtttgggagtttcacacaagccttttatttctttcttatagatccccatattaaggtttctggaaagaaagaagatgttaaagaagccaaggaaatgatcatgtctgtcttagacacaaaagtaagtgaatgttaaggacactcagatgtcagaaccttgtctctacaagggctacttcatgccgttatgaaagaaccatttggagaagaaaaaccaggagaaagtaatggtgggttttaaaataagcacatgtgattctacagtggatgtaaagttctgtttaatatttgaataggttctttcatgctgagtaattgaactatacatacacacacacacacctatatgtacctacatctacatacatatatatgtatcgtgtatgtatgtgtatatatgtatacatgtacatatataccatcttcagaaatagaaattggccctgattaatatagggtaagtaataaggattgtaggaattagattatttgcttttatgatgtcagtagaataccagaatgatcttctatatagctctgtgttgggtgtgtgtaatggcatgaaatttgttgcttgcttttgtgtgatcacgtgatgtctctctctctctctctctgtaagtatatgtatagagagagaacagggaaatttcaatatgtaaaaatttatactcatttgtgagaatttattttctttaacaaacacatctaaatcacttattgtataccaggcacttcgctaagtactctacattttacacttattaatttgtttgatcctcgtaactgactcagcacaaaggtattaagtaatttgttcaggaccctagagccggttaagtggagaggtgggattcaaatccaggctgtctcattcttaaccactttgtcttgccacctggcatttcattagaatgatctccctctgatcgctttcttgttttcattcttcctttctgttctttgttggttttcttcgtttttaaaaaaattactcccctgataattattaaatagtttagaattttcttcaggaaagggggatttttttgtgttttaaaggttaaactgaaagaactaaacttaaaaatcaaaatatatttaatgggcataaatttaaaacttaagaattcacaaggtataaaaatatttttgacatattttgatatttcgattttactttttaaagactgaataatttcagtaacagtcttctaaatgagaagggattttatgccagtctttatgattgtacagcactaaattcctcaaatatagtccaatatgaccacagcatttttatttattatgtcttagaattttacattttgctttaatataactaatgtactttgaatttctttatttaagccattttgtgaccagttatctgcactttatgatctctttctcccttctttctaccagcaagagtaatagatctactttgtaaagttcaatatatagtaatacaggagttgggaaagcagtgattctaaaaactttcttattcacagttttgagctttattatttctaattttgtatcatcttagttatgcagtcccactagcatgcatatcttcaatcttgtaattgtgttttcatctgtttttagttatttgaattaaatgtttcgtgaataatgtctttaaagacaaattgagtaatttatttaactgtagctgactttgtttaaagacttctttccaaaaaaattatcttggtaaagaataaatttttctatttcttctgacaaatctttcttaaaatgagaatttctttttttataatcagagaaattaatagcaggagaacacttatagattaagatgatcttattaagaaataagatttcccactgacttgctttttgttaataccattcccttgagggaaagacatttaggaggtcattctttccttttgcatacatcaagtaataatacattattttcacatagagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtggtttgtcttttcacatgaacttttatgggatgaattacagccttaatttaattttcagtttgcctatcttttttttctgagaggtgagacaaaaaaaaaatcacatagatgacatacagtgtagattgtacaactttctgcaaggaaattgaaggtgctttgcttttttgaggagatgagttgtagatgggccctaaactcttgatcttgaaatcattgataaaaaatagcggaagatgtaatggccacaaaacaaaaccttaaagaaaggctgagagagcatatcgtttaggacctggaagcttgcctagtccaggaacctatccattgcctggtagagacctggaagtaaatacctttgtggcacaccagatcaccttctgaggagcagtgcattagtgcctgacttcttacattgccttaattatgtctctctctagtttatacacatttgtgcttgttcttctgtttggcagcaaatggaactcacctgtcctcatgcaagcggtttcagtacttgaagaacagatagtattatttgtgatatttggaagtattctctcttctaaactagttacaatactagaaactgtcagccacaaagatgaatagtcttttctctacagggactaatggtgacagtgggatgtgcacataagggactagacagaaagctatagtaaaaagcaaagacaatattcagaatatttaaaaactggtacggcatgaccattggccctaagaacagtgtcctggagcccctgtaccccccaccacaatgccaagactaacaccttgagtcagtgggtcatgggaatgcccaggagatttcagaagtaagctcgaggtagatgttggagcaatgattgtgtaccatctggtatggaaaatgttcactattttcagaacctagtgtagctctgtcattgaatattgataagtatctggtatgcaaagagcttaaacaaaacggagaaaatgcagtgaacaagagtaattataaagagggcaggatgatctcctgggggctgtggggctttcagtaagtccagtgggtgaaacagatcagttgacacaaattacctgaggatctcgttaaaatgcaaattctgattaagcaggtctggatgggggcctgagatcctttatttttaacaagcttctggataatacctctgtatttgtccctggatgacacttttagtagcaagcatatagatgaactggaaaagagatgtgagtttgattaaaataaatctaactttgtattttcctcctcttataggtatctatagcgggacaaccagcaggagtagaatctgcccgagttagaattcgggtaactatttattactttaacattgtaaattgatgtcagcaacatttgcattataaggcactaaaaatataataatttatcattttataaccgaatcatgttcaatcagtaggaaatagtggcaaaagttattttagtgtctatcttagcattcattatctaaatatttattgtatatgttcaaaaagtgagtttctatgttatttataaaattttttcactgaaaatgtttctcagagatgttctggattttatctgactcagtttttctagtttttattcaatgatcataaagaggcctaaggaaaaatgccacaggcaatgtgagttagaaactctcaggtttcacaaaaggctcccatcatttaaaaacacttgtaggccagttgtggtggctcacacctgtaatcccagcactttgggaggccaaggcaggaggatcacttgaggcctggagttcgtgaccagcctggacaacatagcaagaccctgtctgtctctacaaaacatttttaaaaattagccaggtatggtggcacatgcctgtagtgccactaattcaggaagccaaggtgagaggatccttgagcccaggaggtggaggctgtagtgagctgggatgataccactgcatgccagcctgggtgacggagcaagactctgactcaaaaaacagaaaggaaaaaaaaaaactttatataatgtagctaaacttaatatctataagggcagtttatgctttaaaatctatcttcagaaaagaaccaatgaatgatacacatgtctgaatgtctaatgctttaactctctgctttggattctcatcatttcattttaggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggtaaattattcagataattctgcacatcctatatgtacaagttacatgagtttcatttttaaagaatattagactaatttgatttccagaattttccttcgttctacattttggtttgcagaatatgctgtatttttccatagctgttagaaatgcaatagaatctttccccgtatatgaacagttaatgtataggattatttctttcccacccttttctcttaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatggtaaggttactgaaataagtgttacaatttttttaaacctctttggattcagtgcatgtttttccatccactgtactaatgtgatatttaggaaagcacttcggaagcctcgtcaaataaggaagtttcttgctaaaaggaaataaactggaagagtaataaggttcatagtgcctcaacaggtttaatttcattgcatatgtaattttatttcagtgttttctttttaacttagactaaacacagaagagaattatagtgaaataattgactgcattttgtggcaaggatggaaggtgactgttttcatctgacctgtaatattagtgtgcagtttgtatttggcaaaaaaaaaaaaagtcctctgtttaaacagaaaagtaaaaatactatttaaatttcaccatcaaagacaaattttgtcagcccaaaacatttgtacatttcataaatctttgatccaattaaaaaatactatttaagtcacaaattcgagcgtcacttattgaaggaagaaaagcaaagttatatattataattcaatactactttactacttctaatttataattgcaatatttctatccttcccatatttgtttaaaacccctcggccaggtgcggtacctcatgcctgtaatcccagcactttgggaggccaaggtgggcagatcacttgaggtcaaaatcaagaccagcctggccaacatagtgaaaccccatttctactaaaaatataaaaattagccaatgcggtggcaggtgcctgtaatcccagttactcaggaggctgagggaggagaattgcttgaacccagaaagcagaggttgcagtaagcccagatggcaccactgcactgcatttcaaaaatgaaataaatgaaatggaatgaaataaactatcccagtgtatgggttgataatgtagtaacaaaatggatggacatgatgctgggcttacaaatatttgtattaaaaacaccattgtattctctcattcagtgcttgacctttagtggcatttgaatcagtaagcctcaggtgtgacatttactattattaacttgcagagtttatttttgagaaactttcagaaaatctaagtttttattgttgattccattcctctgacagacaagaacttgttggaatcagtaagattgtaatccacgattttaagaaatttgtcatgattttttttagccgagcttattttatcaggttatttttaatatactgtactacaagtcagatttatatttatatccaagaattgttgtaatcttcattttttttctgctttacaagttctttagatgttattttttagtttagtgaaatttttcaaatattctctacagttattaatgcacatttatactttgaccatacctgccaaaaataatgactcatattattgcacaacattgaaataactgaaggagaaattaaaaggctttaacccgtattttaaataccatcaccattttgtatagcactattcttataaaaatcacttcctggctgggcgcggtggcttacacctgtaatcccaacactttgggaggccgaggcaggcgtatcacaaggtcaggagttcaagaccagcctggccaatatggtgaaaccccatctctactaaaaatacacagaaaagttagccgggcatagtggtgaaggtctgtaatcccagctactcaagaggctgagacaggagaattgctcaaaccgcggaggtggaggttgcggtgagccgagatcgcgccactgcactccagcctgggtgacagagcaagactccgtttaaaaaaaaaaatcaatttcttccacaggagaaatggagcatagtattttatttctttttctttttttagtttaggtgaggtcttactctgttgctcaggctggagtgtagtagtgtgttctcagctcactgcaatctctgcctcctgggttgaagtgattctcatgcctcagcctcccgagtagctgagattacagtcatatgccaccatgcctggctaatttttttagttttagtagagatggggtttcactatgttggccaggctgatcttgcactcttggcctcaagtgatccacccacctaagcctcccaaagtgctgggattacaggcatgagccatggttcccggcttagtaattcattttaatcctagtgtgcttaatggtaacctctcctgatatccatttacaaattccagcacccagtgggctaacactggaaattctgtgcatcagagaaagtatattacattgttcctagactcagtagatcagaggctgtgagtagagcattagagaaaaaaaaaaaatctaaaaaatgaggtagttaaaagaagggacagtagtaacaatttactccaggaaggaggaaaggtttaaactgcattaggttaagtaggatttatattggtgaagaagcttttgatgagttaaggcaggggtcctcaatccccgggacaaggaccggaccaatactggtcagtggtctgttaggaactaggccacacagcaggaggaaagcaagggaagcttcatctgtattaacagaggcttcccatcactcacatgaccgcctgagctccacctcctgtgagattagcagtggcataagattctcataggggcatgaaccctattgtgaaccgtgcatgcaagagatttaggttgcatgctccttaggagaatctaatgcctgatgatctgtcactgtctcccatcacctccagatgggaccgtctagttgcaggaaaacaagctcagggctcccactgattttacattatggtgagttgtataattatttaattatatattacaatgtgataataatagtaataaagtgccgaataaatgtaatgtgcttgaatcatctgaaaccatcccccttccctccccctcccctggtccatgaaaaaattgtcttctgtgaaactggtctgtggtaccagaaaggttggggacccctgagttaagataccaaagtacaagatcctcttaaaggatcgttgggaggctggcctaacctggaggaaggggaagacatacagatataaatctgtggttgaacaagcaagtctgggctaaaatgtggaactctttaaatgctcgatcatgtttagttttcattcaaaatacaatcaaaagctgccactggaagtcattgagcaaaggcaaagattagtacccttgatatagtcgagaatctagtttctagcataacttaacaaaactgaagttagagaataaaggaattttccaaggtgcacagtggataaaaaaagtccggggccaaaaacagaaacttaagacatataatttcgtcatccaaaaatggttttctccccctcaacgttaatgccacacctgtcctctaagctatgtgaacttatataattcagctttaatacttcagtttagtctttaaatctgtaaaatagtgcattatttgcaggcatgttaaattatcaggtgtttaaatgattaaatttttacctcctacacattctattgtgacattttctagggttgtcttcctcttgtgttgatgtttgatatgaaggaagaaattgaagtagatccacaattcattgcgcagttgatggaacagcttgatgtcttcatcagtattaaaccaaagcccaaacagccaagcaaggttggttcagagtctgaatccagagaattatgtatcatatcatatgctgtatagttttattttgcatagaagtatttatttgcatatacatgaaactgttactctatacaggttgaatatccccaatccggaatgctccaaaagctgaatcttttttagcactgacatgacagtcaaaggaaatgctcattggagcattttagattttggattttcatattagggatgcccaaccagtgcagatattcccaaatcccccaaaaccccaaatctaaaacacttctggtcccaggcatttcagataagggaaactcaacttgtataatatatatgtcattatatatttagttatctaatataaatttgtaacagtattcattatagatcatcattttctttatatatgtgttggtttttgcagtccatttagagtaaccattatttttccatagttaaatgagaaggaaagaacatttgttcttaatttagaatctggtaacttgaagcttttctaagttacccaagagttgataaggctacttacatgttttgtgtgtgtgtgtgtgtgtgtgtgtgtgtgtgtgtgtgtgtgtgtacatgcccagtgtaattcagaaattgtttagactacttactatatgccatctcctgcgcaagctggagagttaaagaagaggtgcctgtgcttttttgtaaatactttaaggactgaactgtctcaagttcagcgttcttggaatctctcctcagagtgttgtaaaatttcagtaactacatgtagagtaaaaatttaatggaataaatgttttttttttttttctgagacagggtctcactttatcaccaaggctggagtacagtggtgtgatcgtggcttactgcagcctcgacttcctgagctcaggtggttctcccacctcagcctcccgagtagctgggaccacaggcatgtgccaccacacctggctaatgttttgtactttttgtagaaatggggtttggccatgttgcccaggctggtcttgaactcctgcgctcaagcaatccacccaccacagcctcccaaagtgctgggattacaggtgtgagtcactgtctccggctcagaataaatcttttattaagtgctagtaagaatgaggaaagaggaatgtttctacattagtattgttgtttaaactagcacagccactttgaagagcgatttctgatcatcgcattattctaagatattgattaccctacctgcagtagttctacttctgattatacactctgaaaacacctttgcaccaagagacaacacgagaatggtgttgagtaaaaaaagtatattgcatcgtagtatgtagtcaatggcagcatttttgtgtatatatatgtctgtacatttttaagtataaagcattgtttagaaggatgcacacaaaaatcatgatgagttgcctttggggcaatagaaaggaaaatggaacaaagtaaacaagggagatgttctatttatttaacaaaaatccgaaataagaaaataacaccatttttaaattttgaaactataaatcttatatgcatagaatggtgtatatataatatgtattttatataatttggtatatgtaaataatgtggtaatcgctgtccaactgaagaaaaatgatcttgccttctcccaaagaaaactttaaaggaaaagatagcattgattctaagtgaacttgatataattagtttaaagttagggaacaggacattaattttatgtatcgtgaagcttcatgtgtgactaatttgagttgaccagagtcactgtagataccaggactaaaagataaagacaggagagacattagagggcttgtgcatattaagatggacagtcagaagaattccaggagttcagtaagaaatgagcagaagtcagggaaaaatagattgtaaatgagaactccagagccttgcagcatcccagggccatttaattatgcccagctggcccacattctaactactgctttaactgctttctcagccacaattttttttttttttggtccattgagggctttcccctttgagttcacatttcaaattttcttgatgagtccattgtgaaagaaaaatgatttattatttagaattttttttaccataagctttgccatagatatgtcaccaatgagggatagtcatacctcaaggtctattagctaactagtaaaccataaatgtcaaacataagtgatgatgatgatgcagtttatatgtggtcacaagtttgatttggtatgtaatgacaagatgcaagggggaagctttagtgtaaagatgaggggctgtaaaaagggaacccaggttcccatcctcttgctgtctcttcacagctgtgccttgacctgggctaagtcccttaacttcactgaatatgagtaatgattcccaccctataaggttttgctgagaataggaacatatatgcagctactatcacagctcctggaacccagaacatgcccaataaatggtaaccaataatttagggttttgccagaaggagtaatcttaagcacgaagtggttagaatttgcagatgatttaaaagcagcattgatatgtcccctgagtggaattcttattagcgtattcattttccacctccctcccctcccccattcattgtagactacttgcatgtcaccttttttcccccattatgtgttttcatagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtatacaatttattattacagcgcgtctcagtcactggggaaatgcttgtctggttccctttctttctaccattcgggtctacatttaaaggctatttttttttcctttgggctctaagatcagatgaaaagccatacaacctgaatcaatccattttggggtttcttagtctctgtggatttgttacccagattcttcccatgtttgcataaataatcaaggtctgactattttattttcggtggctgtgtttgttctaaattaagaatgccattgagattgaagtaagcatgctgactgtaatttatgtttgttctctcctgcatttgcaatattgtcttcagtccctagagataaagattatccagtttgctttttaaaaagtaattgcaaatctgtatgaggggtggggaggggggtgaaaataagcagaacccgcatctccagtggttaggcctgccttgcctagatacaaaggaaatctagtcagaggccagacctgtatttctgtctaacgtgaggaatagaaaatagaagaatgaacaaacgtcatcatctcagagcttcagtcgagaaagtagaatgagctgtttaatagtcatggtgatatttatgtcctcatctatggattgctattttataggctgaagttaattgctgtattacagttttgctagatttatttctttcctgcacatttctcagttgcatttattttccttaatcagtactcctagaaaatcatcctgggtcattcagtgttgatttgagacaaaaaagaatactctcagcagtctttaaaattttttttccaatagctattcttgcagtctttaaaattttttttccaatagctattcttgcttttaacttttaagaagtttaatgctcttatatgattgattttccaagtagccctgcctagacatcattaaagaaagattttttttgtatcttggcccctaatctaccaaagttgttccttccactgggacctgaacagagtcataacaacatagcaatgactgtgagtcaggaaatgccaattaggtaacttagcaggaacctagttcatcctgcactacagagaaaacaagtgagcaaagattcactaactgaatttttaaaatgttttcattgctatacctatcctgttatatactttatgctttatatgtattcctggaaacttgtatacaaatccacatttcattctagaacatattttaaatgcccaaaggaaaatttcattatttaaatcaagcattgactccttagaacaacaacaacaacaaccaaaaaaaaacagtatttttttctgaggaaattttcatcattgagatggagcccagggaagtcatgtatatgttttgagatacatttaggaactgttctggtagcctaccctatctgcagcggggacaaatagatctatcctaccacaggaaagcattccctagtcgctgctacatgtgagtagtttgaaaagggtttgtttgtaagcagatgacaaatgagttatgcagaagaataaaaatgagtttccacttgagcagaattttgttcatcctgggtagctgacatgaatgcaagcacctggtgatgttcaatgaccctaactgccatcctggtctgggcacacctatcttccattttctgatagcaactctttgtggataagctgcttcctctgttggagctgtatgatgcaaaactcatgtgagtatttgaaagaaaatctgtcatccatattttatatttagaaaatatcagattatatcattgtgcattcccaatggcaatattggtgccatctctattttaaaatcttaaatttatgtgaattgactttatatattcatttattacaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtcagtatcatttaagtatattccaagttgtgtattcttaggtgttaccagttttttaaataaaatttacgaagggctcagttttcttaaggcaaaattagggttcaaagcatactccattgaaacagaaattccctgatatgtaaattagttaaaatgaagaacagcaaagcagtttgagtttttcatacaactgaaataccatcttcaaatgtgataaacagacctggtagttaggttctagttggagtaacttgctggtagtcatttacatctgtacaatgagagggttggattaaatattctctatgatattgtccgattttaacactcttttgtgtttttatagtaaatagtacctctgtttacagaggtgtcaaaattgaattcttttctgaacttgcagcaacaaaaatgatatttttattgttaataaaaataatagttgaatctgagtttcttcctaatatctgtcatcataaaatgttgttgtaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacaggtaatggccttctgccagaatgtgtgtgtgatctgtactgtttgtaagagacaaacccctggtaaagttaaaacatgctagaatgtgtgtgtgtgatctctgctgtttgtaagagataaacccctggtaaagttaaaacatgtttaaactttcacctaaaatgaattttatttatttttttcaacttttattttaggtttagggggcacatatgcaggtttgttacatggggaaattgcatatttaaccaatcttgagttaatttttatatatggtgaaaggtaggggtctggtttcattcttctgtatatggctagccagttttcccagcgccagttattgaacatggattcctttccgtattgcttgttattgtcgactctattgaagatcagatggttgtaggtgtgcagctttatttctggattctctattccgttcccttggtctatatttctattttttttttatgccagtaccatgctgtttggtttctgtagcctcgtagtatagtttgaagtcaggtagtatgatgcctctagctttattctttttgcttaagattgctttggctatttgggctcttgtttagttccatatgagttttagaatagttttttctatttctgggaaaaattatgtttgtagtgtgataggaatagcattgaatctgtatattactttgggcagtatggccagtttaatgatattgattctcctgatccctgagaatgggatgtttttccatttgtttgtatcacctacaatttctttcagcagtgttttgtagttctccttgtagatatatttcatctccttagttagaagtattccagggtggttttctttttcgtggctgttataaatgggattgtgttcttgatttgactctctgtaaaattgtgaccatatttatacattattttctattattattttagtctccagatataaaatatggtgcaatatccacttcatcacttggagaaaaagtgctgagtgcaaatcacggggatccgtccatccagacaagtgggtctgagcagacatctcccaaatcaagccccactgaaggtcgggaactgtacccttctgaaattcattttggttgttatttggaaaaaggaggttgtagagagtctatgcagtgatttttgagttggttttgctaaacagctatcattcatcctacctcaattatgtggaaagacaacatcctgaataaaatttcaaagagcatggtgaaagattaactgaaaagcactttccacagaaataatcatttccccattacattgtaagttcctgaattaaagtgaaggtaattgtgcagcagaaaagcatcaacttactaaatgttatatatatagttcccccaagtagagtatctttttataacctttttacccaccccctgccccaccaaatctttaaaatatatgcgggtcttctcttcaaattgagtttttgtgacaacctgaacttgttaaggtgtttctttgcagatggaagaggtctctgtcaggttaatcatgtctccatagagtagggttctgatttgtttccattgcagataattgtcaactggaaggtgatgttgtttaggtgtttcacttttttttccttttcctctgcaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacagtatgtattttaatctttaaagagcccttgatattttgaaatgatatatatttgttctcaactctatagttagtactctttgattcaagtcatgtttgatctcatccatgggtgttttcattttaacttttttaaaaaaaatattaaggaataatatctgttaattttcacccttctctgtcttctctatagtcccttccccatttaatgaattgatttatatctgtgtcctctaaaccgtctgtattactctgaaactgtagcattctctctgctcttcagtaatcagcagggccatttttattctctgatttttgctgttagaaattttcccactgtgaattctccttcatttggctttgaatttctttcttactgtggctctcttttttcccaaggtagttaattgcaaacttttaaataaatgcttgacattatcatgactttgtttattccaaatcactttggttataaatacataagttgtattaaatattaaatataactcttccttaccatagcacagttaaagtatgtcatccttactctttttttttttcctccatgtattttggacagtctctacaatgtaaggttttgttcccacctattccgtccacctgatttcctctgctgtcttattagttcctggtatacccttctagagtgtctttatgcaaagattagcgtacatggttttatttcctcccattcttattaaaatccattttcctttataaactctttggtcaatcattattacccaccgttgtccagttctcctttatctgtgtttttctttacatggagctaatacccaaaattaatgttctcattataggctagagaaacagttttacttccttgaaactattgaagcatttaaaatagatacgtattcttgtcatcactgagtatgtcctgaaccttcttatcatcatcttttggcttaagctgcagcctccagaaaggtctccctgcctccagtcttttattagcttgatctatcctttattttgcttcagcaatttactttcgaaaacaggtctaatcttgtcacactctggcttcaaatcaccaatggtctgtgttgcctgcttcctttcctttacttatgctcttccctctgagttgctgttctcctgacctttggcaccagacaacttgcagatgctcttaagttcccaggtcaaatgtcctttgtgtagcctctgtcaacttttgtcaagcaaagttcattgtccctctttttgtattccccaagtacttttctaaattcctctaaattcccttggcacagcagctgagtagttgaacaaataaaatcatgaatgaataaacaaaacagtacttgattgatattgcaatccctattttgagcctaaggtgcagttagatttgaacttgtggtgcatgcattctgtacatatcatgtgttgtaattcacatatttgctgctctaagaagcacttttacgctctgcctgtccccctcaacagactttgaagaatatttcttatttatctgctacattttatttgttaccatcatatacatatttcatacacacgaattggatcatctacatcccttcaaattgactggatctctgtttggactttgcatggatgaatcattgatatctccttgatgtataaaaattagaaatctcatctgtacatctattccacctatatcatatgcagtataccatatatactatatatactgtgtttgaatgtgcatcatgaaatagtttcaagctttagccctacagtcagagtgcccaatttcaaattccatctctaccattcacattagaggtatgaccttggacaatatacttccttcatccacaaagtggggataacagtagtacctgtgtcatagcattgttgtgaggattaaatgagagactacgtgtaaatagctgatgatgataaacatgcatagtaaatgtggcatgtaggaaacattcagtacatttgtatatatagtggagtgttaaattccacactcttatttcacagcagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggtaatggtaataaaataggaaagccactcaaatgtcatatgtttgggttctggtatggagaattcagtgagtgttcagcagtagtgcagaaattaggttttccttctgtgctacattcaaaatgaaatttaaatatatatgtagcagttagtttgctataaacattaaaaatgaaaagcagtatttaccttaagtgagaattctttaaaatatattaaaaatggtgcagaatggtctgtgtcactgtcttatgcaaataacattattcatgtgttacttaaaaaattttcagatgagtttgcgggactgcatttctaagtattcttgcttcatgacatagtcttggataaatagatatactattttctatgtaatgaagatgatgaatgtgtttggtgccatttaaagatagttatgagaataacgaatgtggagtgttctttgaaactagatgatgaatattattgatgattgtgttggttcacagattttttatgattataaaaacaacttcctttaaataatttttatgattaaacaacttcctcaataggaactttctgtgtttccattttcaaactattagtctaattactcagaatagactattgaccatgaaaatgcagaaattatagatgacaatatgaaagataaggatttgtgctttgtgcttttagagatgcctacaagcatttgatgtcagaccagaattgctgagtagacttacctgttttatctttcaccaccaaaaaagaggaagaacgttccacaaaatcctagaaacagaaaagctgtcatagatgtgtcaaagaaattaattcatggagctaaactatattactttaattccagtgcaatctgcagtttagtcctccttctctatttttttaatcctttgcattggaacattttcctaagtttttcgatgaatttttttttaaataaaagctatggcctttataatgtgtcagtgtttaaaaaagacatttaaggccgggcacagtggctcacacctatattctcagcactttcagaggccgaggcaggtggattgcttgagtcctggagtttgagaccagcctggacaacgtggcaaaaccccatctctacagaataattctaaaaaattagcagggcgtggtggcatgcacctgtagtcccagctacttggaggccgaggtgggaggatcacctgagcctgggaggcagaggttgctgtgagccaagattgcaccactgcactctagcctgggagagagagcgagaccctgtctcaaaaattaaaaataaataaaataaaaaagacatttattacattttctctggtggatgtattttcagttaatatgaattacaatttatttaacaaatatcaaatcccctttataatcttttgatggtttttgtcttgtggttcttgtcaccttttccatcagatttatacctgcagtgaaccagtttcttgtttctttcttttaggatggatgagcatgttcttaatgtttgagtttcagcctaactcgatgtatttatgttgttagtgaacagttgactcttaataaatcactaagaaatcaatgataatattcactgagcattgacagggagaaagattgaaaacttggcctgatttccttggctgaaaatgatctgtatctcctgattgctcttggagtgctatatccccagctctctttttatgcttatctcagtttctaatttattttatagttatttctttttcccaaccctcctaagactgcaagtcagccaggcatggtggctcacacctgtaatcccagaactttgggaagccagggtgggcagatcacctgaggtcaggagttcgagaccagcctggccaacatggcgaaaccctgtcactactaaaaatacaaaaattagcccagcttggtggtgggcgcctgtagtctcagctacttgggaggccgagatagaagaatcacttgaacccaagaggtggaggttgcagtgacctgagattgcaccactgcactccagcctgggcaacagagcgagactctgtctaaaaaacaaacaaacaaacaaacaaaaaaactgcaagtcatcgaggctgtagcttatttttgattagttgttgtattcttccacaaagctgagcatagtctctttaaccagtaggccctcaatgaatatttgttgaacaagtaaatttaggttctccgtataccttgcctttaggcattaataattaaaaattgattttaactcccaatgccattttagtcctaggatttaaaaacttcatcaaaaatattatctaaaaatctggctttcctgacacatggctatgtttttagttatcacatgtccttgtttgtctgggacagcctctatttacttttattatcttggcctaattgttattcacagcacatttcaccttcagaaatgtcctgtttcagaccacagattatataggtaccttatatatgatggtatagtctttctggttaaagagctcttgccaattggcccttggtccttgtggtaggcctttgagacatgcttagatcaagtcttagctatttcctaaattggggagttgataacactcagaaaagatttgaaatgtagctgtatctgcactactttcttcaaaatgatctatcttagtcctcacatacacttgactacatcgtagttactcattcagttttaatggaatgaatcaatggtgctatcctagccctgtgcaataaacagtaactaggtttaattttatggcattgcttaatgtcattataaattaaagttagacatctgccatttatctcacatctcacttcaaaagcaaagactatgccagttaggttaaataatttcttaaggtatcttgacatcataccacttcaggccacgcttacctaaatgaagaggggatttttgagaccctaagggggccaatagatacatgacagcattttggaaatgtatactttcaaaacccacattattattattaggctgttcactatattctagcagacattggctctggtgtgctaggtatttatggtaaataagatttttttttctttttttaaggaaaaattctaactcttaaagtcaaccttaaagtcagaagtggtgatttattattactaattaattagtgttggaaacatgtttaaacttacagacataccttggatttctgtggcattattgtgcaaagcttggtgtatgtctcaggcagattcatggaacacagtcaaaacctttgttctctaaccatggagtgttggcatgacatttggagagactgtcaataaaggtattttctgtttcattttcaggcatttgactatgaacagaagaagctattagccaccaaaggtatgtaatacactaataacttacacttgactatattttagtacactcataaatgttttttgagtactcatggtgaatcgagaacttgaaaactcagaaaaagaaacctagaatatttgggttcaagttgcatacattctgttgaatatattttgttgaatggtttagcattagaccaattaagaaatcatttagcattttttcatttatcattacttggataaaatatttcattaagatatttttagacattttgtgttaagaaataacattcagtgataatttcttcacatatatcaaagaaacgacacttatcatcagtattttattgaagaaatgcattaaacataccaagcattggttttattttgtttccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgaggtttgtagagtcatgtcctactcattcttcctgtctgttctttcagcaaaagaggacagtccttcccccaccctcattctttatgtacctaagggaaaatgattagtggtgacttgtttttatttctattcttgtaaacacactgttataaaactgatgcactcttgtgtattatgatcttttatctgtattctctcaaagttgttggtcagctcttaaagagatgtaaatttggatgtgagtttttgttgagtgtgggatgtgtcataaatgataagcgtagggctgagattaagcaaaagggagatgtaatatttcataaaaatgtctaaagagtcctattatccaagggtttcactagcaaggtcacgatgggggaaaaggcaaatattcaacaaaaataggttttcagatatgagttaaaaattcagtgtgctcagatgtgccaagaacacagcaagaagtatctgaaacaagtgctccaaaatttttatgtttcccagatgttggctgccctgctcagggtgagactgggaagctggcattcctaccatatggaagggatggagagttccatactccacagccaggctacacgcgattcaccaagcaggccttttccatttcaaagtatcagattttggctctaagcctttgggagtcggggtgggtctagagagagcgtgcacacatacacaatgctgggagactgtacacacccaaacatggatgaaaatgattaatccaggagtcacagtgttcaaccagagagagcactgtaggccaaaaaacaaacactggttaagggtttcataattgttagtctaataactagcatttgtagattgaccttttctccacccatttgctttgtaataaattaggctattgatgaaacacaaaagcaaacatgctgctttttttttttttgtctcttttgagtaagtgaaaaagaaaatactattgaaatactaaaagagtctcctgtgaatttcattttgggagttatagtagcaacatggcaggctgtgttttaaagattgaagttaccttcagcagcagaatgtaggaaccattatgaaaaatgttgaggctctaggaggtacactcttctttcttccattataacacagagagaaaataaacatctccttttgttaacagagaccataaaactgctgtgctcattcttagagtttcacctgatgtacggtatggctattcctttcagcccatccttgcttttgacggagtgaagtgtgccagattgttgactgtgttcctatagtttcaaagatgaagtatttgctttagaaatgctcattcagttctgctttctaagaccaacagtaggacaagttgaaaatgatgttcatttcggtaatggagtggtcaagttcagggttctgataaccacctctgaccagatgtatagctttggtgagggacttcactcatctgagctgtgtctcattcaggttgtgctgagaagggcattggagagggcatccagtgattagcatgatgtgttgtcagttcttagtgatatttaaaaaaaatttttttttttttttgacgtggagtctcactcaacccccctaagctgcagtgcagtggcacgatctcggctcacggcaaccaccatctcctgggttcaggcaattctcccatctcagcctcccgagtagctgggattacagacacccaccatcatgcccagctaatttttgtatttgagtagagacagagtttcaccatgttgaccaggctggtcttgagctcctgacctcaggtgatctgcccacctcgacctcccaaagtgctaggattacaggtgtgagccgccatgcctggcctagtgatattttaaaaaattttactttattaagagtctcactctgtcacacaggctggagtgcaatggcaggatctcgcctcactgcaacctgtgcctcccaggttcaagcatttctcttgcctcagcctcccaagtagatgggattacaggcatgcgccacaacgctcagctaagttttgtatttttttttttcttttttagtagacacagggtttcaccatgttggccaggctggtctcaaactcctgacctcaagtgatctgcccgcctcggtgtcccagtgttgggattacaggtgtgaggttcttttaagttttttacatttttttcatttttaaattttaatctatatacttatttattttgagaccaggttatgagactggctagtctttgtatttttggtagagtcgtggtttcaccatgtcgccaaggctggtctcaaactgctgggctcaagcaatccacctgcctcagcctcccaaagtgctgggattacaggagtgagctaccacgcctggccagttcttactgatattgagtggctattattatttccagtggaggacttactttatcctgaagaaaaccaagggcttgctgaaagatgagattatgtttatgaatgctcactggtggaaatatttctgcacactcaagctagttatgcttttttatattcaaaggaatatcttagggtattatgtgaacacataagaatttaaggtaatagtagtaattatcttaaatcatattcatttagttcacccacaattttattcaatccccacaaactcctagtaaggaaagaggggcccagaatggctaagtgtcttactcaaggttacttatactcctcttcctaatgatttaacccaagagagtccatagcaaagggtggtatgtaactgatctagagccatgttgccatagttttatgaacataagaatcactcggagagcttaataatccagactcttctcctaggatctcactcaaaaggtagggagtgaggaccaggtatctatttgtgttttcagcaagaacctagtataattgtgatgcatgtgtcccacaggaaactctgctgtaaagggatgtaaccctatggggataagggcaggaataggcataggagcccaaaaggctcttctgctccagcacttgcccaaggacaggtagatcacagatcactttctgtgggcagaaatgtgcagggcccctgacaccatggttgaacttcttcctatggcttttcttgctttggctatcttgggctagcctgccccatcatcctggctggtgtttagcagcacattcacattgaaatttgggaggaagggtgggtgagacctgctagattccagcatggacattaaccatgtaatctgcttttcttcactgcctctttaagtgctactaatggaaagatatgatctttttttttttcttttttgtgaatggtgttctagattctccctggtatataagttagacttgagcttttcctcatgtatcccaaattctttgaaatgtaagaaagggcccctcacatagcatggtctgattttctgcagcagtggctgtgtatgtcttttcctttattcttctatagctcagaaggatcagaaatagggcatccagtgagtattgcctctatagattaggaagaggggaagggcctggggaaaagtagagagggagatttttattaaaatagagaccacatctatgcttatggcactaatatttttaagttggagagtagctaaaaacaccttcctttttcttactttttcatttttcaaaagaaaaataaagccaaatgaacaaggagaatgccgatctgtaaaaagagcaagcatgtttgaccaataggtcctgacaggtgagggctgctcactcggtgtgccagggaccaaatgtttcctgctgtagcaactttgcttgaggcaagaatctgatacttcaaactctgtattcaatattattgagaagctcagcttgagcagttttttccagttttagggcagctttgagaaattaatctacttcaaagagatcccttagataagaagcaggcactttgaagctttttttgttttctccaagattctaaattatgaccctgtccccatatattatattgggataccaaaagtcaaacaaaaggctgctttgacctgcagtaactgtgtcacatcaataaagctacaaagaggtttgggattttcttttcctttttgccacccatctcttaaaagcatgagtaatggtcacatattctcggagcaaataaaaacctgcactgagaatcaaaggtggttttaaacttccctagcactgatagtaacgaggttgtctgattattttaaatcttacaaatctaggagtagaaatattaaagatattttatcaaagatatacaaataataaagatactttgattggaaatccagtttttggtctcagaaaacttcatttccctatacccattgccagaagttagtgaaggcgtcccatagttgtagggaaaggagtccttgagattaattcaataattccacaaatactaagcaccttatgtgttccagacacaattttatacactggtaatacagtgtttgaatacaaggttcttactttctcagatggagctttcttgtgggtagaaggaaacataaaacaaacaagaagtcattagtaacaagagtctctgttacatatgaaacagaaccactttagattgggtagtcataaagcagaccttatgagcaaatgacattcaagctaaaacctagatgccaagaaaaggccatgaagatctggggaaagagtagtaggccaagggaacaactggcacgatcaccccagagtcagaaccagccggtgagttcctgaagccgaggtgggtagggtgggggaccatcagcatcagagaagagactggagagaggcagaggctggattatggagcctgtcagtttatggtaaggcacagtggaaatacatcacaggactttacacagaggcatatttgttttaatttgcattttaagaaatcagtcttgttgcttcatggaaaatggattgtagggagataagcaacaagagtagaattaaaatggcccttagggaggcagttgggacattgtggaggtgcatagaagtgagcagacttggggtattaagatgacactgatgaacttgctgagggattggctgtgttgagggaaggaggaaccaaggatgacccttggacttttggctggagcagctgggtgagtagtagagtcactagctgggatataggaattctgaaagaataagtttgaggatagctgatggggatgggtaacaacaacttggtttcaagcacactgagtttaagatgcctatcggacaggaaaatggcagtgtccgactggcacctctgtgattctaaatttcttttcttttcttttcttttttttttttttgagacagagtctcactctgttgcccaggctgaagtgcagtggcatgatcttgctcattgcaacctccgcctcctgggttcaagcaattctcctgcctcagcctcctaagtagctgggattacaggtacgcaccaccacacccagctaatttttgtatttttagtagatatggggtttcaccatgttggccaggctgttcttaaactcctgacctcaggtgattcacccaccttggcctcccaaagtgctggaattacaggtgtgagccactgcacccggcctatgattcttaaatttcaacagagaaatcaaatctggagttagaagtttaggaatcactactgtcattactttttgaaaggacttgagattacttaagaaagtagacagagggaagggaagagatcctaggaccaggtacagggtaatctgacattttagaatgtaaaataggaagatcctccaaaggacacagtgaggtaggtggaaaacttggggcctggggtgtcaggatgccctaaagaaagaaatttttaaaggagggcatagtgagctgtctttatgccattgcaagattgaattaagtaagtttattgaagtgaacagtaaaggattctcttggaattacctaatgaacataatattttgaaagtcagagaatcttgactttaatactctaggtaatagtagggtgtctataatatagtgattaaataaatacaaagatgaataaatgcaagttcagtgcaaattttaaattatttttgtttttattgtggagaatttaaagagataaattactccaggtatgtaatttgttagagagattgtatccttgtttgtttaggggagggtaacacaggggaaatgacagctccccttccaacctcaggctctattagcattttgagaagccagctttgccacatcaccatttctcttacttgtgtaatacaaggcagagaatctttgctctaccaggtggaagatttgctttttggtctccaaaattggaaggagtctcagcatccactcttccaaattttatagaagggattatttatcccggaggctctcagaactctccctcagaatctactccccataatgaaagaaaaagacttcactgtgcaaattaccaagtgtccttggtgctgcagggcaaaggctgtaggcaggttccacagccttcccgagagtcaacactcatgagtaactgcggtggttggcaagagaagtaaacggcagtggtgtaatgtggattcttttctcctcccaccctgaaaaacccacctgattaaatatttccttatctggctttgtctgtttacagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagcgttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtccatgtgtcaagtattctgttatgctctgccttattggatatttcttcccaaacgcctagtgaactgtctgacacctagtaggtaggtgctcagtaaaagtttgtgaaatgaatgcatgaatgggtaatgtacacacatgcatccaggtggtgacaaaaagacaaggacataagaaagtggttgaggccaggcatggcagctctcacctgtaatcccagcactttgggaggtgaaggtgagttgatagcttgagcccaggggtttgagaccagtctgggcaacatagtgagatttcatctctactaaaaaaaaaaaaaaaaaaaacaagaggctgggtgtggtggtatgcatgcgccaatagtcttagcctacgtgggagactgaggtgggaggatcgcttgagcccaggagtttgaggctgcagtgagctgtaattgaaccactgcactacagcctgggtgacagagcgagaccctgtctcaaaaaaaaaaagtggttgagaaaaatgtgattgaattagcatcttagaccattgaagaaagactgtccagcgggtggctactaaaggtgaatagcagggtttgattttgtaaatagacaagatgttgctgaattcgcataaacaggaaaaaattaacttattacagcatgggggttctggcttttagcaaatctggctgagactcagcataagcccattgttttatctacaacagcacccatactcctgggctgtataaacagatgagagctgacattgtcatcacaagatatgccccaatgccttttttcagggtttttgacaaatttggaatcctgaaacatgtagaatatttgaagactccttgaagctaggcaatctagatgagcatggtagacactcagtaacagtcagttgttacgttactatcactcatgtcagctgtattatcaggagtctcagatttgaaaggagtaatcaggttgttggccaagtctaaataagaaagcacggacaactatttcattcctaagtacactgtcaatagtagcctggagacttcccattagttactggctggacgctccaccactgacagtatgatcaagatgagagtcaggctgatgccaggcacagatggaggggtgtaaatgatgtccagtctctagcccaagatacattcatttggtgcttctctttttctatctttatctcctttcccttcatttaacattggataattaaattgactgtactactcagttgaatagaagttcaggattaagatggaggatacattaataaaaaggaatgattaatgaagcacagttatttgggttttgtcactttttttagggtatagggagtttaagagagactatagaaactacaagtagttaagaccaaaaaaaaaaaatttaagtaaaagtacgttataggctactttgaacatttatcactatgaacattttattttcaaacatttgtttttaaaattgttaataatttaacatatgtaagattccttttaaatatgtaatcaatataaaaattattggagatagcttacattctttcttaggttgtacaaaggctttaaaatctgcagtgtattgtgtactgacagagcattttcattcccactaggctcatttcaggtgctcaatagccatgtgtggccaatggctactgtattgaacagcacagttttagataatttctcttaacacccttgtcaaggtcaccaatgtttccattttcctgggcatccctatttataccagttgctgcagcataattctcagtaactcttttactctcgaaaaaaaaagtaaatctatcatttggaccataaattatatgggcagcctttcagccactttgatgtagtcacatcccacatctggtggtcactcaccccaatttgcttatcgcagtccactttgtggctttgtgtcacctttgacccggtacctcaatagtcactcctcctcaaactgtttttatgactttggggcctctgcttcacctttaaatggtggagtgtcccaggactcagtatcttggggtttggttttgggtcctttctctacacattcaccccaagagataaacagcagctatccttaagagaaaaaccttttcaggaaatgccttctgtttgagaatcatagaggacatctcaattgggagatgaaaacaactggagaaagtgatcaatgacacccaaaacagtgcagaacaagattcctagatttggcagacacatggatccccagagtagactagatggatctgattggctttggtcagtgttgtcctccctcacctctttggggatctctcctgaagccacatccttggtgtaagaagacagatttcccacacaggcaagagctcattattggtctgggaggtggaatgcctgcactctgctgaaatctccaaggctgtgtgtgtgtgtgtgtgtgtgtgtgtgtgtgtgtgtgtgtgtgtgtgtgacttacttggcttggttcaatagtccgtcaccagcgcttgcttgtcactgggtctgagagccacagacagtttgttgaaacctttgcccaccaaatcagttgcagaaccaaggaaaagttcagcattgctgtcttaaaagttttccccagagacagatttatttttgtcctaaattaaatccaggaaccccagcatcattcttatcactttatacattactattaatcttggaagtgtgctgttttgtgaccttgctacccagttatattttttagggagcaggatttatgtgttgcaataccatacaattcctttgaccaaaggaaagcacaggtgtagatacagagagccaccctgccatccaacggagcctggacttgtaataactttccatacctttattttgtcccagggatcctttttacagctcctcatttaattcacatccaatcaattttaaacaacaaatgcttctgactactcagggagaatatgatgaatgattattaactacagaggcactgttgctgaatttctgcctcccaagtgtaaccttttaaatgtcaagagcctccctgaaagcaataaccagcatttccttaatggaaagccaatatttcagtaaaggattgctgtatttctacagctactgccctattcagctgaacaatggaagttgaaatatttaggtgattaaaacttttaattaaaccatgttctctctgggcatttacacttcaagcctgtctctcctttgcctttcagcggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagaggtcagtcattatttattttcccaagtatctttgttttgattgtgtgtatgatgacttctagaatgaaatcacttattgacctatgagtatgctttcactgagcatttattcaagtctcatagcttgtccttgctactaagaaaaatgtcatctcatttcttatttagtgcagctagtaaacacgggatagcagaaatagagaaaatcatacttgcagaaaaatgtacaatagctgtctaacagttttagcaataaaacccaatcgatatatagattcctaggaatttttgtagtcacagctcccttaaggtcagcaacaagtctgtatttaacatgatttcattttgaatctgttgttatctttatttgtggcacttaaaagtaaataacagcatctgaaatatctctggctgtttttgactcatcctggtcatgctgaagtctgttcttacagaatatatgtttttttcaacatgttaatttattcattaacttattgtttgggttttacctgaactgagacagaactgagatgtctactgaacaatcatgaccatggattttggtcaaactgattagccatatcctattatgtactggcataaagaaaagaggccccaggcatgattcttcctaacagtgctctcatattactggggcacagctaactcaaagtgtcagaaaattaaaatgtttctatacatttgtgtctttttcaaatcaagacatggtccatgtttgatgctagttggcttaattttatgttagagaacatctgatttagtcagtaatttctaggcacgtgtcagttaataaagaatctatagtttttactaggcactttgtatcataaattcaatgtactgcccatggtccaataaattattaagtttaaatgctgagcatttttgttttttacactgaaagggcaattgttgtgtgtattaaatttcagggtattgattttttttttctgtttcccctacatctgagttagtgttcatttaaccaagaattttctaagctgaataaacctttcataatcagtgcattaaagaatatatctccttattttgtcttgctggttagatgatggtagctggaagcagaagtattttaatgtgtccaggcacagaaggtcaaaaagcaagagattgaatgttaattcaatgatattctgggtttgttttcatctatgtttcctatttgaagaagcatagaaattgtaggtatttcttattccaattactccaagaaggaaaaaaacatgaaagtataaagccagagggacttaatgtaatattttattaactacagcaggggtcagcaaactgtggtctgtaggccaactgcctgattttgtaaagttttattggaacacagccacattcatttgtttacatattgtctatggcttccttccagctataacagcgtagttaagtaactgcaacactgacattgtggcccacaaagcctaaaatatttaccatctggtcctttaagagaaagctggggaacacttgagctgaagaatctctattatagaatttctgaaaacatatctttagaactgtgataaatgatggcctaaggttttctaagacctggatgtaccttccaaatcaaaacaggacaatttaaattatcttcaatatcatttaatgaaaagttttacctgtttatggcatgttgaaatttggtcatctgcttttttcagtgtaggatattttctaatactcagatgtgatttaacaagaatcccccataagtaacttcatgagatttaatttattgtaagcatgttgaagattcatttagcaactttcacaggtgatatatcaacatgcattattactaaccatacctgccaattgtcttatttggtaagcccagtactttatatctatagttatagtgaatgcttacaacagttctgcaagatacagtattgtcaaccctctgtgcccacagctagtaatggcagagtcaggatcgaacccaagtctctttggcttcagaatctgttgtctttctcttcttacacactatctttaaaggaaggtgggggatccttgggcagtttcccttcatgctttgttcctgatgccagacagtgcagttttatagttcctgcaaatacttcttttgtgtccctttcagtgatagtttgctgagttgagccaagtgaactgtagatctgattgtgtctgggaattcttctttcaatcctttcaatcctgtgttgaacacaaaggaagatgccatctgttttattatttagtttcttcttataaagataaagatacacttaaccaatttaaaatcccaacctaagaaatatttttctcttctctgaacagataatgctcttccttttatcagttcacaaaaatggtacaatctttgtgtttcctttcttgctatagttgccgggttgctcagagctaagtcttctgctagaatcatcatttccatttcaccacctttcttaattcttgtttcttaggtttgtgctaccacctttcttttctggaagtaggcagagcataattaataaataagtgtgacaacaagttgatcctacagtgggaaagaaaataagtaattaatacattggttatagattgacctttctacccacagatcgatcttcagacattcctcactctcacagatcaggatctgaaggagctgggaataactacttttggtgccaggaggaaaatgctgcttgcaatttcaggtgaatataaatattcaactcatatgttaaaatctgaataacctctgccagtggtctcagccattgggttgtttctacccattaactgctggcttactaacctaacaccttggttgtggtttcagagggttttcctgtcaacagtgtgacagatcctgagactgtcttactttttcatcaaggcattgcctgaaaacctgccttaacaagggtcatatatgaaaatagatctcttcagaaagatctaaccaaaatcgccctatgcagaacatgagaagttggggagaaagtttaattctcctctttgcagttgtgttaaacagtaatcattacattagtgaataattattcttgattggcagttatgtttcaaatgtttgtgtccttgcacaccgactgagttcattgcactgagaagaaaagaatgctggttgaatctggcagtgttacttgtcttaattcttcttagtcttcccactgtcttaatagaatttatgagtcacaggacatagtatcctgaagatagtcacagaatgaaggaaaataatgtctgtctccctaggccactttctttgtgcatctgttgcatatatattttagaaaatgctctatacgtatttattgggtgccactcatttgaaaggaattgagccagatgatgagtcaggagttggcaaatacatagtaatgaacctcaaaaaagcgtttagaaaaatatgcggaaattttaaggagggaatgggattagtttttgaagacttgccaataaagttcttgaatgtcaagtttatatgtgtcccagtctcagaaagacagacacaccaggggcagaagccaagtgtcatgtgctgcggaaaaatgaatgctttttcagaacactgaatttgcaggctatgcctcagtgaagccagcagttacatccaactggtgaaagtccattccagacaacattcactaatcagatcagcagataaaatttaaaacctcagtggttttccattttattttagcggcatgttgaatgccccacccatcttcccataggaaatctttatctgaagcagatacaggcaaagcagctttgaaataggagtggaaatccagccattgagcttcctggtggcagcctgttaggttcttctgtggatagagttctacactcatcagttttcccagaacttcttctaaaatttcttctcggatatactgtgtgtacccaagaggctctattaatggaactccacagggaaaatgcataattcctgctcataagatcatcttggtatagtggaaagaacactggattcaattaggagatctgggctttacttatgctaagtcatgagtccttgagtgagtttccaaacctctcttggctttggtttgttaatcatgaaggtagattggaatttgtgattgtacaaaggtcaccttccatttctaagatctgtcctttcatgtgatatcatcaggcttagtgaaaatggacaaaacgatagttttattacttgttcttttttaccatctatgataatagagtaatttttaaaatttgttttctgtaaagctcatcctcagggggctatccctagactcaagctaactttaaaagttttcatattattttattaatttgcaaatgaaatttatttgcagtttgaaacgtgattaacttatgcattcaccatacctgtactgttgaaatatgcctgcaggccagcaattttctatcagtgaagtgtgtagtccagagctccataatctttcactagagattcatggaatagcagtgaggatatagtgaaaactaagttcattttttggtgtcccaacccaattctgaattctgtaaagattttagcaacaagcagatagctgtaaatacattcacaggttgtagatagatcatcaatacctttcctctggaatatatcagtatcttttgggggaggtaagatgggaatcagaaaggtttcaagctctctattttaaaaaaataatattttttctaatcatcttctttgtcattctgttgaggttatatagtacttttgcagacttcctctctcagtggggttcaccaggtcctcttgcttttaaagggagtttgagactgactaaaatactttatggctgctctgcacagcataaaggacttgattattttaagaataattttgtcttactttgttgagtgcatttgtttgaacctggtaaattattttctctgaaagcaatacatttttattgagaaaattcttcatcaaaaagcttctttctccagttcaacttatctcataacaaagacatccatttatagtcccagaacattctgtctccctatggatgcagtatagctgggcagtctgaactcacatttgtcttatggttatagattggttaggtccagagtttgcttaaaattcctttttaaattttgtagattttaaacttataatctgagtgattctttcagtataaggttttgttttatttttaatctcaggccaaaatacatttaatgttatagcagtagatgaaatttatctccaatggagatggatcaaagtataaatttgatctctttttccccaaatccactttttttttttttggaaaattcacagatttttctcagaatattttcatgattggtcaaatgtacagggactcagtgaaaggacgcttagcatcctgttgacaggcttcccaccacggcctcaggtagatctaacatttcccgacctattcttttagtttgtgactctgttcagatccgcaacaagatcctgagagctgccaggattgtgtgaaccttggaatttcaaagaaaaaggttggtattttcccaaaccatcccgtaggcttactgaaaaatattagaggagtttgccttatcatttaaacaacaacaacagcaattctaaagtctcttcagtaggacttgaccttgataacctctctggaagatttatctctgtgcatcacatttaaaaacatatgtatgtactctcttagaaactgtatcgattagggttggattcccttgtgatcattttactgtttcaaagatctagctgatgtgtcttttcagaataaagtttttaatatttattttgaaaaactttgtcttcatggcccagttgttgtcatgtgctcagttatacatgttatatatgctaaaggagaatgttgtttggcctcattccttttttttctttgctgtaaagtgggaatgtcttcctgaattgtatgttattcccccgtgagaaaatggaggccgaagatagtccctagcttgaagatgataaaacttttccaggctgtgtacttaaggggattcatttattcttaacgcttctataagtttgcctttaaatatattcaattctgtcttgatttctgaattttgaagtgctgtgtttgtttttaacaagatacatgtattcagcttttaataactgtgtttctggaggaacttgaaacaacagccatctgtatgcatgcctgcatgtgtcttttgcttgtaaagataccttccttgcttcttcagagtgaagctgggtttttctatttaaaaattaaatttggcatgttaaaatagcaaataaagctctgttatctggcatacttggaactatcgatttctcagatttgtattcctgatgccttggttggtcttctctgtccagtgggtcactgaaggccagtgctcagggcattgacctttccatcaagcatgtgaggtttcacctctgtcacttagtacctgtgtgggcaagtgacttagtctattttttcaatcagttttttcacctataaaatggagaatggtaatattatctatcccttaaagaagacttgaatagggcaaaataaatgtaaagtgcttgtcatacaataaggctaatgaatcattgttatttttcttctctcctaagacctatatatgaacaaaagagagatgtctccagtgttgctttgaccatataggggcaggcgtttacattttggaaggcagtggggtaaaatgtgaagggtattggtcatcctccagaacttggccataggagtgtgtctggtcatatggtcatccttaacaccatgcagtctgttacaacctgaatctgtgtcgtcagcattactgtagatggccatatcttacattgtaacttcacaattcaaaaggggattgattgtgtgtgtgtggtttaaaaagtactgagtaccatgcaaatataaggtgaatcactgctctagcccctcaaagagacaactttaagcaaatcagttacataatccctctaatctattttaaactgaataaatttgagggtatttgcatttgtttggtatcaaaaccctaatttccatagtctgatgattctgtgtacttgcatgagtttgtcagaatgagttacatcagtgattttgaggtgggggcggaggttgatgcatactcataaaacaacgtaatctgtttcaattaactttttacctttccagttaataattttagttggcaaaagacaaaccaaaacagtgttttcagagtactctaatttctttaccattcaaatagggcacctcaggttttccctgaaattttagattcaagtatttgttgtttgtgagtattaattttctaagctgatatgatttttttactagattaattttttattcaaagaaacctactcatatgcctctttctaaaactatttctgactcaagaagtatagggttcatgagttggcagagccatgggggctgtggcttaatacagttgacccttgaacaacatggatttgaactgcacaggttcacttatacacagaggtttttcaataaatatattgaaaatatttttggagatttgtgacaacttgaagaaacttccaaactgcatagcctgggaatattgaaaaaatttaagaaaaagctagatatgtcaagaacgcatatgtatgaaatatatacagatactagtgtattttatcatttactaccatacaatatacacatctattataacatgttaaaatttatcaaaacctcacagaccatatatggcaccactggcagcagagagaaatgtaaacagacaaagacattttaaatcataactgcataaaattaactgtgttatatacagtactgctgtaataatttcatagccaccttctgttgctattgcagtgagctcgatgttacaagtatccgcttaaagcactatatgacactaatttccacctgagcaattaatctctccagtaagttgcatataacagttacaagtgatctctcacagttcttgagtatttttcattgtgtttagtacaataccatagaccttgaataacaccgtaggacccacataaagtgccgctaatgctctcaaaagcaaagttatgacatcatgggaaaaagttgaattgcttgatatgtaccacagattgaggtgtgtagctgcatttgcccaccacgtcaagataagtgaatccagcataacaactattgtttaaaaaaaaaaaaggaaaaggaaatttgagaagccattgctgcagctagacctgcagatgcaaaagccttgcactttttgcaaaataccttttttatcttgcattgaaaatgcagcttttagagtgggtgcaggattgttataaaaaagcatacttattgactccatgattcaagaaaaagcaaagtcattatatgacaacttaaagcaaaatgaaggtgaaggatctaaagttggagaaattaatgacaacaaaagatggtatgttaattgtagaaagaggtttggcttaacaaatttgaagataacaggataaggagcttttgtcaaccactagataccacatgagttcccagacacggttaagaaaatcattgaggagaaagactatacacctgaacaggtttttaatgcagatgtaagtgtcctattctggaaaaaaaatgccacaaaggatttttattagtaagaaagaaaggaggccgggtgcggtggctcatgcctgtaatcccagcactttgggaggccaaggcgggtggatcacaagatcaggagatcgagaccatcctggctaacacggtgaaaccttctctctactaaaaatacaaaacaaaaaaaaattagccaggtgtggtggtgggcacctgtagtcccagctactcgggaggctgaggcaggagaatgacatgaacccgggaagcggagcttgcagtgagtggagatcgcactactgcactccagcctgggctatagagcgagactgtcccaaaaagaaaaaagaagaaagagaaacaaacacccgaatttcagacaggaagggataggctgactgctgttttgtgcgaatgcagtcacgtttatgatcaggactgcccttatctataaagctgcccacccttgagccttggagggaaaagattaacaccagccgccagtcttttggttgtagcacaagaaggcatggataacaagaatgttttctctagactgtttccattgatactttttccctgaagtcaggaagtaacttgccagtaaaagactgacttttaaagttcttttgatgttggataatgcccctggccactgaaaaccccatgtgtttaacatcagagtcgtcaaactagttaacttgtctccaaacacaaagtctctaattcagcttctagatcaggtggtcataaggaccttaaaggattgttacacatggtactttatggaaaggattgtcaaggttgtagaagagaacccagatagagaaaacattatgaaaagctggaaggtttacaccattggagatgtcattgttgatacagaaaaagctgtgaagccatcaggcctgaaacaatgaattcctgctggaaaaaaactgtgtccagatgttgtgcacgacttcacagaatttaccatagagccagtcaagaaaatcatgaaagaaattgtggatatggcaaaaaaaataataaataaaggtaaagggtgagtgagggatttcaatatcagatcttggagaaattcaggagctaatagataccacaccagaggaattaatagagatgacttgatggcgatgcatgtttctgaaccagtgccagacgatgaggaagacatagaagaagcagtgccagaaagcaactgatgttagacagtctggcagaagagttccgattattcaagactacttctgatttttttaatgacatggattcttctatgataaaacagtggaagaatgactagtaccatatagaaacatttttaaagaaatgaaaaaagcaaaaatggcagacagaaattatgatgtatttttgtaaagttacaccaaatgtgcctgcctctccttccaccaccactacctattgagcctctactatgcctgaaacagcaagagcaaccccttctcctcctccttctcaacctactcaacgtgaagacaacagggatgaagactttctgatgattcacttgcacttaatgaataagtaaatatattttctcttcctaatgattatcttagtattttctctggctgagtttattgtaaacatgtagtataaaatacatataacatacagaacatgtgttaatcaacttactggtaaggctgctgggcaacagtaggccgttagtaaagttttgggggagtcaaaagttatacatggatttttgactacatgggagcaggaggggtttggtacctcaacctctgcattattcaagggtcagctgttcttcagggtgctcctccaatatccctgtgcttaggtatggggtcttctttttcatatctgactttaataaaactaaatgattgccatgtttgacatgaatgagttcagtagctgtaataattttctgtgccatcagtcatacgtcctttcacgagcttagcttgttctccttgcctctgaaatgacctttggagtaggtcaaactatttaatttggttagagcgttctgagaatggtatatcctccaatacagtttacaaactataatagaaactgtttgctgtcaggagtttatgagttgcaacaaaaactatttgctgtcctttgttctctagactatcaatatgctatctttaataccatactttctagtatttcagaaatgccttgaccatcaactaaaagttttccttttgataccagacttgactttcctcaaaaaacctaccacgtcaccattttctgagctctagtgccatgtcctgtagtatacatagaacttctcttgagctcctaacaattctctctttctctctctagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcatacagaacac

SEQ ID NO: 2316 - DNA, 2520 bp, Homo sapiens
gccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaataaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaagaagaaaaggctgttagttcaagtcctgactcaccataacattaagaaaaatcaggattcccttataaagaaagtgcaatgtctgaggaaatttcaactgtgaaaactacaacatatttactaacatgcatgaattttcttgtttttagaattattcctggactattcagtagccactcagatgctactgtgtgaaagggccataaatgttgcctgctgcttgaacatctatttttttctcttccagtgcttgataactctgggagataatacactgcagtcatactagtggttaagatatttgggaataaaattaatacttttgactagaaatgtctaaggataaaccaacagaaattgaatctggatacatctttaagatgtaatcagaaatgaccagatgactctagttaaaatttttgaaggagggattacattaatatttcaaaacccttactctgtaagataagtgtagtttaatttttttcccctcgtatacttttatttacctggggaaggagcttttagggttgggggggtggtttgctatctctttagctagcagaatagtgtgcctttgatcctcacacatcctgtattatgaacacagtagccatacttcacggggaggtcagagctggctaccagcagtcttgccctttactgagcttagtgtcatccttggatgctgtcatatgctgctttgagtgaaccagagaaacagccatttgcagcatgagaaagccccaaaagctctgggatttacctccacttcagtaataatgaatattttttagcattagaatgtgttaggtcatttgaattaatttttactacactttggcttgggagaggaattattttaaatagacactggtacttttcgaacttgatagctaaagattctaaaatgcatgttttatactaagttttaaccagtcaggaaaattttatgtaaccagtgatagtttatttttttgtatgaattttgtttaggctacaatgtttagcttttgttaactcctcactcttgctgtcttaagttcattactatgtttaatggcgtacttgccaagatatttagcatgtaaaaagcagggttttgattaaaaaaaaaaaaaaacagcttcatattgaagctgagacttacaataacaagttgagtggcaagcctggtatgctgtgtcttattgccagaatcttagtaaatgtaatgttttaaaagtttattgtctttgtatattaataacaaagtatgacaagttaagtttaaataagagttaa

SEQ ID NO: 2317 - DNA, 884874 bp, Homo sapiens
tccaccgactcctgcccgcctcaacacaatgccttgtgagtagaaatgaaaaaccacctgaatttaaaattatttaggttgagattttgcattgggaataatttcttccagaggaggttgttagtgtgttatagagatgagggatattacatgtccaatatttgattcatttgtgataattctaaatcatgaacagttggcctccacaaaggtactatttctttttgcatttccagggccatagtgatacatataacacttgggaaacgtgaattcgtatagttaacccagtatctgttactctgcatttttacaggtagttaatatactcattttccctctttttatactcaaactccggtagactatttttgcttaagtcaattgagttgtcatgctgtacatgaaaattacagggtcttaatgcatttctcaccattaattgtgctcaattattaataggatcatagatattaaaatgtcactgagaaagggtatgtgtacctatgtttgagtgtaaaacctataaaatgtctcagcatttctatcagccattgtaacctagcagaacacaaggtttttgaaatgagctcagaagcaagggccattcatatatttaaaatattaaatgttaaatgcaaaaacattaaatttactgtgcctttggcagagaatgaatctaagtctacttgcactgcagagtgattgagtgattcacagagaaagtggaagttaatcattactcaggccttctgattacatggtttgattaaaagaagtaactgttttctgtaagcctgctattctgcagttagtcttcccaatcctcttaacataagcagaaattgagggagtcaatctttcagcagattctactagagttccagtagtgtggagtaagaaaagcttctttagttcccgtccttcccattgtctcccttcttccacccccaaagtacttgctgtcaatcttttctttattccctcagtatagttttattttgtgaaattttccacttacatttagtaataacatattttcaaatgtaaatgtttgaatggctttgaagttgaaggtgaaatatacacttaaagaaggtaggctgagaactccattggtttcatttgcagggtgttggaaggcctgatgaccctatgcattcctggatgactttcttggatcactctccaaagtctcttccaactctgaaattcttatattttattctgcttttactattttcacatggttatccagtgccaagatctacatatcccttcaaattacattaaactagctgtttctggttttctttataggataattaagtagctagaactataaaatacagttataaatctgagatctgagttttttataaaatttttcacatacattttaatgctattgacaactttttgtgagacaatattaatacagatatagctttgagtgacgtatctctctgggttttcatgtattgaaacagtttttaacatagtaatggtttatcttgataattctttattatttttacacaaaggagttatttcacaaattacctaacaaatactaatttgtagtttttgtaagcaaaacacagttaaaagtaacagtagtattagaaactgcagctgtgtaacatatacctttgccacattttaaaggcttagtttttgaagtgaagtttgcagtcggtttccatcttactggattgtcaataggaagatatgatttttcagttatgttttaattatctgtaaatgaaatcaccaaagtccagtcttctagacttaatattattattattatttctgaaatataggtatgatcttattaacattggccagtggctccttatagattattacatgccaaagtccacaaccctaatgccactcaatgcttttcacaattcattcttaaacctccttatgtagattaaaacactgtcctcctggccccccttctgaattcactctttagtccattcacaagactcttaattactattttccccaacactacataccattttaggattttgtggtttgcttatgctaatctttcttcattgatccattccctgcccctctaccccaccccaccaaatatacaccaatgataggacagaaaaacattttagttccttgggtggtctttccttcatcatgatgcttccttcctgtacccttactctgagctcccacaacacagtatttatactgggagtagcccacctttcacacttctaatggttggctttctcactgcacagtgaattgccagagatcaaaagacatgcctgatttatcatgtcattcggaaatgatagcttacctttatgtctgaacatagagtctaccataaatgaatagtaaatgtattatttataaatatatttggctatgaagtaacagaaaacttggctaaccgtggattaagcaaataaagctttatttatctcacataataaaaagtcaggagaagagagttgcttaagcattttatcaggcttcttctattatctcgaaacctttcttctcatgggcacaaggtcactgatgtgcctccaaactcgtgtctgtctttggggcccaaaatgggggagaagaagataacagtattctacctcagggtttctcagctttgacactgttgtcattgtgggctggataattatttgtctttgttatgggggagtgtactgtacattatagggatgtgtagcatcatccttggcctctatccaccagatgctggtagtgcaccccacccccacctcatcatgactatccaagtatctccagacattgccaaatgtctctaagaggtcagattgtcccaggctcagaagttttgctctgagatcagaaggaaggaaattctctgtttcctactcttccctacccctgtttttttttgttttgttttgttttttgtttttttccctgcattatggtggtggcgaggatctttttgattttttgcttaataagtggtagaggacacatgataagatttaaaaaacaaataagaagaaggaagaggagggaaagaggccaaacaaggcttctctgagcattgtgtctttttttatggtgtgaacattctccccatagacttccattctcgtatcactgccagactctgtcagctggctacttctaggtaactgagaggttggaagatagatttttagggtgacattttactaccctcaacaaaatcagaatctacaagaaaagaaggggaaatggatttggttttgaaaacttagtgtttgccgtgatggcagagtgaatcaatacataaaattcgtctaaatacttcagaaaggagaaagagtaaacacaaaataaacatccatcaaagagggtcgatataatttttccacatgctaaatgttaataaagtaaccaggataatactgtgatatttttccttttgatgatattttacttagaaaataaatgggcagaatggaaacatatagcgcttcataacatttttctctgcagacgacatcccttctcttccagtctattgaataaagcaatagactttgctattgatacttaccaattatttagtaatcatgtgagagatgtcaaaggaaataaaaatgcagctctattgtttcaatatttctttctaatgcttgtatttagaaagataacacatgctagtgaatgcagtaggtaaaataatggattctggtacagatgtgttagcatggactatagtaactttaagatgggttgcttatctacctaccatctacctaccaataagtactcttggattctatcataggaaataattctgacttacaaagatatattaacattgctatggacgaccaatgatcttgtctgattgattgtaatcttttttcttcctattcttgtttatattttctgtaagttcgttgaatgcaaatttttgctcaactttgtatagaatatagaaatataaaagatggtgtctgttaggaagcttttgcctgcaagtaacagagtacccaattaaaggctttaacaaaaagtacattcattatctcagaaccagattctggaggtgtgctgatccagggttgactaacttaggagttcaaggatgtcatggctctggtacgacttcactgtaaatctcttgagtctttatcttggaaacaagataaacaatatgattatcacagagccaaacatcacctcttctcatagccccactcaaagcagaaatgaaaaagcagtcttcttctcatggatatatctctttatctagaaggaaacttttcacagaagatatcagcaaacttccctttatgcctgaatgactaaaactatgtcacatttcactcttaacttacaactgtcaatgagacaatgcgttgtatgattgtttttgatcatcatggtcggtcccttgagggctggggaagaggtctgttttcctgtggacttggctgcttcacacaaaaaatcagagctctgttaactgggaagaaggaggcaataactatctagggctcctaacagggagttccacaaacaaactatctgtccttctcagatctcttaaaatatggaatgcctatgtgaaaattaaattcatgaaaaaataattacatggcctttgaatccatggaataaatggtgtatatgtctggctgcatgcttctgatgtagaatgcatactttcatgatgttacagagtttttttttaaaatagaaactgaataattggaaaatgtaggaatgtgtactgcgtaaaattacaaatactaaattatactatattacatgtctaaattataaaccttgctttgtcatcgtatacctatctatatgatcatataatgtaaactatagttaaatcagaggatgtccaccttaccaaacagatcacgtatcctcatctatgtttgtcatatgatttcaccatcataattcagagataatatgagaaatgactgaaccctttggccagttactctcataaagaaggacttcatatatgctttgcacaaataaaaattacttctttgtttctgataacggtttatttacttgaggggctcaagggagggatctaattttcagctcacataccagtgagcatctctctcattgaacattatgactcatttttgtaaacaaggaaagctttattttcattcttttgcctgacttcatggaagctcagagccaattttgtgctcaattgaaaaagatgtccttaatcatcttcttttactctgctttattatttggattcatttttaaactttaactttgtttaaatatttgattattctggagtttttttaaatcgtagctgcttcaaattattttttagaacaagaaatgatgtaatgaatacatgcacaaacaaatgagtgccatcgcgcatcactcaatacgtgtcttttttttccctgaatgaatgtatgtttggaaattagacgatactgtgttccgtaaactgctgaatttgtggcatgagaggagcaataggtacaatatggtgcaataggatttcagggaaaagagatagcagttgtgcttgagttatttttatggagatacatattgtagtttgcagacaggtgggaaactaaggcagtgtaggtgagataaattataaataaattgaattcattatatttattttgctgtatgagcagatataaattgtgtctcaactttttttccctccagttttagaattctaataacctcattgcaataactctttcttcagtataaaggatccaaaaccacaatgtaaaggaaacataaactaggaaaagaatggggttgatatctctctctgtttcaaagcaacttttgtgatggatgttggtgatcttcttggcttaccttcagtatgttagaatgtgccttctgagcatctcatcattccattgacaatgctctattttcaggctccatgcctagagctgtttacaccacagcaaccacctctgaactgggctcctcgcctccaggagaattgatttttgaatcaagcttaaaatggtaattagtaactccatctgtgtttagggtcaggaacagatgcttttcctttttgctttaatggaagatatatttgaaggtggaaatatagtgaaatagagtttaaatagatctatattgtggtgggcactcctgtgtcaggtgatgaccatcatggaagtatgtttttgagtatctacctgaaccctcttatctggacacagtacagatgattagaaggtttatttcacaaatccattgtgaattcattatggttcatagcaatgagcctaagctactgcaagttcctgaaacctctgctagggagttaaatgtttaattatatttaatagaccgtattttatcaaaaccaaggagcactgattctagaacactgcattttattcacactgtggaaagaacaccccagtattaattccacaatcgttctctactacttagaatttttactttatatttttataaaggaggatttttagacaaatagatatagatttttaacatatatccatcttttacatgaataaaacatatattagcaagatgcattagcttaagaatttaaaaaaatttatcctattcagaacctcttctgaatcattttttgactcattcatagccatgtttttccacagaaaatagtatgcatgtgttgatgatgcactgtttttgaagggctccgcgattgtctccagaatttaattccaagcagctgataccttctgaatgatttgatcctggtgtgttgttgattttactagaatgtgacaatggaatgttttcagacaacaaccagaactcatttgccttccttaaattgtcctgaactgtcaggagtggtggttgtctggtcatgctaagaagaataagaagaataccaacaattttcacatatatagtctatggctactatgcctccactactgcttggccataagaaattataaaatgcaccttgatttcagatatgttaaaggtgtcagagtcaatgaaatatggcaactttaattatacatgatcctcgttttttaaacaaactaataccatagcgataactaattaaccaaactaataatctccaaatagataagagaaactattgcataattcttagaaagtatgattaaaatataatcctatctctttttttctctatttgccctccaattatgtaatatataaaatatagctagtcttaagaaaagaaataatagtaggatgaaaacaaatgaagagaactagaccaggaacgaagagaccgatgtctggggagcagactcttctagtaactctctgtgtcatttctagtgatcccttcactctaggctttggttttcgtttttcaaatgtatgtttaggctaattaaaattaaacatgtttcctggctctaaaatctgttttgggtaaagataatcagaaataaagtctgtaataatatattacacatttaagttagtatgatataaatacataatagtggagggatgtactgtaagctggtaagcttaaaatatataacatgtatcatataactttaagatttattgtatcatatatagctttaatattttacatgttttgggagacttgtccatacatatcttacttgttctttaaaataactgttaagcaatgcagaagattcaacagaacaaaagtaggatttaggaactcttatcctcaaatatactggatgagaaagattactaaataaatcacagccaaatagtggatgtaaaagtgggaggaggcaagaagaaaatgcattttccaccaagaacaaagaaaacttatgcaaggaattaactatcactatatatataaatgttcttctttaaaagaattatcagtaagaagcaagagaaaattgacaggtaaaaatgaagtttcccttttttattttatcattactgaaccatattttatgattcagtataaattggcgatgtactattttattttatatgtatatttatatacgaatatatctatgaatcaaatatatatatgaatcacatatatatgaatagatatatatatcaatatatatgaatatatattcatatatattgaattcatatatatgtattcatatatatatataaatcaaaggaagagaagcctatagttggaccagtcagatgctactatttgtggatacatcttgaccgttcttaccgtgcatttccacagacaacagcgtttcttccctgtattgtatttgaaaattgccactgctcttaagtggtcagaaagctgggcacttactttttgatgaataacaagttctccagaggtgtgccactctcctttctttcgttgtagctgtagtcaccacagagaaaacactgtgttgcttctcacctacctgctttgcttaaaaagtgagttgatttatggagcatgaagaaaatccttcttttttattttggctagatattcttgaagttctctcataatacaattaagatatcaaaaacatgatacagtattactgaagtaagtaggtttctataaaattattaattaaattattttaatcctctagttgtgtcactttgtccttaagaaaaatattcaagatactaggtttcaagatggagagtactatttaatggcttagagtctcagatcattaaatagagttcagagattatattcatattgtaatcacatctttatgactaaatgcgtagaatcacattttttgacctaaggtggtttgtaaaacatattgtacaaaggaatcatttatttctaaaaactttaataaattttcaatggtctttccagctgaaaagctgaaagggccatggtgggttttagataacataggctcacttccttagtttacatgtgacaaaactgaagtccagaggaaaaaaatgatttgcttgtttatgcaatggtagagctggaacctgatcttcacataatgccttcatgcattagttttatttaaagagcagtaatacatacatcggcaccatatattctgtatataagttaccatgattacataattactagaattttagaagtataggtaataatcaccagaactgataaaaaaggggagtcatatttttagcaaagttagtggaggaggtattatttaaaggagattaggatatgaataaatagagaagagggagcaagcattgcttgcataaaagcaataaaaatcaagactaagacaggcagcaggggcagttggccattctagattctttcaaaagtaaacacacacatacaacacattgagaaatatcattgtagaaagcaaagaaaaatgcttattgaaatcatacatcttatttagcattcagtattttggtttagggcctctgcagattagaaataacaattatacatttattttgaataaatagtcctcagaaaaattggttcatattactcatatcagaaagagtttgcgtccactaaaaataaattatttaaaatggaatgtatgattttctgagaatgtctgtttgtgacactggttgatacaaaatcaagctgagattatttgattgcctgtcatcaaatgagaagattcttcttatcatttttgttttttttgagacagagtctcgctctgttgcccaggctggagtgcagtggcacaatcctgcctacatatggttctctagcccaagcactctttccataagaaatactagaaacgttctgcctcacacaatatgtcttcttttccatgctccttttcaacatggtactccaagcagtccctccagatttgatgattgcaagacagaatgcctatttgcttaagggagagagaatctagttggtgccaatctgtcttttaatgctcattggtcatactcaccatcacttaaaaatttttaacatttttaaggtctgaggggcaatttcaagagagatgtattcttccgtttctactaaattctatgtaaaatcaacacatccctcctgactctccttgaagtcactctccataaaaacagcagctcattctgggagccagtggctagaataaccagcacctggagattagggagggaatctttcagaagagcataagcatgttttctatagaactgcgtaaacatggcctctataacttctcaagaataggcgcattggccgggcgcagtggctcacgcctgtaatcccagcactttgggaggccgaggcgggcggatcacagggtcaggagatcgagaccttcctggctaatacggtgaaaccccgtctctactaaaaatacaaaaaattagctgggcgtggtggcgggtgcctgtaattccagctacttgggaggctgaggcaggagaatggtgtgaacccgggaggctgaggttgcagtgagccgagattgtgccactgcactccagcctgggcaacagagcgagactctgtctcaaaaaaaaaaaaaaaagaataggtgcattacaactctgccagttgtaactcaaaatacgctgggaatagtcctggtatgctattttgaatgtcatttcttcacgagccttctctagaacccctaggaagcctgagatctcacagaacagcctctcgtgggacactctaccatagaaatctgagaaaaacaagagtatgggtggtgctgctataggggagaacgaaggtataatcactggaaatggaataatttgttagagtgttagaaagagtataaagagccatctttaacattgcaatatcttttatttatcctgctacactcaggtttgcaaaactgccatatgtatacatatatatcaatatgtaaatgtgtatctatctacctctgtttatctttattaattgaaaattatagttgaatgattgatatgagaaagcctgagaagaaacaatcacttttcttggaaaaaactgttcatattccatatgtactgtagacgggaatgtggaaaaacactagaaaacgtgtcactggcccctagaaaacgtgtcactggcccccaggaaaataaatctagcattcatctatcagtccatatatttttttgcttatcttcatgaatattatttctttcccccatttccaactcctgatttcctgtctcctgatccctgtatccagtcaacaatgtctcttacacacgtctcttacatggcatcctttctgtacctaaatccagaacccaaattcaggattttccattgtgcttttgaaatgttgcaaaagccttctaaatgcaaatatcagcaaccaacactctaatatgaataagtttgtctgactatttccctccgccatgtgatacttggctaaaaagaatgaaacataaaaaagacaagtattgatggggaaggccaggaagatcagtttaaaccaagatcattgctagtgagaacaagcctaggttaatgccaggtgcttactagaaggatgttttagggacctgtaggggggccaagaggcaatctctggagagggtgggagattgaggaatttgggtctgggaaaggggtgacacaaatgagcaagataagggggaaaacaaccaaacttgttctgcataattctttagcttaataggtggtactgctgctaagttagtactaaaattcatgattctgtgtggacttcacctctctttgatttagtttttctgtctgtaaaaaatacactgagagtagtcctgctagtctattttgagtgtcattccttcaccaggctattctaaaactctaaaaagtatagggccgttatgggaataaacaaaataacatagcacttttgcctggcacataaaaatgttcagaagtgtttgcattatcatgagaaccctccatacataaacacggacacactgtgctcacctactaatagccatttatcacgtatttcctaagcactgggtgggacatggtgctaggcacaatggagaaggcaaagatgagtcaaacgctacctcaattgtgacagtccttctttattcacctggagtttttgaagttaagatatggtgttctacatccatgtttttgttaatgcaggggagattgggctgcttttatttcactagcacatggaaggagggataaagcatttagaaatggtgaaattggcagctttagaaaattcaagaactctatcagcattagaatgtgaaaacatttgagtcataggcttgctaggggtgagtatttaataggtgcctttgtaaaatctccaaactaggctgtatcattttctatacatgtttaaatctcttaattacaaagcaactttaattatacataaagtatgccacttcaatcatgttttaatcacacataaaaaaattaaatttatcccaaagttattttctgcatttcaattctgatttttaaactctggcatattctgtaccaaaaaattgcattaagctaatgtttatgcttgcacataatcccacactttcaaggcaacacttaaaatattcagaagagcttcacaagagggagtagtttaattctgttgttgactcagagccattgttcttcacagttacagctccgctggcataggctacatatggtcacttgttttctcagtgtacagagtgataatgcattaacattctggctggtggtggaggctgtgctgtgctttagagaaatatagcagggaagatgtgctgcctctttggcagaaaagagggcaagatcagcatgagagagcctgcagattgctataaactaatcattgggactgtacactgtggtggctgacctagaagtcagatcattcccttacggagtctaaatttcaaacattgtctgtctgtgagtaggacttacattgaaagagtggtcatcagagagaactatggaccacagccacagaaggaagttttgccagcttccttcaccactgccattcagaggtgctgttctggagccctcggttgccacttggaagagactttttatgatcccacttttgctctaatcatggctatgtaggccccaggtcaagtggagtgctgggctggtgactgatggccctgtcaaggtccattagaagtagtacttaagtactttcttaggtcattagtattaggcaacaagaatgggggattttggctggggtttagtaaacatgacttttcttaaagcttttgcaatttccttttgtgtatatgaagtgaggaaaaaaggccacggaagatattaagcatctattcctaccccgccctccaaaccccctcatctcttatctaatattattccatgtgggattgtgtgccaagagacatttccagttatgagggcttctacctactttttcctgcttctctgggttacatctgtggttgcgaatagaaaaattaatactagtggcagcaccagagggagccacttacacacttttgtttcaagcagtgacgaagctgacagtaagacttaaaatgcagaaatattaaggtttaattgtattttctgaaagagaatggcagaaaagtagatgatatgtaaaatctgttagcagcaattccaaattatgggactagtagcaaccactttctctctctcacttgaaatatttgtgaatggtaattgcctggctgcaatccagaaagtaaatcatatttcaaaatgtaaaattgtgtttggagcaagaagtattctctctgatcctggaattgtccctctgcagaatactattagcaagtttgcatgtttgaaacctataccagtttactgtttttgtaatgttaatgatgctaccaaaaataaagaatgaggaattaagactaaaacttttcagatgcacatgccagtgctcaatgcattctctctcactctgacacacacacacacacacacacacacacacacagtgtgcacacatatttgcacaggtgattttgctgtagagcattagaaccaggattttgtaaggacatcaggtaagcttgctcttgagtactatgatagggttgagagaattaaaatcctgaaaggaaaatagaatgtatttatctttattagcacactgaccttttttttttaatgaggaaatagtcaaatgcataaagttctgagtgaaactctatcttaattaccacactaacaaaatatttcaggaaaatatattgattccaacttcttggagggaaggtttccagcccttctcttgttttgtcttggctgattctaaaccaaattataaaaacactggaaaggaagaattgctatagttcttctttgaacaaccacaaaaaaagccgtattcttagtactgctcagccttcctccaccccactttgacagcatcaggcatatccaataacatactttcacaagaagggattctatgaaattagatgatctcctttggctctgtaatggtacttttttggcctgattgtgataaggcctgcagtgcataatgctgacaacaaatgctttcttaggtcgctttccacgtaacagtaattctcttcaagaaagtaattgattaactggggtttgtgctacagatggaaaggagggaataagaaagattgcttgtgcttgactccctggcgatatttatccttcttttctttttaagagtctttccttctctttctgccttgcccaccctagccaacatgcttccctcgcagactgcccattcctaatccatttttgggggaagcgatggactaaggaagtcggggatgcaatgtgactgtgatctagtgtccttctgcctgcagaacttttaagaacacaaatttgcctctgagacaaggaagttcatatattttttgttttatctatccatccatctacctattttattttaattttaaaaatgagacttctcggccgggtgctgtggctcatgcctgtaaccccagcactttgggaggctgaggtgggcggatcacaaggtcaggagttcaagaccagcctgaccgatacgatgaaaccccatctctactaaaaatacaaaaataagctgggcgtggtggcatgcacctgtagtcccagctacttgggaggctgaggcagaagaatcgcttgaacccaggaggcagaggttgcagtgagctgacatcatgccactgtactccagcctgggtgacagagcaagactccatctcaaaaataaaattaaaattaaataaataaaaacttcttagtctagaaagagggaccattactgaggaagagatctacagcaattttgttaacttccaaaactctggaagacattggttatcacttccttcaggagccttgaccccagatgtctagagaagttcagggccagagcagcaggtcaaatgggaagccctggagctaaacataccaggtgattctggctaccctatgggcaaaaggtttcaagaaccttcttctccctggaaaaagaacaagaaaggaagcagcagtggttgtggtacaacaggtgactagtgaaggtagaagagatgatgtgagctttgtatgtacagagaaggtgtccccagcacgcggttccacactgtagtgaatatcatgagtccactgtgcacacagaagatcctgggttcgggaaggtaccccaaagtgcctccaaagcatcttcatacttacattgtattaggatgtgaacatatgggaacaggagtgggggcctggaagggagaggggcatgtctggtaccgaaaaagatcatcctcacatcttgttatttcaagctatgtctgcaagcaaactggtagctgtgttgctgacttaacagaaacagagaggatgcttgaatactgatttgagtgtgataaaggagatatgttatatagtactcttcttggtagtatacaaaaagatgggaaagggcagggagcagagtgagtagagggcatgtctcctgcttaggaatgattaaatggctatctttgaattggactggagaagaaggaatcctcaggacgctaggaaaccaatggacttaagtaaggggtcagtgtggtcctttctttgtaatctgagaattaccgctatgctttgtttagcaaaaggtacatagaggcttcagtttgccacctcagaaccttagttaagagactagaactacattatatgatatgcaacatctccatgtgaaaaaaaaaaaagcaccaaaaacttcttagtctagaaagagggaccattactgaggaagggatctacagcaatgtgtccatttgtgtttaatagtaaaacccttgaaaagaaaaggacctgaacattaatgtctttggggagagaaagggaggatgatttaaggagcaacatctcactttggaaatcagatttggaggagcaggaccacgaaaggtgaagtgggtggttttgagaaggcccaagagggtgtgcagcctagaatgacagacaataggaatcagataagaaagcatcctgagacagagcagggaagaggccctaagatgtccacatatgaataacgtcatcagagaagtccacctgaaatccctaaacaaataaattgaaacaagagcccacaataagatgcagatggagacaagagggctatcaaggaggcaactgccaagtgagccaaacttctccttggtctttgattcttcatcaagcaaagtcagaacatttgcagtgttttgaaaaccgcatttgtttttcaagctaattgttattaaagggtgatttcaaatagttagatttaacattattccaaataattgtagtaactcagttgtatgtggttaaattctggacctttgagcaaggctttcggcaaaaacctcctttgtcaagtgcaaaataggcaaatttacagctcctattatatagggattgctatttaaatctgagatggcaggaagtaggaggggggataatttaaagcaactgacaggcattatgtctttctctgatccttattttttaagttctcaacaagcggtttagcggtatgaagacaaatctctcccggaaaaagtagaatggaaagaagcttgatgctatgcatagtacactgggattgaagttggatgatgtagatataagttgacataggtaagttttgactttgccgtatgctaatgattgctgaaggcagtgcaacctggctttcagtgtttttccctataaaataagaaagacaacatattcttgcctgtttcgtagagtagtattaaaggaccaataggtcaaagtctgaaaaggcattttatatactattaaactctatatgaatataggataccattgagtatagcagagaaaaaggtaatatattgtagtagagtcagaaattggatggattcagggtataggccttaaaatcagaggagcctctgccattaagttatttagtctctctatgcttcagtttccctattgataaagggagataaggagaactctacctgtggaacattgcaaggagtaaatatatatatatatagagagagagagagggagagagagagagagagagagagagcttggtatagagcctaacacacaataagagtgcatacataaaatgaatattagctattaccaggtgtgattattggttgacaccactgagtttatttatcttggaaatgatagattcatgagcgtcacagataaggaccttgaagctcaagcactttgtttctatataacacttacatcacttacattatacttgttgacatatagatggtatttaagccatgagattagattacaccaccaaaggagtgagcatagatgctcaatatatgcattccattgcccagacttctaaactgaataacctcatgcaagctccttatccctctaagcctcatttcttcatttgcaaaatagagataatatcttcctcatagaatgagagggtttaatgagatagtatatgcagaatatgcagcacctcattggaatgatttcattctgttcttttggtgataactcagctttcagaaatggccctgaagggccaaaggaaaaacaggcaaccaggagcagcgtcttcccatgaatttcactgtgtgagttgttttccctaactcatatttcttttgctttctattttctaaaagactccgtgtttcagttagttcagaaaatattgctttgatcacaaagctgacccctactacatgtaatcctgaggctttttctggtaaaagacatgcaaaaatatacctacaaaacaatgtgttaatttcttacttagatatcattccaaagcatgtgagcatcaagattcgaaagaagaggtgggagacatatagttgcaaataatatttgtattctttagaatttgatatgattaaatggatactgatatggcccaagcacaaagatttcatcactttaatatatatagttaaagtgagtctaatgtattttgagagacatataaagaaacccaagtatttattctgagatcttctacaaataatgtttttgaaagttcatataaaataaatctttatgataccatgatcaaactgtaatattcatctgtctgtatgaattcaactcttatgttcaataatggaaatatgtgctcttgcaattataaaattgaaacctcttgagagtacaaactggtaaacctggaaatccattacttggaattaataatgcatgttatttttttcatagaaaatgatctaccttttttgtattagatattacatttgacatattcttccatgtctcaaggtaatatctatggtgtcgcaaattacatttgtaattagttattcatgccattaaacttaaatatactatagaagttcaagagagttcgtagaagtagaaatgaattaaacataaattttctgattatcttttttaaatggtctttttcaattttaagactatagaattaagtaattttaaaagctcactgattaaaactatttttaaaatgtcttggtatgtgatacttgaacttaattctctaaataatctatttacaaaaaatagtgattttctattttgcttaattatctgaatcatataagcatttttactttaatggaaacaataattttctttataaaattagcaattcatattttgctatcattatgtggatttaaacactcttagaaaatatgtatcagacactaataggaattattttgagttgcttaattatcatacaccacacagaaatgcaataattcaataacattgcttgcaacaataacttgcaatttcaaagataatgatgtttgggtctctatcagttatacaattattttgtaacttataaatagttcttgtacatgtaacttgtgtaacagatattgtaatacaaaacataaagggaatgaatgcacaatatgaaatattaaattaactatgttttttaggtgtttcttcttaaactaaacttttatgtaaactttctgcctccctattcttctcagactaagttttactcataaaattttgtggcttttattacttttattaaacaaatactcatcttaataatgagaaaaaaaacaattgagcagataggaagaaaaaaacagaattctgtcatcacaaggtagctccttttattcatccattctctttctttttatttgtttatgtgtgtgtgcatattatttgaaagtatatatacataaataaaatataataagtatatataacaaagatggtattttaatgctctgtcatacatttctttcacatattaatatgtgaaatattagaaggcataattataatataattggaagatgtaattattataattttaagatataattagtatacaatgtaatattattgtatactataatttaacaatttattgcttgaatttttttttgctttcatttcttttttctgttaactatgaactgcatatttcaatgcacagtttgattattttcttaggataaattattgatcatgaattcttgggtttaaagatatgcacactttaaattatttcaatgtatattcctaaggtgccttccataaaggtcatagcccagtgaaatgtctcaggcagaagttcgttgtgccctgtgcaatacagatattacattctttttgatattttccaatccaataggtatgatctttcttctcattgtataaattggcaagtctttgatagctaatgatataaaactataaaaatatgtatttgccaaatgattttcatctttgagatttcatctaatttttctaatctactgtccatttattctgtttatgtaaacacagctatagatctttgttactgtttctttctttaacatcaagcttagattctgagaagccaaattatgtacatattaacccatatgttctttagatagctttatgtcttgagtttttacaattacatgtttttcatccaaaatgtgttttgttattaagtatgatataaggatctaaaccaaacttgtccaactcacaggccctgggccacatggggtccaggatggctttgaatgtggcccatcacaaatttgtaaacttccttaaaatatgatgattttttttttttgcagtttcctttctgttctttagctttcttcttcttcttttttttttttttttttttttttttttttttttgctcatcagccatcattagtgttagtatatgtctatatctatctatctatctatatatatcgattttttttttttggcagttaaagacaggtttactttcgataaaacctgagaagggcttctggctgatttcaatcaggagcgctttctcttacagacaaagtacatgagtatacattggttttagggtgagggggcttatcacaagcttggaatgtgtatgtgtaggggagaagtttatggtgaggttggaatgtctctgggtgaaggggggattatcttggggctgacatctttccagcaggaagggggttatctcggggctggcatcttcccagctggaggggggcagctagcatgtctctggttgcagaggaatttggaatgtttctggtcggagatttttttttgtttatgatcatgctgatcttagccatttaggctgatgccctttggatttaggcagtttttgattaatgtgaattggaaaataacagtgcttgtgcaagatggtgatactcctgctctgtcatatttcagcctctcaaagctcagggattataggcatgagccactgtgcctggctctgttgtctgattcaaagtctgttttatctgatataatagtgacccctggttgggcgtggtggctcatgcctgtaatcccagcactttgggaggccaaggtgggtggatcaagaggtcaagagatcaagaccatcctggccaacatggtgaaaccccatctctatctggtaaaaatacaaaaattagctgggcgtggtagtgtgtgcctgtagtcccagctactcagcaggctgaggcaggagaattgcttgaacccaggaggcagaagttgcagtaagccgagatcgcaccattgcactccagcctggcgacacagagagactcagtctcaaaaataaaataaaataaaataaaataaagtaaaataaaataatagtgacccctgaccttttttgttttccatttgcttgatagatcttttttcttttttttttcattattattattattatactttaagttttagggtacatgtgcacaacgtgcaggtttgttacatatgtatacatgtgccatgttggtgtgctgcacccattaacttgtcatttagcattaagtatatctcctaatgctgtccctccccactcctcccaccccacaacagtccccggtgtgtgatgttccccttcctgtgtccatgtgttctcattgttcaattcccgcctatgagtgagaacatgcggtgtttggtttttttgtccttgcgatagtttgctgagaatgatggtttccagcttcatccatgtccctacaaaggacatgaactcatcattttttatggctgcaaagtattccatggtgtatatgtgccacattttcttaatccagtctatcattgttggacatttgggttggttccaagtctatgctattgtgaatagtgccgcaataaacatacgtgtgcatgtgtctttatagcagcatgattttataatcctctgggtatatacccagtaatgggatgactgggtcaaatggtatttctagttctagatccctgaggaattgccacaccgacttccacaatggttgaactagtttacagtcccaccaacagtgtagtgttactatattttatgtgtggcccaagacaattcttcttcttccggtgtggcccagggaagccaaaagattgtaccctaaaaatgatagtattgaagagcctatctttccacactaatttgatatgtgtactttttcatgtacaaaatttttacacatagttgaatcttctggactttctattcattgccattgctctgcttattgggtgaaaatgctacattgttttaatttattgtatatttctaatacttttctaatatcaggtagtacaagccctgtgcattaattactcttcttttttcagatattttcttactattctgtctactgtgtttcttctaagtgtattgtaaaatattcatcaagttaaaaataataatacaattgttataaattagtaaggaaatgttaaataacctcacactcttgattttcagaatcaggactctagtctatttctcaaattttttaaaaatcatttttattatatactttttattttgaaataatcttaaatgcctagaaaagttatttatttggatgtagtcttaaaattagaatttgcaagagtacaagtgtctatttttaaagccatttaaaagtaagttgcccatctttccttcaaatacgttagtgtacattttttacaaataaggatattctccttcctaattacaattgccatcaaaattaggaattaacattggtatgttatcccatctaatccttagacccttttcagtttttctcaggtattccaacaaagtccattatagaaaaaggatcaattttataataataattatttttattattatttgagacagggtctctgtcacgcaggctggagtgcagtggtgcaatctcagctctttgcaacctctgcctcctgggctcaagcagttcttctgcctcagtctgggactacagactgaggcagaagactgggattacaggtgtgcaccatcatgccgggataaattttgtattttttgtagagacagggttttggcgtgttgcctcaggctggtcttaaactcctgggctcaagtgatcctcccgcctcagcctcctaaagtgctaggattatagacatgagctaccacacctggcccagtttagaattatgttttgtttttagttgctatgtctcgttaggcttcttcagtctgatatagtgtcttagtcattctttgattttatacctcaacactttttaattgatacataacgattttacatattaataggatacccataatattttgatacatatatacaatgtttaatgatcaaatcagaataatttggttatccatcaaatgcagacatttattatctcaaacaaataaactcaaacacttatcatgatatatatatgtgtgtatatatatgtgatatatatgtgtgtatgtgtactatatatagtacactatatatacacacacacacacacatacacacaatggaatactattcagctataaaaagaaggaattcttgtcatatgcagcaacatgaatgaacttggaagacattatgctaattgaaataagccaggcacagaaagacaaatatcacatgtacttactcatacgtgagagctaaaaagtttatctcaaggaggtagagagtagaatggcggttaccggaggctgtgaaaataaaaatactatatgatctagcaatcctgactccataccttagctgctatgaatagcactacaataaacatagaaatataaatatcacttcgatttgatttccttttggatatacccagcagtaagattgccaggtcatatggtatttttatttttgtttttttgaggaactattatactgtttttctataatggctgtactaatttacattcccataatcagtttacaaaccttcctctttctccttgccagcatctgttatttttttgtctttttgatcatagccattttaactgggatgaaattatatctcattgcagttttgatttgtatttctctgatgattagtaatgttgaacactttttatatacttgtttgacatttgtatgtcttctttttagaaatatctatctagaccatttgtctgtttttacatcagatttaatttttgctgttgagttgaggttgttatagatgcaagttattgattccttgtcagatggataaactgcaagtattttttctgtattagtccattctcacactgctataaagatactatctgagactacgtaatttataaaggaattctttcctgactttattgtcagtcctttaactgactcacaattctgcatggctggggaggcctcaggaaacttacaatcatggtagagggcgaaggagaagcaaggagcttctccacaaggcagcaggagagagagagagagattgaggaagtgccacactttaaaccatcagatctcacgagaactctctcactatcacaagaacagcatgtgggaaactgcccctgtgatctaatcacctcccagcaggcccttccctcaatacattgggattacaatttgagattagatttaggtggagacacagagccaaaccatatcattctgcccttggctcctcccaaatcccatgtccttttcacatttcaaaatcaataatgccttcctaacagtcccccaaagacttaactcattccggcattaactcaaaagtccaagtccaaagccttatctgagacaaggcaagtccctcctgcctatgagcctgtcaaatcaaaagcaagttagttacctccaagatacaatggaggtgtgggctttggataaatgttcccattccaaattgggaaaaattgaccaaaaaaaaaggggacataggccccttgaaagtccaaaatccagcagggtaaccattaaatcttgaagctccaaaatctcttttggctccatgtctcacatccagggcacactaatgcaagcagtgggctcccacagccttggtcagccctgttcctgtgactgcagggtacaacccctgtggctgctttcacaagctggtgttgagtgactgcagcttttccaggtggataatgcaagctgttggcagatctccctttctggggtctagagggtggtggccctcttctcacagctccactaggcagtgccccagtggagactgtgttgggactccagccccacatttcccttccgcacttccgtagcagaggttctccacgaggactccactgcagcagacttctccctggacatcgaggcatttttatacatcctctgaaatctaggcagaggctcctgaagctcagctcttgtcttgtgtgcacccacaagctgaacaccatgtggaagctgaacaccatgtggaagccaccaagcttggggctcacatcctctgaagcaattgcctcagctgtaaccttggccccttttagccacagctggagctggagcagctggaatgcagggcactaagttctgaagctgcacggatccactgggccctgggcccggcctgtgaagccatttttccctcctaggcctctgggtctgtcatgggaggggctgctctgaaggtctctgacatgccctggggacattttccccattgtctttgctaataacattcagctcctccttacttgagcaaatttctgcagtcagcttggctcaaattccttcccaggaaatgggtttttcttttctaccacatggtcaggctgcaaattttccaaacctttatactctgcttcccttttaaactaagttctaatttcaaaccatctctttgtgatcatatataactgaaagctttcagaataattcacgttctctcttgaacactgctgcttagaaatttcttccagcagataccctaaatcatctctttcaagtttaaagttccacagatgtctagggcaggggcaaaataccgccagtctctttgctaaagcatagcatgagtgacctttactccagttcccaaaaagttccttatctccttctgagaccacctcagcctagacttcatttttcatatcgctatcagcattttagtcaaaactattcaacaagtctctaggaagttccagactttcccatatcctcctgccttctgctgagccctacaaacggttccaacctctgcctgttacccagttccaaaatcacttccacatttcaggttatctttgtggcagtactccactttgccaataccaattctctgtattagtccattctcacacttctataaagatactacctgagactgggtaacttataaaagaaagaggcttaattgactcacagttccatacagctggggggcctcaggaaacttacaattgtggtggaaggtgaaggagaagcaagtaccttcttcagaaggtggcaggagagagagagagaagagcgaggaagtgccacacttaaaaccatcagatcttgtgagaactcctttactatcatgagaacagcaaggggaaactgttcccatgatctaatcgcctaccagcaggtccctccttcagcatgtggggattacaattcacgatgagatttgggtggagacacagagccaaaccacatcagtttaccattctgtagatgacctcttcactctattggtttttttctttgctatgcagaggcttttttttttataaaatctttatagaatctcatttgtcacctgtgttacccaaaaaaatcattgtccagattaatgtcctaaaatgttttcccagtgttttttctaatagattcatagtttcaggtcttacatttaagtctttaattcattttgagtgatttctgtatatggtgagagacaaggttctatttccattcttctgcatatggatatccagttttaccaggattatctattgaagagactgtccgtttatgttcttggtgtcttggttgaaaatgagttggctgtaaatgcatagacttatttctgagttctctgtgctattccattagtttttgtgtttttatgccaatatcatgctgttttagttactatagccttgtagtatactttgaagtcaggtattataatgcctctagctttgttctttttgctcaggactactttgactatttggggttctttgtagttccatgcaaattttaagaaatttttttctaaatctgtgaaaaatatcattgttattttgataggaattgcattgacattgtagatcactttgggtagtatggacattttaacaatattatttttctccaggaacatgatatgtcttttaattttttgtgtgtcatttttaatttcattcttcagtattttatagtttttatggcagagctgtctcacctctttggtgaaatttattcctaggtattttatttttttgtaactattataaatggaattaccttcttgatttcttacagattgttcactgttggaatatagaaatactactgtttgtttgtgtcatgatttagtattatattttgcaacttcattgaattagtttgttagttctaacaggtttttggtggactctaggtttttctaagtataagattatgtcatctgcaaacaaggacaatttgacttcttcctttttcatttgcatgccttttttttcctttctgttacctaattgctctagctaagacttctgctatgatgttgaataaaagtgatgaaactaggtatctttttcgttttccaaatttgacaataaagtttttcaaattttccccattcagcatgatgttagctatgggtttgtcatatacagcctttaatgttttggggtatgtttttttctatatttgttgagagtttttattatgaacagatgctacattttatcaaatgctttttctgcattcattgaaataataggtttttgtccttcagtctgttcatgtgctatagcacatttatttatttatttatttattgaaccattcttgcatccctgggataaatcttgcttgatcatgatgaataatctttttgatatgctgttggattcagtttgctaaaattttgttgaggatttctgcatctgtgttcatcagggatattggcttccaatttgcctttttgttgtgcccttgtctggttttggtttcagggtaatgttgaactcatagaatgagtttgaaagagttctttcctcttcaaattttttggattagtttgaggaaaatcagtattatattttctttaaaagtttggtaaaacttagcaatgaaattatctggttacggactttctttgtggagatttttaaaattactgattcaacctcattacttaatgggctgtccagtttttctatttcctcatgattcaatcttgtaagattgtatgcttctaagaatttattcatgtcttctaaattttctaatttgttggtgtatggttcttcacaataatctccaataatcctttatatttctgtggtatcagttgtaatgtttcatttttcatctctgatattacttgggtctttgtttttcttaattagtcacactaaggtttatccattttgtttatcttctcaaacagctttctattttgttgattatttttctattttctttttcatctcaatttcatttacttttgctctgattgttagtatttttccttctatgaattttcagtttggattgttcatgcttttctatttcctttagatgcatagttaggttgagttttagaagtcttttttctttttcaatgtaagcatttattgctgtaaacttttttcttagtactacttttgctatactgcataggttttggtatgtagtgtttccattttcatttgtttcaaggaatttcaaaattttctttgcaatgtgttcattgacccattggtttttcaaggccatgttgtttaattttcatgtatctgtgcaatttccaaggtctccttttgttattaatttctagttttattccattgtggtcagaaaagatacttgatatgatttctactcttttgaatttgttcagacttgctttgtggcctaagatatggtctatcctggagaagttcaataggctgatgaaaataatatgtattcttcagtagtttgttgaaatattctgtaaatatcagttaagtctttttggtctggaaactctatttttttttttttttggttgagtttctgtctggaggacttgttcattgcttaaagaggggcactaatgtctcctattattactgtgttacagtctgtctctttctttatatttattaatatttgctttatatatttttgtgatccagtgttggagtacatatgtatttataattgctatatgctcctgttatattgacccacttattattatataatgaccttctttgtctcttgatagttttggacttgaagtctattttatctgatataagtttagctactgcttttttatggtttccatttgtatggaatcttttttttctccttcacttttagtctatgtttatctttataggtgaagtgagtttcctgtaggcagcatatgattgggtcttgttctttcagttgcataatttagtttattacattcagtgttattattgataggtgaggacttactactaccattttgtttctgattttctggttgtattgtaagttctccctttttttcttttctactgtctttttttggctaagtgtttttttctggtagtatgttttatttaatttcttactttttatttttaacatatctgtatttttgatttatgattaccataaggcttacaaaatattttatggatataacaacttaaactgatggcaacttaactttgactcaaataaaagaaaaaaatgattcaatttccccacattttgaccttttttgtctcaatttttatctttatatattcctatctcttaagaaattatgtaattatttttgataaatttgtcttttagtcctcatactaaaggtataagtggttgatacatcacaagtttagagtattctgcatttgtatttgttcttgccttttccattgttttatactttcagatgttttcattttgcacattaacattctttttttttcatattgaataactccctttagcatttcttataagctcagtctggtggtgatgaatttccttagcttttgtgtgtctggaaatgtctttaattagagctcctttatatgttgtttcttttgttttgctgcttttacaatcctctttttgtgtttggcctttgaaaatttgattattatatgctttggagtagtcttatttgggttgaatcaggttagtgatctttgaccttttagtatctggataatctttctctaagtttgcaatattttctcttactattttttaaataagttttctacaccttgctatttctcaactccctcctggcggtcgacggctattagatttgctctgttgaggctatcctctagatcttatagacattcttttttctttttcattctttttttctgtcctctgactgtgtattttcaaacagcctgtcttcatactctctgattcttttgtttaatcagttttgctggcaataacctctaatgtatttttctatctagccgttgtatttctcagctccaggatttctgtttatcttttattattttattctttttgttaaatttatctgaataaatttctgcaccgatttactgtgttatcttggagttcactgagtttcctcaaaactactgttttgaatagttgatctgagaggtaaaaaatcaccatattcttagggtcagacattggcttcttttttgtcttttcgtggaggtcatggctacctgtttgcttttgtttcttatggatgtatgtctatgtctttgctttcaaggtttagttatttatttcagtctttgctgtctgccttggtttggtctttctagagtatgtatgactagaagtcctgtgccagttgatttttgagtaccctcagcccaagaacactgcctccttttctgcactagatgacacccttgctcagatttgccacagttcctgcaaataacttgagagtgctgcccatcccagattggggctgggggaatcctaaagtgtatatccccgctgtgtgggaaaggtggctaagggttatgcccacagggcccctgaagtacctcccctaaagcatgttgctgctgaacagattcagtgatttggcatctcctttgacagagatgaagaatagctgctgagttttgtgccctggctggtactagccacacctctgctttatgcctctagtttctcttagaagccttcaccctacgggcatttatgatgcttcctgtggattcaagcagaaatgtttttcctgtgaagaaacctaactggtgacgaaactgtctgtcttccttgatctcactttttccagggtaaaaactgaatctgctagaacctttctgcatagtgcctggcagcttaggggagggtgttgtggccagaagcttttgtttctcttacctcttgcttgcggtttttcatttcgctgtgataactggagtcatcacatcctcagtttttagttctgggatgtccctggtgataatcttggccctagataattgattttggttttctatgagggagagtaaagccagattgctcttactccattttgataatatcactctcttgacacttttaaggattatagacctgtcgttttatagtctctaagtttggaattgtctgatatttcttcatgattacttttataagatgtatcttttggaaaaatgtcacagaagtgaagctgttatcttactgcgtcctatcaggtggctcttgattaaggtggtatctgccagccttctcccctgtaaagctgtctgatatcatttggatatttgtctgctctaaatctcttgttaaaactttatccccaatataggaggtgtgacctagtggaaagtgtttgcgttatgagggatatgccctcatggcttagtggcattctcatgagattaaatgagttctcactcttagttcctttgccatctagttgttaaaaacagtctggcatctcttcttctctgcttcccaccgtgtgatctttacataccagctcctctttgctttctatcatgagcagaaacttcctggcagcaccagaagcagatgctgataccatgcttcttgtacagcctggagaactgtgagccaaatatattttctttataaagtacccagcctcagatatttcttacagcaatacaaacagatgaagacagtattattttcccctttgtaatatatcatacctagctaacttttaattaattaattgactaatttatatcagtatatactcattctattttcattaaatgggtcacagtttattactatcattttattctttcatgctaaaactttccctatttcactagtagaagcattttagggcggaacacatgaacttttagcataaccctatcatactgaaagcactttcttgacttctggcccagtaagatgttcctggctcatcttgtgcttttccttccctagctgttgaaccagccatttctccgaggataattgtgtttcctttttttggtttttaatctacattttagtttgtttctttaggaataagagtagtttggggcaaatatggagcaaacaatttctttttattccttatcaaatctagcacacatatataatatacaaaatctttcttgtacatatataactttttatttgtatgaaatattgacaaacctgatgaaatcagtatctgtgagcattttttcaaattcagtaatcaattttttgcatgatttttggatatatatataatatgtactttaatttttagagcaattttacatttgtagtaaaattgattggaagatgcagagatttcccatatatgccctgccctcattcttgcatatcctcttctattatcagcatcctacaccagagtggtacattgttatgaagagtgaatccacattgacacatcattatcatccaaaatccaaattttcattaggaatgaatgttggtgtagtacagtcagtggattccataaatgtatcatgatatatgcccatcatcatagtatcatgcagaatagtttcactgctctaaaaatcctctagggctctatggtctgcctatttatatcttcctccccaccagcccctggaaaccaccaaacttcttactatttccatagttttggctttttaaaaatgtcgtatatctgaaatcatatggtgggtaacaatttcatattgaattctttcacttagtaatatgcatgtaaggttcctccatgtcttttcatggcttgatagctcatttctttttagtgctaaataatattcctttgtcaatatgcataacagtttatccattagcctactgaagaacatcttagattcttctaaattttggaaatgatagataaaactgctataaacacctgtatgcaggtttctatatggacgtaagttttcaacttctttgtggaaataccagggggtgtgatggctggatcatcgggtacgagtataagtacttctgtaagaaattacaaaactgacttgcaaagatgctataccatttgtattttcactagcagtgaatgagagttccttttgttccacctccttgccagcatttagtgttgtcagcattctggattttgccctttctaatagccgtgtagaagtacctcgttagtgttttaagttgcatttctctaatgacataggatgtggagcatctttttctgtgcttatttacatctgtataacttctttggtgaggtgtttactaaggactttggccaattttttaatcaggttattcatttttttattgttgagttttaagagttccttgtatattttggatgaatcttttatcagatatgtctttaataatcattttcatctagtctgtggcttgtcttctcattctctagtagtgtcttttgcattttttttattgtaatcaattacagcttatcaactatttcttttgtggattgtgcctttgttgttgtgtataaaagttaatgccaaacccaaagtcctctaggtttatttcctgttatcttttagaagtctcatttccttttagaggataatgatatttaaatccaagatttgggtgctgggtatcctcattactatgtgggaaccactccccccaggctctctcagtggacagagttaggaaatatatattcatccaatttatatctctttatatttctctatctttctatctattaaaaataatgagtttgcactaatacctaaaattctaatcaaacaccacagagagttttctcccttttcatatttgcaacatttttgtgttaatgagaaacatggcttttattattcttaaggtatttacctatttgaccgattgccctgtattgaaccaatctcccattgctgccattgtgccttcctctgacagatgtcctccgcaccccacctgggctctgatgctccttattgggctgccctcctgcaggagcaccctcatcctgtttggggttgaacagtctatgtctgaacttgcctctctttggatgcctcctcattctgccaatcccctgtctctccacagtgttccctccctgtctgaaacctctcctcacagtgctcaggctctgatccctttctctgggccatcttggatgaaaaccctcccctattaggatgcctacttttctctgtcttacccagttagtttagcttaatgttcagtaaggaaaaagaaggaaaagggaagagggcctgatctttcatgtccctcagtaaactttataatttcattgttaactttcttagatttctagctattttatatttttgcttgtatggtgcatatttattttcttttttctattttctccctttattgctggtacatagataagtttttatttgtatgttgagtgtttaatttataagcgaccaagctcttgatcattttgctccctccttatatctatttaattgagctcttcctaaaacatcagttgtcccatcactttatgcgtaatggaagtttccttgaactgatacttcttggtagttgagaagctcctggcttaggttatataattagtatttatgggaaacaagttgcttaaataaaagtgtccctaaaaattcattaattaattagcattaagatttgtttatgatttactatataaaatgatgaaatatagaagagtgaggcccttttaaaagtatttaagaatcagccaaaatactgcttgctatttaagcttagattcttttcttccagactgtagaagtagaaaatacatgattattcagaattctagaatcgactttaatccaaaatccttaactagaaagtgggggtcaggagaggtggggaattagaaaattacaactatgtgttatagtttatatcagataatgtttagacatattcaaattactcaaaatattttctcaagtttccttttttcataaaatctttaaaagtagcaaaaagtatagcaaagtagattctaatgttcatattcttattcctaatataatacatgagttctttgtagtagtggttttcaaattttaacatgcatatgaattaccaggtaatggggctaggaaattgcattttgatcaaacactgcaggtgattacaattcatgggcctcacttaagaaacactgatttagagtgaaacaatatttgaataaatgtttcaagtagtatacttttgtttaaagtgcagacaaagagtaaacacactatttctagtgattatatcattattcagggaatacaggacatcatgtagttggagacaattgcactctctacaatctactttcagaataagctgttgatgttcaccagctctctaggatcaagagctaagttccttgaatgttcctgtcctttctgaggttcttagtaaaatgacaccctataaaatagtctaaaaggagttataaagccactctattttgtagttatttatccaattttcagtgtttaagaagctttctattaggcaagagtaggttcagaattatctgtgaatagctgccaaataatggttgttgttggaaactcctaagtgtagcacatgctttagaggaaattttttggtcatttggtctaatgtaaaacttaaaaggtggcctgaaattcacccaccatttgaaaatacgtagttgctcagttccgtgtcactaattctctgctttctctttgctttctgacacttctgaggagcagacctgtgaagcttgaggccactcaagttccaaatttgtgacaaatcccccagggctcactggagtggcagtaagttctcgcagtttgatttcctttcaatcactgaagtgttagaaaagtagtaacaaaagctcccacggcaaaacagcaattctgtttcctgaccatccaccatagtcatgacttacctcttttgttccattgatttttctgttgaacaattttaatacttttagccatacaatatgcagtatagttttgacaagctggcataatcctttaaccatgctttgagtgtacactttttctccttctacccccataacctgccatagaaaaactgattttatttttgaaaatttctttccctttttcagctattattttcacttaaatatataatgtttttatgttacaaagtttgattctcttttgatgatatatacatacacacacatatatgaaaatcttatgttcacggaagcgttatgttgtgatatttataatcacttcaataaagtcatttttagaaaaaaaaatgtaggctgggtgcggtggcacacgcctgtaatcccagcactttgggagactgaggtgggggcatatcacgaggtcaggagatcaagaccatcctagccaacatggtgaaaccttatctctactaaaaatacaaaaattagccaggcgtggcagtgcacgcctgtagtcccagctactaaggaggctgaggcgggagaattgcttgaacctgggaggcagaggctgcagtgagctgagatcatgccactgcactccatcctgggcaacagagcaagactccctttaaagaaaaaaaataagaaagaaaactttagtaaaagtctatacgatgcatttagtcaacaaggaaggctgacatcatttttaatgagagaagaatattttaaagaagaaataatggcttttgggtcagaaagaaccactgatatcaaactgactctctgttctttgtaactaaaccccaaaccaaactgattaacctacagccgcaagaacaaaatcaaacaacacatgatgtatgttattagagcatgtctataactcgctttttacatcaatttaccaaacactgagtgaacccagcacttgttgagaagaaaagacagaaatgattatttagcctttgctaagaaattaagaaatcagttttaaatgaccagcattaaaagcaaaacaatttttcattgtcaccatccaaatatgctaagaaggaaacatctagaatatatttcccaatattaaaattatttcagagtagttataaacaaacggaagactgctccacctcacacaattttgtttattctggttagtggctcccattctttggcaaataatgtatggcacacacatgagttctggaacatgttttaataactcttaatttcctaccactcatgacccatctgtcatgatttgaggaccttacattagggaagtcaaatagggaagactgtgtgtttgtgaccaagagcattaattttaggcgtggtttaactatgtgtcccattaattccatatctacaggtttttatctgtaactcaacccagccagatccatgttctcctcttctttgtcttgttgtatgccttgagaagctaaccttgacttctataagttacatccacccaggcccccttgatagttggcttcttttaaaaatccaacaaatgcaagacaatggtaggagaacagagtgtaagagagagagtttgggttaaaaccccatccccgccattctttcctgctctaagccatgatttctagcagttactacatctttttatcactatgacccaggttgggtggcctttttctatgcctccagctctaactgtactccagtaacactatttttctcttgcccttaggccagtcataacctctttctattgtcattcccttggtgctgcaatgttcctttttatttttcttcaccctgtccagatctaaagtcatccttattaaaacttcttgaagtagattctgattcctgcatgactgactcagacattagcaataagaagcactacataaaacatttgactgtcaagattccatttttggatgtagaaataagatgagaaacctgaggaaaattcccaagtcgtgatctgtttagaaagtacctatacttggaataatttgactgttgcttcctcctgctctttatcccctggtttcttaattatcacagctagatgttcagctgttggtattgtctgtcactgccaataccacatgtgtctattgtggccataactactgctttctgagaggacttggtcatctactgtaaagacctgattactcactgtgaccagaagccctttaagattgaatgaaggaagatgaggctttttcagctacattattaaaagacagttgcagctgcaataaaacatgcattggaatttattcagcactcctgtgtgcagccccttgctcctcctgcttttgaacgttgatggatatgacattgtgtctaatctcagttgtattctatggtacttgtcttggagctggttctctgacttgactcttcatttagcttagtggacttgatttcctctcatttgactaccaacttttgattttctttaaatcttgcctccagactacaaacatgccaagtatcgtgcatcgtgtgttgtttctttcattgccgttcctgccaccatcactcttggctttgcctctgctgctgccattactttcaccacccccacccaccaacacacacacacacagatatgcacacacacacacgtgctgtattgtgttacagacaaaggtctgctatctttgccttcctgatcctgccttccctactatcagtcaccctttaaccactgccaccatcccctctaccatcaaactagcaatttactggtctttttctttcatttcagcccttagactgagtttccaagtatccaagtccccaatgattataaaatttgttactttggatttttttttaacattgcagatttattatcaagggaagtgagtcctgaaggattcattcatttggggtttatagcagatagacatgaatatatttctctcttaaaaaaacagaaataagcctttgatggtttggttattttgacataactttcactttaatggtggttttttccccctttggactgtatttccaaatcaaaacccttttaatttgatgatggagaaaatcttatatcctagatgcataaatgttttgtgttgtaaagtttctatatcagaaacccaatttcctggttaagataggaatatagttttaaaaaggtgaaaaaaaatgagccttatacatatcgtctttcctattaaaagtatacaaggaaaaaaatggcagaaatgaaggaaataactaagttaaagagacatgccaacttgatccagaatttcttccctggatcctgggctcacagatccaatatgcagtcttttttaaacagtatgcaatatagtgctcttatttttaaaaataatatgattctaatattgatacctgttataattatgaatcactgataaaaagttttaatttttcacttttattttcaaagtttagagctgaaattattaagaaaatatagaaaaactgcggaagatttagggatcattaatagtctctcacacgtttcaaaatgggattctaaagaaagattaaaggaattagaaatattcagtagacagaaaagataaagatacagttgccttcagggagttaatgggtactggatgttcctttttcttccttgaatgtaagaagagggaacagtgttatatgttagcaagaaaagtaaaaaccatagttatcgtgtggacattttcaggattatctcttctgaagttccttaaagatagacttatctgggaaatatttcagtattttccaaattcaattcagtagagacacaatttatcagagatactcactttctaagatttccttggtcaaaacagcttgacaaatatctcatattaaattcctctcttggatattagcaatctggattagcatatttaagaaaaatttctggaaagaaaagagctgttgaagtctgtttaatgcttaggcaacaaagtttgtttgcacaagggaagaattttttcccccatagcacatatcacattctttagtttcctcttaacacctgttcaagaagcactggtttaaagcctggagaatgaatttctaaacctgttgaggctcattgttgagttttagtattatattaacaaatggttataaacttgtgaaatttaatccaatggatgaatgggagccaaataagaaatatgcgggaaactatatagaggaattattttgaggttgagtaaatgcgttatgctcctattcccataaaatgtgtcccaaggtgtagaacacaaggaaaaatgtgctcatctcacatctttgaagaagctgaagtttatttcttattgttaaaaggactgctcattcacctgcaaaaaaaaaaaaaaagtacaggaacaccttggatatattgtaggttttgttccacatcactgcaataaagcaaatattgcagtaaaatgaatcacacaattttttttgtttctctagtgcatataaaagttatgtttacactatattgtagtcaattaagcatgcaataccactgaatctaaaaaaaaagcaaaatacgtatcttaatttaaaaatacttaaagctaaaatgctaatggttatttgagccttcagtgagtcttaatctttttattgctggagggtcttgccttgatgtttatggctactgactgatcagagtggtggttgctaaaaattggggtgactctgggaactttttcaaataagacagcaatgaagtttgctgcatcagttgattcttccttttaggaaagatttctttgtatcatgcaagtcagtttggtaggattttacccacagtagaatttctttcaaaattagagtcaattctctctcttagttgctttatcaagtaagtttatgtgatgtactaaatcctttgttatcatttcaacaatgtttagagcatctttaccaggagtagatttcatgtctttgacatccacaagatgcaactcctcatccattcaagtttgttcatgacattgcagcaattcattcatatctttagactctacttttaattctagtttttttgctattttttttaaccaaatctgcagttacttcctccactgaagacttaaaccactcaaagtcatccatgagggttggaatgaacttatttttgctaatgttgatattttgatctcctcctgtgaatcacaaatgttctcagtggcacctaggatggtaaatctttggaagaaggttttccatttactttgcccagatccattagagaaatcactatctatggcagtggtagccttacagtgtatttcttaaataataagacttgaaagttgaaattccctcttaatctatggggtacagaatgaatgttgtgtgagcaggcatgaaaacgacattaatcttgtacatctacatcagagctcttgagtgactaggtgcgttgtcaatgagcagtaatattttgaaaagataggtctgaactgtaggcttaatatattcagtaatccatgctgtaaagagatgtgctgtcatccaggctttattattctatttatagagcacaggcagagtagatttagcataattcgtaaggatcttaggactttcacaatgataaatgaccagtggtttcaatataaagtctctagctgcattagcccctaacaaaagagccagtctttcttttgaagcctgcaagccagacattgacttctctctagctatgaaagtcttagatggtatcttcttctaatagaaggctgtttcactgacattgaaaatttgttgctttctatagccaccttcctgaatgatcttccggataaatggtgcagcttctacaccaggactttctgcttcaccttgcacttttacgttataggaatgtcttctttccttcaacctcatgaaccagtctctgctagcttccagctttccttctgtagtctcctaacctctctcagccttcacagaattgaagagttagggccttgctgtgggttaggctttagcttagtggaattttgtaggtggtttgatcttttatccagactactaaaactttcttcatatcagcaataacgcgttgttttgctttcttaacatttttgtgttcagtggagtcacacttttaattttcttcacgatcttttcctttgcatttacaacttagctaaccatttgaaacaagagccctagcttttggcctattttggttttaggcatcccttcctcaccaaacttaagtatttctagttttgattgaaggtgagatatatgtgactctcctttcacttgaacagtgagggaccattgtaggattattaattggcctagtttcagtattgttgtgtctctggtaatagggaggcaggaggagaggcagagagatagggaaatgatggttagtggagcagtcagaacacacatatttgtcagttaagtctgccatctttgtggatggggtttccaacacccgggcacaatcacaatggaaacatcaaagatcactgatcacagatcaacgtaacagatgtcataataatgaaaaagttgaaatacatgagaagtgccacacaaagtgagcacatgctgttgggaaaatgacaccaatcaatttggctaatgcagagttgccataaacttccaatttgtgaaaaatacattctctgcaaagcccagtaaaaagaagtgtgatcaaacaaggtatgcctgtatttgaagtatacattaaatctgttaaaccaccaagtcatgatgtaaattcctggttgccttctgtattaatctaattttaatattttgaaatgaacctgaaaaatctgtattgtaggaagtcaaggtgtgtattagcccctttaacttcaaaaccatgacatttgcagtcaaattatgtaaaaatatgtataaacagcaattaaatttggagtaatgaatgtgtctttgcaagttagaaaaatgccaataacatttgggatcttaaatctgttacgcagttttcaatgtgcagtgatttgtgttgagtgcattgcctgtttatttttgattttaaaatcattaattattgaaaatcttaatgctataaaaaactaagtggggtttttcgtgtataaagagtattgagttatttccattgtatttaaaatgtatcaaatgtttatttttcatgtaaaattactgatcatattttctatcaaacaagtttttcattatacagttaaattggtttcatctctccttttaataaagcagatcacattgttcctgaatccagccaaaaataatgtgtaacattcaacgtgtgtaatattctccaaggaaaaagagattcctgcaggctaatttttgtaacttcactttgttagcatataaatgactggatagggatgtttgtattgaaaggtttaaattttacactagttttcttgtgtactttcagtaattattgagtcttaatattaggctagaaacaactctaaaattattttcaagattatattaaaatattaacttttgaaagttatttgattaattctattaatcagaggtctgcaggatttgataataaataccatggcagacaatatagcctagagtttctgaatttaaggatgttaataacttgactgctgttagttgtagtaataaatctttcaaaatttatacttctgcctgattaattatagtatgacttggtctaacaagtaagatacacacatattacatatatcttttaagtaacccagcagcctatagtactaagtaaatataatataatactatacaaccagtttacggaaatgacagagtggtttgaagccagttggggtctataatagaacacttgtgtcagcagtctttccaggggaggcaaatggctgtatattttaaagtggaaacacaagatttaaaattaaatgccagtcaggtgttgtacctagtggctataatccctactactaggaagactgaggtgggaagatcacttgatcgcaggaattggaggctgcagtaacctatgatcatgtcactgcactctagcctgggtgatggagcaagaagaccctgtctccaaaaaaaaagaagttttttaaaaaaattgcccaatttttatatttttactttaatagtatatatattatatatatactatatatatatatacactatgactatatatatagtcataaaaggataaattgaagctctttgtgattaaattattaattttttgaaactgtactcccaataccattttatatgactttattgattatgatttctgttgctttgataatttgaaaattattttctatttttgaaagcatttaatgagaatggaaaaagaagtaaataaacatatatattgtatgtgcagtatcaataaggatgcacacagcacattttaaaaatttactttcagacttagacttttggtatttaattttcaattttcaacaatgtttacttttctggcaatttatgaatttttgttgctttaggaagaaaaacgtgtaaacattacgcttaaggtgcaattattttctagagaacaatttcattgtgttttcttagtagaaagactatagtgctagttaaacccataaccgttaatattgaaaattgtaatgctgtaaagaacttgaaggaatcatatttttcaaggtaatacaattttgaaatagataatttacacctactcatgcttattcattgacagcatatcattgtataaatggctcacttaactgatcagtgaacatgcattcttggataataaccaacataagattgtatcgatacttcggtattaatttgctcgtcatttttgctccagtctattttttgtgatatctatgtataattttaacttgaaaagatctgcaaaaaatatagtttgaaaaatatcacatatactgggcatctttctaaaaaggcaatatcactggaatacaatactaagattataggaatttagaattacagtcttgtttataaaatcctgacttaaacatcgttttaaaaagtttaatggctgctcttctaaggttgtcataaaatcactttcatatttgatattatgttttatgcctagataaaacgatagatgtctgtggctccatatctgtataacagaaggacagcaggtaatgctgctcatcaaaatgaataggctgtaatatctataaaatggaagataaaagttagacttctgcttgaatgaaatgagcacgggtgtgatttcatgcaggtctggtatacatttatttcaccttctgccatcttttctcccagtctggataaggcaacttctgcatagttgatttttaagctaaaaattacaactattaatttaaatacaaatgtgtggattttggtctttcaaaaaaatatatatattcactattttactttatttaatttggttccttgaagaaaatggacatttctcaaaaaagctaaaacttgaaaatgcccttactatattagtttactttttatatttcctggcctcaacggctggatggtcacaactatatattgcagtgtctatctatctatctatatatacacatatatacatatgtgtgtgtatatacatgtgtatatatgtgtgtatatataaatataaatgtggatagatactgcagtatatagttgtgtgtgtttgtatatatatacacacatactcacacacatatattacattttgtagccctttaacattacagaaaatattttctttggtgttttattctgctgcttcaggaatgcaatatgcaaggacttgtattaaaaaaaaaacaaggacttggccgggcgcggtcgcggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaacaaggacttgtgtgaagatctattatggtttcctgtcagttggtgtcttttgttttatttggtattctagtaaaatgacctgttccttaggtatggttaattaaagcttaagttaattaaagattaatatccaggctcaaaactctttatacatgtttcaatttacagaagcaaaacctgagacttggagaggttagataatttgccaatgatctcatagctagtacatggctgaactgactccaattcctgaacattttgctcttcccatacagtgagctcaattggtaccgtctgcactaatagagtaatggttttagagcctgctgagatatgttggacagttttcttccacattaaatggcttcagattgctaaaactttggagccattgtgttttctacatatcagcagccttattcttcattcttgttgaacctagcagggttttctttgtgcttgcaccagggaagccaagcattattttagaacatcagaagacagggaagtttgggaacactttaagttcacactgaccaacctcagataagcccttagcagaacctggcaatatgattgctcttctttagtttcctgatttgtgcaatgaggttttcaaaacttctccacctctaacagacatttgatctatccacccttgcccttactgtgagcagattacccctgtttttgctttacagagaaaataaaagctatcagatgcaaattccattaattttccttcttttttcttttctttttttctttttttttttactattattatactttaagttttagggtacatgtgcacaacgtgcaggtttgttacatatgtatacatgtgccatgttggtgtgctgcacccatcaacttgtcatttagcattaggtatatctcctaatgctatccctcccccctacccccaccccacaacagtcccggtgtgtgatgttccccttcctgtgtccatgtgttctcattgttcaattcccacctatgagtgagaacatgcggtgtttggtttttttgtccttgcaatagtttgctgagaatgatggtttccagcttcatccatgtccctacaaaggacatgaactcatcattttttatggctgcgtagtattccatggtgtatatgtgccacattttcttaatccagtctatcattgttgggcatttgggttggttctaagtctttgctattgtgaatagtgccgcaataaacatacgtgtgcatgtgtctttatagcagcatgatttacaatcctttgggtatatacccagttatgggatgactgggtcaaatggtatttctagttccagatccctgaggaattggcacaccaacttccacaatggttgaactagtttacagtcccaccaacagtaaaagtgttactatttgtccacatcctctccagcacctgttgtttcctgacttcgtaatgattgccattctaactggtgtgagatgggatctcattgtggttttgatttgcatttctctgatggccagcgaggatgaacattttttcatgtgttttttggctgcataaatgtcttcttttgcgaagtgtctgttcacatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagttgaattagaacccatttgtcaattttgacttttgttgccattgcttttggtgttttagtcatgaagtccttgcccatgcctatgtcctgaatggtaatgtctaggttttcttctaggatttttatggttttaggtctaacatttaagtctttaatgcatcttgaattaatttttgtataaggtgtaaggaagggatccagtttcagctttctatgtatggctagccagttttcccagcaccatttattaaatagggaatcctttccccattgcttgtttttctcaggtttgtcaaagatcaggtagttgtagatacatggcattatttctgagggctctgttctgtttcattgatctatatctctgttttggtaccagtaccaggctgttttggttactgtagccttgtagtatagtttgaagtcaggtaacgtgatgcctccagctttgttcttttggcttaggattgacttggcaatgcaggctcttttttggtcccatatgaactttagttttttccaattctgtgaagaaagtcattggtagcttgatggggatggcattgaatctataaattaccttgggcagtatggccattttcatgatattgattcttcctacccatgagcatggaatgttctttcatttgtttgtatcctcttttattttattgagcagtggtttgtagttctccttgaagagatccttcacatcccttgtaagttggattcctaggtattttattctctttgaagcagttgtgaatgggagttcattcatgatttggctctctgtttgtctgttattggtgtgtataagaatgcttgtgatttttgcacattgattttatatcctgagactttgctgaagttgcttatcagctaaggagattttgggctgagacgatggggttttccagatatacaatcatgtcatctgcaaacagggacaattttacttcctcttgtcctaattgaatgccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacctcccatcaatacctaatttattgagaatttttagcttgaagagttgttgaattttgtcaaaggccttttctgcatctattgagataatcatgtgatttttgtctttggttctgtttatatgctggattacgtttattgattttcatatgttgaaccagccttgcatccgagggatgaagcccacttgatcatggtggataagctttttgatgtgttgctgtatttggtttgccagtattttattgaggatttttgcatctatgttcatcaaggatattggtctaaaattctcttttttggttgtgtctctgccaggctttggtatcaggatgatgctggcctcataaaatgggttagggaggattccctctttttctattgactggaatagtttcagaaggaatggtaccagctcctctttgtacctctggtagaatttggctgtgaatccatctggtcctgggctttttttggttggtaagctattaattattgcctcaatttcagagcctgttattggtctattcagagattcaacttcttcctggtttagtcttgggagggtgtatgtgtcgaggaatttatccatttcttctagattttctagtttatttgtgtataggtgtttatagtattctctgatggtagtttgtatttctgtgggatcagtggtgacatcccctttttcattttttattgcatctatttgattcttctctcttttcttctttattagtcttgccagcggtctatcaattttgttgatcttttcaaaaaaccggctcctggattcattgattttttgaagggttttttgtgtctccatttccttcagttctgctctgatcttagttatttcttgccttctgctagcttttgaatgtgtttgctcttgcttctctaattcttttaattgtgatgttagggtgtcaattttagatctttcctgctttctcttgtgggcatttagtgctataaatttccctctacacactgctttgaatgcgtcccagagattctggtatgttatgtctttgttctcgttggtttcaaagaacatctttatttctgccttcatttcattatgtacgcagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttgtaataggtgtggtgtggtgctgaaaaaaatgtatattctgttgatttggggtggagagttctgtagatgtctattaggtccgcttggtgcagagctgagttcagttcctggatatccttgttaactttctgtctcgttgatctgtctaatgttgacagtggggtgttaaagtctcccattgttattgtgtgggagtctaagttctttgcaggtcactaaggacttgctttatgaatctgggtgctgctgtattgggtgcgtatatatttaggagagttagttcttcttattgaattgatccctttgccattatctaatggccttctttgtctcttttgatctttgttggtttaaagtctgttttatcagagactaggattgcaacccctgcctttttttgttttccatttgcttggtagatcttcctccattcctttattttgagcctgtgtgtgtctctgcacatgagatgggtttcctgaatacagcacacagatgggtgttgactctttatccaatttgccagtctgtgccttttaattggagcatttaggccatttacttttaaggttagtattgttatgtgtgaatttgatcctgtcattctgatgttagctggttattttgctcgttagttgatgcagtttctttctagtcctgatggtctttacaatttggcatgtttttgcagtggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaacgttgatattggcccccactctcttctggcttgtagagtttctgctgagagatcagctgttagtctgatgggcttccctttgtgggtaacccgacctttctctcgggctgcccttaacattttttccttcatttcaactttggtgaatctgacaattatgtgtcttggagttgctcttcttgaggagtatctttgtggcattctctgtatttcctgaatgtgaatgttggcctgcattgctatattggggaagttctcctggataatatcctgcagaatgttttccaacttggttccattctccccgtcactttcaggtacaacaatcagacgtagttttggtcttttcacatagtcccgtatttcttggaggctttgttcatttctttttattcttttttctctaaacttgtattcacgcttcatttcattcatttcgtcttacatagctgataccctttcttccagttgatcgcgtcggttactgaggcttgtgcattcgtcacgtagttctcatgccatggttttcagctccatcaggtcccttaaagacttctctgcattggttattctagttatccattcatctaattttttttcaaagtttttaacttctttgtcattgtttcgaacttcctcctttagctcagagtagtttgatcttctgaagccttcttctctcaactcgtcaaagtcattctccgtctagctttgttccattgctggtgaggagctgcattcctttggaggaggagaggcgctctgatttttagtttccagtttttctgctctgttttttcctcatctttgtggttttatctacctttggtctttgatgatcgtgacgtacagatgggtttttggtgtggatgtcctttctgtttgttagttttccttttaacagtcaggaccctcagctgcaggtcagttggagtttactggaggtgcactccagaccctgtttgcctgggtatcagcagcggcggctgcagaacagtggatattggtgaaccgcaaatgctgctgcctgatcgttcctctggaagttttgtctcagaggagtacctggccgtgtgaggtgtcagtccgcccctaatggggggtgcctcccagttaggctactcgggggtcagggacccacttgaggaggcagtctgcccgttctcagatctcaagctgtgtgctgggagaaccactactctcttcaaagctgtcagacagggacatttaagtctgcagaggttattgccgtcttttgtttgtctgtgccctgcccccagaggtggagtctgcagaggcaggcaggcctccttgagctgtggtgagctccacccagttcgagcttcctggccactctgtttacctactcaagcctgggtaatggcgggtgcccctcccgcagcctcgctgccaccttgcagtttgatctcagactgctatgctagcatgagcaaggctccgtgggcgtaggaccctctgagccatgtgcgtgatataatctcctggtgtgccgtttgttaagcccattggaaaagtgcagtattagggtgggagtgacccgattttccaagtgccatctgtcacctgtttctttgactaggaaagggaattccctgaccccttgtgcttcccgggtgaggcgatgcctcgccctgcttcggctcacgcacagtgcactgcaccctctgtcctgcacccactgtctggctctccccagtgagatcaacctggtacctcagttggtaatgcagaaatcacccatcttctgcgtcactcgcgctgggagctgtagactggagctgttcctattcggccatcttggcttcctttttttttttgagatggagtctcgctctgttgcccaggctggagtgcagtggcgcgatcttggctcactgtaagctcttcctcccgggttcaagcctcagcctcccaagtagctgggactacaggtgcccgccaccacgtccggctaattttttgtatttttttggtagagacggggtttcatcgtgttagctaggatagtctcgatctcctgacctcatgatccacccgccttggcctcccaaagtgcaggattacaggcgtgagccgcggtgcctggcctaattttcttgccggctttcacattcaaattttcttattgctatgttgacatgtaagtcatattttgttgaatacttacagtatgtataatttatacactgtggatactgatatgaacaggcctgttttcctggtctctagtacttatcattccatagtagagacagaacataaactcatatttaaatgcattagtcaaggttatctagcgaaacagaacccataggagagagatagattacttgatagatagatgattaatagtacaataggagattcagggatacctcagaaatactgtgtgttcggttccagaccatcacaataaagtgaataacacagtaaagtgagccacagacattttttggtttcccaatacatatataaattacgtttacatgacactgtattttaatgtgtataacattttatctaaaaatgtacataccttaattaaaaatattttattgctaaacagtactaatgatcactggaaacttcagtgagtcttaatctttttgctggtggaaggttgtgtcttaatggtgatggctgctgactgatcggggtggtagttgctgaagattagggtggctatgtaatttcttttcttttcttttttttttttgagaaagggtctcatattttcttttttcatgggctggggtgcactggtgcaatcacggctcactgcagtctccacttgccaggctgtagcaattcttcctaagtagctgggactacaggtgtataccaatacacctggctaatgttgtacgtgtgtgtgtgtgttttgtagagatgggatcttgccatgttgccgagctggtcttgaattgctaggctcaagtgatcttcctgtgttggcctcccaaagtgctgggattgggattggtagtttttttttttttaaataaagcaacaatgaagttggtcacattgattgatccttcctttcaagaaagatttctttatagtgtgcaagtcagtttgatgggattttacccacagtagaacttctttcaaaattggaatcaatcctcttaaactatgccactgcttttatgtatattctatatcatttgttgtcatttgaacaatgttcacagcatcttctctggaagattctgtctccataaaccactttcttcacttatccataagaaggaactcctcattcattcaagtttgttcacgagattgcagcaattcatttatgtctttaggctctacttttaattctagttctcttgctgtttttaccagatctgcagttacttcctccactgaagacttgacctctcaaagtcatccatgagggttagaattgacttctttctgctaatgtttatattttgatctcctcccatgaatgttcttattggaatttataatgctgagtcctttccagaaggttttcaatttactctgcccagacccatcagaataatcattatcaatctgtctatagccttatgaaatgtatttcttaaataataagacttgaaagttgaaattgcctcttgattcattgactgtagaatgaatgttgtgtaaacaggcatgaaaacagcattaatctcttgtatatctccatcagagctcttgagtgactaggtgcattgtcaatgagcagtaatattttgagagacattttattcctgaacagcaggtcttaacagtgggcttaaaatattcagtaatccatgctatgaacaggtgttctgtcctgcatgctttgatattctatttatagagcatgggcaagtagatttagcataattctcaagggtcctaggatttccataaggataaatgatcactggtttcaacttaagtctccggttgcattagcccttaacaagagagtcagtctttcttttgaagcctacaagccaggcattgacttgttctttctagctatgaaattcctagatggtatcatcttctgttatcatctttctttagaagaaagcctacaagccaggcttactgtagccaccttcatcagtgatcttagctagatcttctggataagttggtggcagcttctatgtcagcactttctacatgcacttttgtgttatggaggacatcttctttccttcaagtgatgaaccaatttctccatgcttccaacttcttttctgtagcttcctcacctctaacagccttcatagaattgaagagagttagggtcttgctctggattaggctttagcttgagagaagccccttgaggattttgaaagaatgttgtagctgttttgatcttttatccagactactaaaattttctctgtatcagcaataacacattagtttgcttttttatcatttgtgtgttcagtaggtaacacttttaggcttacttccaacttttgattgaaaatgagagatgtgtgactcttctttcacttgaacagtgagagggcattgtagggttattaactggcctaactttaatactgttgtgtcttagggaatagggaggcaggagcggaaggagagagacttgagaatggccagttggtggagcaatcagaacatacacaacatttatggattaagtttgctatcttagatggctgcagttcacagcactccaaaacaattacaaaagtaacatcaaagatcacagtgtcagcccattcacattgctattaataaatacctgaggttatataatttataaagaagggaggtttattttggcctgtgaacctcaggaatctgacaatcatggcagagggtgaagggagagccagtgcttaacatggtgagacctggagcaagggagtagatgccacagtcttttaaaccgtgaaatctcatgtgaaagagcaagaactgactcattattatgagggggcaccaatacattcatgagggatccacccccatgacccaaacacctcctaataggcctacctccaacatttgaggttacatttcaatatgtgattcagtggggacaaaatatccaaaccatatcaatcagtgatcaccctaatagatacaatagtaatcaaaacattttaaatattttgagaattaccaaaatatggcacagagacaggaagtgagcagatgctgttggaaaaatggtgctgatagacttggttgatatgtggttgccacaaactttcaatttataaaaaaaatgcactatgtggaaagtataataaagcaaacaacaataaaacaaggttagcctgtgagtatatatatgtgtgtatatatatgtgtgtatatatatgtatatatgtgtgtgtgtatatatatatgtttatagagatttattttacgttattggcttacactgttatggaggctgagaagttctacaatctgtcatctataagcagaagacgcagaaaagccagtgtagttcgaaggcctgagaacagcagagataatgatatagattccagtacaggtgggagggtggaaagaatgatggcccagcttatactatcaggcagaaagcaaattgaacattcctccacctttttgttctatttaggcccataagtgattggatgatacacagccatctgctttactggggagggccatctgctttagtaagacatcaattcaaatgctaatctctcctggaaacaccctcacagatacacccagagataatgtttaaccagatattcgggcacacttggcccagtgatggtgacgtataaaattaatcatcatcataaataaatataaatgatatttttaaaactgataagctctaagaagagagtaaagaggtgacatgaaacagtgacaagacaggaggtgaggatggggagaaggcagcatttactagtgtggcaaggaaagatacctcttgggaagcaatatagcatgagggttgagaacatggactgaggctcagattctactgcttactgcctgagtaatgctgggcaagttacttagactctctgtttctgagttttctcattagtaaagttagccttgtcagtatttacatattagtgttaatatgaattaaataagtgtaatgtgtttagaagagcacctggattacaggaaacattcaatgattgtagctatagtatctgtcaaagaccaattagcacattcaggagttcaaatgaagagagtttaatgaaggggccatttatggaggtgtaggattagatgatggaaccagcaggatgtggaaaatcacccaggtaatagtaacagtagaaagccaagccattactacccgtaagcatgaagagacacagggaaagaatgagagtatttaccagagcttggtgggagcagtagctgtgaaaaagaatcactggtgtcctttggagctcggcatatgatcttcttccttcagtctccataatcttaccttaaagatgattattttctgtatgatttagctgctcttgcatatggatcccctgacaagagttgtggtcataaagaaactcagccatggaggaagagttgcttgtcagggagaaccatgggagggtgataccctaacctatctcttcccatttttgcatcttctagcattacttactatcagaacatccaatcggaattcatgataagggaatctagaagatgtattcagtggaggatgatatcctgagccacagagaaagacacagaagggtggtgaatgagttgaggaggacattaggcactgagcttcattatcattatcatcaccattatcattattatcatcacagttttcatcattattaaatgacatttgagttgagaagtcaggccattccagaattagggggaatagtaccagaaacagaggacagcaagtttcaatgccatgaagcacagttgctgcatgtggttgtgcggattttgaaccacataagtgtagggggtgatattcaaagaggctaggttcacaaagcataaagacaagtgtgacttgagtaaaataaatatgggaaattgggggagagatgcaattgtaaggataaacaagtccagatcatttaggtttttagaggccatgccaaagaatttgaattttattttacatgtaacaggaaggcccttgaggattttaaataaggaagagatgtgatcctatctatatttacaaaagacaactttagatgctacctgaaggttaaattcttataggcaagcaagagcagaagaaacaggaatgatgtcacggtagtcttgctgagagataatagtggcttggcctaaagttgagattcagtatgtatgaaataaagcaataaggctatcttatgggttgaatatgaggaggtggagatgatgaaaaagaaaagaactaaagataattccaggtctttggtttagacagctaggtggacaagattggcatttatgcaagagtgaaagcctggaagtagaagcatgtattttgcatgcatgtgtgtggtgtgtgtaataggagttagggagatgggtaataggtaattgttgcagaaccaggagttctgagatttcaggatttgaagaatccaaattgacatattaaggagacagtccagagtacagagatgaattaaggcctgagatatacatttggatgtcattgtgatattgatgggatttaaaactatggaaagtagaagaggagtaaggactgaggccccaggtctgcctcagtgttaggaatttcagcaaaagtagagaaagcattggagagtgggaagaaacagagggtgagagaggagggaaatcactgctgtttatgtcatgagtgcaaaaagaagaaaatatttttttcttttgctttgttttgttttgttttgtttttgcataatcctgaaggtcagacgtcagaataaagtgtttttagaaagagggagggatcactggtgtcctgtggagcaatatggtgctggacataccaccttctttcattctcaggtatctcaccctaaagacgatccttctcttttctgtatcatttatcttctcctctgcattcgatcctgccaatgatcatttaaatatgctcaaatcttttctctcttaaaaaccaaaccaaacccaaacaaaccaaaaatcctacagactcctccccaaactccagatccagctacttctcccatcgtcaatggctccttctcatccaagagcagtctaacctctgtttccagttcctcatcacccactctctaatccacaagttgagttgtgattcttttggtaacaagttactgaatacccagatacaagtgacttaagaaatgaggatttatttttctattaagaagaaggttgcatgtgggaagttttaaggttgtttaattcagcaattcagggatgttggtgctctgcaatccccttggcttttttcttatggttgcaaggcagctgcagcagttctaagtcttgtgtctgcacttaggagatgtttatttttcactatttcacatttcactaaggaagaagcaccctttgagaagacactagcagacgccactagagtatcattggctaatattggaacatgtgcttcacccattctccagccacagagagcctgaaagagcaaagatctagcatctttagcctcagtggtgggagacactctgttaagaagaaagaagagggtattttattttgaatgctcagctcatagcccatctcttcctctagactaaattacatgatcttacagcagtaatctgttttgttgttcatcattttcttcttaatgctcagcccattgctcaactcagttagttaaaatatatttatttaatgaatgcacaaatacctttcaatgcattttttaaaaaaaatagctacaccaacaattctaatttcctgtttccactttgttagggattaaacaaatccccacgttttttcaggtgcatgtatgtgtgcatgcacatacacatgtgaatttaattgcaaatatgcttggaaagaatgactgataactttcttttaactaatgcataaactcagtgacatttctttgcttaatcagaggctacacatgctaattttctagttcttgagtttgttatggtaagcagagattgacaaatagttggcttccaggtaaatgagatattatttcattgtagaaaacaagatcatgagaaaccatggaagttttttccgggttcacattttaaaataatttctgaaataatctgaaggaaattaatgtctagttaaacttaaagatgcaaaataaaactattgccatcaatatatttataattttatgctataatgataagccatacacagacctatttcaagagtccttataatatgtttgagtaataggcaagtcctcagtaatttgcagttaaatactataatagcatatttttgtgtatcaaatacatatttttaaagaagaaattataatcaggagccttatttataaagctgttatcaggggttgttaggaatttttgagcttttatttaaaacaaaaagattatgagaagcaattatttttatagcatatgtgaatgaaaattgacaatgcagaattattttttgctgtgggattcttagatacaataaacaataattttaaaaatcaatattttttaattaacatattaattaacacatatttggagagctactaatgtaggcctggtactgtgttaataagagttaattgaaaacttcaattgtaatatgtagttttataaatcatgtaggaatttttatgtgtgctctaattaccctttggcctcataatagtgcattgtaggtatttatgaaatactcataagatagctagaccaataaataatattaaattaaaggaggcaacatgcttcataactaatactacccacatgaccctcagaaaatggtaagccttcaggagacttacggcttagttgaggagatcagacatgtacaaaattataaaaagctgggacagtaagaagaaactgttattctctgttctttctttgaaacttggcatcgcttcttcccataatagttcaaccagctaagattgaactattaaagtgttgaatgttatcatctaagtactgtcacagagctcaagaactgaaggtatggtttttgtttgtgtttttgttttttatcatttctgggaacatgtataagtagaagtaccaatcactagaagctgcaactaattgtttggattctttgcagttatattgttggccaaaagttagatacactctatattccagaatttctattttcttggcccagaaagaagttgggtctacaaatggtaaggaaattgtaatttgtttataatccatttttttgatgtctacatggaaataaaagagaggttttctgggataaaccatagggaataagcattggacctagtatcccaacctcagttgactttgatgtcctcacagtgtgaagagctgcctagggaatgctctctcgccagccctaaggcacagtcctttccactcagcaatcttgcatgggtgagattgaaagagacttagtctatttctgtgattacatctggatggtatctcatacaaggatgaatcaaagagaaagacaatagtatggagagacagtagtttactctagaaactattgagcaccagggcggtctattataagcaaggcagatatatcttgtagtcaactccaaacaattaacacctatatgagccttgatgtaaggaaatcaatcaaagagactgaactgtccatgcatggccgaaatccttgattctgaatcaaaagggtggtaaagtaccaaattcagttagtgattttagtgagcactaggggaattttatattctagccaaacatgtggttatccaatccccttaggaaaaatgtagggtcctgagtgtactagttctcccagacccatttgtttttattttttttttgttcttgcattaatcatgcactatgctaaatattatatggaccacatcatttaattctcaaatgggggaaagattctattatgaccattatatagacatggatactgagattataaagactattaacttactcaacctcactctatttgaacatcagctgacctccattctgcataatatgatattgtacatatatgagaaatagaataataataattctcaagtcaacatcaataccactaactttcaacttcatttgacattgtcctataaatacttgtgatttagtaaacaaatattattgaatcatgtccggttactcacaaaagaaactagaaagattatctctctatatgatgtaacctgaaaatatattgtaacattctacaaaaaaaatctctcttcttccctggtttctcgttttgcctcctcacctactttttcaaatttttcttacctgtataggttaaatgtcttactacttagtagctgtgacagttttcctagtgcctcaaatcttcacctgtaaatttcacataagaataacatttatttcgtgacatagccatgaaaaagaaatcagataaagcctgtaaagttgtgcttctcaaaccatctatggtgaatgaacattttctataagttattatcaattgcagactgataaaacatcaaaaatcaattgtaagagaaattaagtaaaaaatagaattttttattattaggttcagtgctgttactgttttgaattcctataaaagtctttcaaagcttgctcagatttctttacttatctcattgcaaattgatagcaaatagttggctcattggcaatagtccattggccccattttgagcaacactgatgtaaagctcctaaaagagtgccttttacatattacatgctcaataaatatttgcagttttattgaaaataagcaaggtaccaatgacactgttagtttttacctttcttaactttttagctttctcctccaaaccactcttttcttcacaaaattttctccattagattttactacccccatcctcctcaatgcttttgttcctcttgctaatttattttgaatgtcccttaaagtttaattcctggacttaaggctctctctctttttgcgtgcatttccttgaattcttcatttcattagaaagtcaccttctccctgactccaccaccttctcccctggatttttgtcttaccatagccagtctccaattcacacacctctgcctcccaggtgactttaaccttcagccttgttaccttgctttcatatcagtgcaacaatcttctattgctgtctctaccatcatttatttctgtttcaacttattttgcatgcagtggttattatgtactattttgataactgtttacatttaaaataattgtcattaatttgttttcttaaaaaaatctggcaggaattgagaacttgacagtaccaaacaaattcaagaaaaggtgttttatattctgctgagactttattttggcagtaagtcctctttctagttcttctcttcaaaattcagtctgtgttttcttagcttccttcagtcactcactttttaattcctcacatctttcttgaggattatttgtaactctggtcatgctgaattgctttatataggagaggcaggatctccaccttgtcctaatccctctgggacactttatttgctcaatttagctctgagaataaatcatttgtttccagactatgggctagagatcagtagggcatgctaggatgtatgcaagtggtctgtgactctacaggtaacctctacccaaacatcagtcttattaactattctgaataattcaaactatactttcccttaaaaggattatattgttcaaaaacatgagtagaacattattcattgtaaacaacctgaaaacaaatcaatacaaaatatacataaaatgtgcttgttcttaattgtaacgctgtgttttccccacacttgaaattccatctccaatttcttttcatctctcttccatacagatctgttgctcccgctgaccttgtggtacattcagttccacattccaaccttaactacaaatgttagcactgactagaatgttctcttgtagtgtctctgccaattatcattcatttattaatactgttattgtcattatcatcatcgttgtcattgttgaattggctcacttcttccaagaagatgtcttggctaacttcttaaggcaagcagttttcaaagtgtgataagaggatccctcgggattcctggtatcctttcaactatgtatttgtgtgtgggtggattgtcttctaatacttcaagcaaaacactgtatcatgatagattgaatgaaggagcagatatggcaatccagctgtctcatattaatcctagcattaaatacacttgcaaaagtgtaaaatggcacagctcttctcactaaatgattttgtttttgaaaatattgttttatataaaacatttatattaatatataatgggtttatagttgttacttaaagataaattgatacataaatatacatttttcaaaattcaagcatattatggtaaatatccatagagatattctaaatattaaaaaaaaacctcttaacatcctcaatcatttctaaagtctaaagacatggagagaccaaaaagtttgagaattactgctttaagcattaaggtatatagggcattttgttactatatatatctgctcattctcttcagcttcataaataataataaatagcatttactgaaagtctactatggagaagcatgatatgatatgtgcattatctctatccacacagtaaacctgtaaattagctttcttactctaattttatagatgtggaaactgatgtttagagaaatcaaggaatccctaagttttcccaaaaactatgctggtagagttaggctactacttaactccaagtctctgctatttcttaatatttaccactattttgtataaatccacattattcatcaaaccacctcccatggtatcagttacaattttttttttttttttggagatggagttttgctcttattgcccaggctggagtgcaatggcgcaatctcggctcactgtcacctctgcctcctgggttcaagcgattctcctgccttggcctcccaagtagctgggattacaggtgtgcaccaccatgcctggctaattttgtatttttagtagacacggggtttctccatgttggtcaggctgctctcgaactcccgaccttaggtgatctgcccgccttggcctcccaaagtgctgggattacaggcgtgagccaccgtacctggctggtatcagttacaattctatatgcaaggagttaatgaacaaaataattattaaatagatagagtcagcctatctttagaaacccctaatggcagaggttagtcttcaaatgacctatttatctctagaactatttttttttgtggactattttttttctaaattattttcagtctgaattgcctcctatagacagtggaatattggttttgcaaatcaatgggtttcaaagaatgaacacaattcattcaacttctacttaagctttctaagcttaattctatattaattcacctgtagatgcttaatttgatctggaaacattttataattccacttcctgataatacgcttaggcatttctcgcagaggaattaagattttcaaagttatcagtacataattaagccttgttcaattaactggcctgctgccatgcttgcagggtgctgtgtcctgcgactcaggaaactgacacagcatcacagaggattctggcttttgtagacaagagccaacactgaagatgtaatgcttaggaaaaacacccaaatgagcaatccactttagttgttgctgagaacttcttggaggaaggagctttgcaggacaactgactcatcttgcagcaatgtgtaatgcttgtgctggaagagattctggtaggtgagaacaattatggcagcaaggggcagaaacatcaccccctagcacacaaaattacaaaagttatttgagaaagggcatttgtcagaaaaataataaatttggttttagccaaatttgatgtaaagcctatgtttttaacggaaatgccaagtaggtagttagaaatgtcagaatgaacatcggaaaataataagacaaaattcatagaagtgaatgttttagattagaggtaagagatgaagtcatatttttgaaaggaaatcacaaacaataagctgaaaaagatgactgttaaactttgcataaatcctattgttatattgagagattaagaaaagtaaaacttaaaaatggcaaagaaaaatatggtagaacatgcagttggaatatgccagtgcctccaacatctagtgagaaagaagtttcaagaaagaagattccatcgacagtgtgaagtattccagagaaagtgaaataaagaggaggaaaatatttggcttgttaatgagaagatacttggtgacttgtgagttgttgatacgggagctagattacatgtcagtaaacatgagaatagaaatgtgataatagcttaaggaactagtggaaagacaacaattataaacaaagataaatagaccaggttctagtgaaggctgaaagttcaagttaggatgatgcatgcgtaacttgagggaaaagtttcatcattttcaggttgtctagtaaaaagatgaaagacatattcattgagcaattgtggtatagagacactgtcttaggtgcttgaatatagcagtcaacaatcaaaaccaagatatctaagctgtggagcctgagatctgttttgaatatttaacaggctcctagccctgggctaattaagcactattagaaggaacacactcttgtgttatatacagtgctgtgctggtaatctggcttactgggaaaaaataaaaataaaaaataaaaagccctgatagagtatttgaggagttcctagttgtaaatattcctgtactgtagccaatttctagctaccaagataataccactggtgtagagttgggaaggaggtgcagaataggctcctgagttggctgcaacagagcgctggtactggtgtgttttgttttgtatgctaggtgtattaacatgcttctaccttcgttttattcatatgtaaaataggaaaaatattttgcaacttttatgaagttgtttattgatgaatatttttggtggaaccaaaaactggagaaatgcaagctatcaaattaatcagcataagtgaaatggttagacatttacatgtgaaaacaatattaaatttagatttggaaaaccatagacaattaaaattaaactcacagatggtagacaactttagaaatgctgtaatacacctcacttacctaacgtcttcagggaatgagctgtttcatttaagtgaattttcctaataaaacttacagattcaagcactagcacattttcatttaaacaaatttatgtggaaacctttcaaaaatggattcaaaaatttgttgccttctttatttttataacacatattttgaatttcaaaataatacgtgatcattatataacatttgaaaataaacacatataaaggagaaaataaaaatatatttctaatctcatcagaggaaaccagtgttatcaagatgatttaatttaattccatcttcttacttacatgtatatttttaagtaattgaaatatttttaatcaaatatatgttacatgaatttatttgcaagcattttctcacatcattaaatattctgtaaatgtatgttttttaaatggcagtactattttgtcaaatatgtgcactagaatcattttaaatatatacatattgttatcgatagtaatttacattgcttccatttttcataattataatgtgctgcaaagaataacctcatatatctctttctaccttaggacatttctaattataaattcctaaaaatggaattagtgggtcaaaagataaggttattgttttagacaattaatgaagttggtcaaattttagtgcaaattggtcaaaccttgcctgcagaaaaagtatgacaattaatactttcactagaaatgtatgagagtacccatctctctgtattccttgtcatcagcagacattgccatctttatcattgttttcaaacaatgtgctacatgtcataatgattcagtcatcatcatgtttataagtgagataaatgagataatgtatggggtaacacctagaacactccatgacacatagtcactatttagtaaataactaggtcaaagttgaggcttaacacaatgtttatctctcattcacatttcagtgtgagtcaatgagtccatgcagtcctttagagatcaaggcttcttccatctgttggcttcaccatcacttaaggccttagaatccttgcttcaaaactcacttctgtttagtggtgaccacaggcaatctaaggcatagttgttaatttgagtaaatttttgttttattcatatacaaagatgcacctgtgatttattaaagatcataagcctgtttgccaccactataatgcattttcttctttttattacctttatgtctcagacaaacacatactatactggttcatgattgcacactgaatgtctgcccctcttctaggctggaagcactttaagagccgcgggctgtgctttattcaacttactctcttcagcacttgatatggtgtctggcacttattaatattcaatgaataatgattgggtcaatgaataaataactggattagtgtatgttctttttgttcctttgcctgcttttgtggtttcattcatgtggccatatattctctcagtgaatctccctctcctttcaccagttatcctaattttcaaacctcttggaacttctgggatggtatatataaaatagaatattaactgtctgtgggcctaaaataactcttgaagtagttaagcttagaaactttaataaaattcctttatatcaccactgccttactctctggcccattactatgttctggggaactgaggccatcaaatacacaaatctgaatgagtgaggcacattttcacatcaatgtaggtggatactctattacctaaaaaagaaaaaaactggatgtgcattatcctcatatgatgaataacctttttccgtcagtagtagtatttggcatatttgaattcaacgttttcccatgttttgtgtttcctggaccaggtcttctttggaataaaaggaaacaaagagttcctgggatatcaagaaggttctgtccgtttaatgacttttaaaaaatagcacatctatagtaagtgagttgaatcaactcagtttcatattatggtttaaaaaaactgaaaataaaaaaaaattgttctaagagttatccactgcaatggaattaaaagccagtgcataataggaaactgtgttctggagttgaggaactgatctgacttggtgtgtgactagggtattgcaggatgagctgcttcagattccactgctactggatatgtggtcttcatatgaaaaacaagttttgtaatatctgttctgtctccatcagaagtttattaggcttgagatcaaatattcagaagaaataaaactgttatcaatacttaaagcaacactacttattttaaataatacactattgatacttcttgtaaagccttaatttttaaattttttccagttcttactggtaaaatgaattttttcaaattacaataatttgtcttgaataatttattttttattataaaagataatgtacctttaaaatggtttctaaaatctcttttcaaagagggcaactttgttaatttccaactaggctttcaccataagtaggcatcccaaacatagcaatacctcccagattgttaattagttctcctactccaagttacactgatgatcccctccttttctaatagttcctaaggaagcagtctgattacacaggccattgcatatttagttggccaattaaaatctttgtcatttcaaaatgttccttggcttgtatcacttatgccagcaatctttacgattcaggagaatattcctaaggcagatggatgctaactgacatttgggtgatgcctaggaagcagagttaagtcctcagaaagttggcatatgcacttttaaaaactaaaaaaaaaaaaaatgcattcacaatggtgtgtaaccaccacgtctgtgtagttccaaaacactttcaacacatcagagtaaaaccccttacccatcaagcaatctatccttatttccccttcctcccagaccctggtagccgccaatctacattttgtgtttttcaaaacttcttaatgtggaagtaatttaaaatttataagaagttttaaaataaaaataatacaaagaacacctacatatgcttactccagttcatctgttgtaaacatttacctcatttgcttctctattatatatgcatacaatatataataattatacttttatgttaattatatatgattatatatatatgtataattattttctgaagcatttgagggtgaccctcagacatctgtgtggtctggacatatgttctcagattcaactttagaattgacttgccctctttcagtagctgccaggggtgcatctaaaacacagagatgattgtatctctaatatgctcaaaacccaatggggacttcttttttaaacagagaaatctcttaactgctttgcaagggcattcagtgtgcaccacaccttgtttttaaacatcctgtcttgcctcttctgctgtctccatttctttttctttcatcaaccccatccacactgaactgcttatgattgctagtgactgccatcatatcatcatatttttggggatttcttcctccagatatatacatttctctttctctccttgtgaaattcacccatggcccagcttaaatacatatttttgtttttgcttccctgacctcatcctttatccccaaacacacgtagcgcttgtagcagagggactaacagcatgggtttgtcttgccaaatcatgggtctgtcacttgttagccatgtgaatgtgagcaattttcttctcttttcttctgtttgttcttctgtaaaatgagaataataataatacacacctcctaaagctgttatagaattaaatgagagaacatttccaagtgtctaaaacagtctttggtagatagaaagcactcaataacatgtgaactacagttttagcaagactcagctcagtatattttgattaggtgtttatttatcaatctcccagtgcaggctatgggattcttaatgatgaaaacccttgtttattcatcttcatatctccagccttgctgttagtagagctaccttgtgaataataaatactgctaactctacaggtaatgcccttctttagacagagtagagtacaagagacatctcaaagtcacacaatttaaaagaaaggtggaatctgcactaaggaatctttagcctgtaactgcttgcatgctctggaatgagcaaacaaaaattctaattatctttctaggaaatggatcaaataaaagaattagttgatctccagaaaacaacaacaacaataaacgcctgcatccttacagcaaatttattaaaggaagacattgtactttgaagtactactgttgcctcgggtcagcattaagtttctaaattctgtgatatatctacaggtagattggttttttagggctgctgtaacaaagtacaacaaattaggtggatttagcaacaaaatttttttgtttcacagttctggagtctagaagtttgagatcaagacatcagtaggattggtccttctgagggctatgaggaacaatctattccttgcctttctttcagcttctggtggtttgcaggcaacctttggcattccttggcttgtagataaaccaacccattctctgccttcgtgttcacatggcgttctatctgtgtatgtagctctgtgtcaaaatttcctgtttataagaatgtcggccatattgggttaggggcccaacctagtctagcacaacttcataataaataattacgtctgtaatgaccttatttccaaataacattctgaggtactggggggttaggatattgacatatgaattttggtagggacataattcaactaataacaatagacttttagagaatgcctttaacatttattaaggatggaatatcaacagatgtgcttttgttcttcactgtccctccaatgaaaattgtttttgatgctgctttccagaacctaagtgttaagaggaaacacttaatgtttctaaacttagatttatgatacttgatattcctgtgcactagagaaattcctatctaaatagatagatttatgattgtgaacctgaactttgctgaagcaggcaggtttgcaaattttagcagtgttgacattccaagaaagaagataatgaattctagaaattcaaatctgattattaaggtagaagtgctggggttaatataaaactcaccagaagtaaaatatttagacaaacagtagaggtatcatagcatttagggacttggggaacattcaatccttcccttaagaaaaagtcattatatgtaaagtaatgcacacgctattctcagttctcaaacacagaaataggatgctgattacattaaagtaagaaatttgaaaatacctagcttcttaccctgcccagtggtaatatctcttaaaatttgaccacaaacatattctactctctgtttcctccactttttttgttttagttttacctgcagaaaaacttctgccatttctattatttttatccttagtcataatgtctttatgaatgatttcattgttttaccttccaaaatcttgcctcgtatagaaagtttaaatgtgagccatataagaaatgatgttccttgcttagaaagtatatttcaggagtacaatttgcagagttagaaattatattaaataattaaaatggagaatagtttcacttatcaaattgtatttgagttaaccttgagaaactctcagtatctagtattgtgccttgggtagaaggaatttattaatatcaccaacccccttggacttattaaaattatcctgtattcaatatttctgactgacattaatactttccctttttattactaacaaaggaatattattaacctggggtgggaatacataaaaaacgtcatgaggacacaagtgcttgaagaatttaattactgcgactatagcatcttttttctcagcatttttcaattgtcgacctaaaaaagaattgtctgtactatgtaaggcattttgactcaaccctgagtgtttgacccaaatggcataagtgaattgttttaatctgcccctttaggagtctgttggctttacggatcttgcatcatgaataattaaacagtgttggcctataaattccatcagaagcacagtatctcagagattcatatttatttcacaaaagataaatatattgaggaatcaaatctggcaattgtgtataaagcttattttcaagtataagaatttttttgtgcagtgagaattcaaaatcctcaatagacatcatgttagtaaccccacaacagaaatcccacataagtccattattgcttttaaaaccttcatattaagatttcctataaaaatgtaaatgttatgtctctgaatttgtgaattcaagctatcacacagtacgaaaatatagaaaatgttttgataatactgcaagttgagaatatgaactgtctcagcaagagtacctggcctttctagagtaatgaaacataacttcaaagaagactttattttctctatgcatttggatcattgaccattgggttaaaagtagagattaatcccccactgtgggaaatgagcattgaaatgctgacttgcagaaaagatgtttagaatgaattcaactttcccttttttaaccttcaaatatggaccttgaagttcaggaagacagaactatttacttcactaaaatagttgctgtttgaggactgtgtgctttgggtagtactcttctcagacagtgatgcagcatgatctatttcagaaaactctttcttttttcaccttcattctccctatcccaaattggctgtttataaatgaaaatattgtataataaaacaatacgttattttttgcattgtgcagtaatttctggtgtattttaaagtgtgcatttcctactcagttcccaaataaataatctcaagtcaacttctctgcatcattttgctggtcaggaggacaagccttctgtgtgcactacagctgctagatgctagcgggcgaataacacagccttcttctttaatgagacggcagatttcctacctctgaaaattaagaatgttggtctctgcagtaatttggcacagggctgcttttactttattaaatttcttctagtagcaataaaaagagtgccagcgttagcctcaaacccagggctagaaagaaaatatgttgttagcctaggccaggtctcagttgaactttttaatactgggtgtatttttttttcttcctcctgctcctcctcaccctcttcaacctcagcctccccctcctccttttccttttccttctgtttttctttctcttcctcctcttgctccttctccttcttcttctgaattctagtctgtttttatttgagagtcctcagaccactctgaactagcatggggtagaatcttcagtacttcatgaaagacttctccttcttagaactgagaacaaagaaagtaaaccggaattaacaaacaatactgaaattcacagattggaaaagtggcaattattctgtgaagcgttgcatcttcctaaaaaaaagccccaaacccttcaatttcttaagaatatctatatctatatgtgtgtgtgtgtatacaaactatatattctcatatgcaaatatgcagcacttaaatgaaatgttcaaaattatttatgagaaaaggaaaacctgagaatcacttgcctaatatgaggttattctgacatatagtttgattaatatgtatgtactgattgtcacagttttccttggttagtttcagtataaaatatgcatgttattattaaatatgcttaagaaatggcagaagttgggctgggtgcagttgctcacaactgtaatcctagcactttgggaggccgaggtgggtggatcacgaggtcaggagttcgagaccagtctggccaacatggtgaaaccccgtatctactaaaaatacaaaaattatctgggcatggtggtgcacgcctgtaatcctggctactcaggaggctgaggcaggagaattgcttgaacccgggaggcagaggttgcagtgagtggagatcccgccactgcactccagcctgggcaacagagtgagactctgtctcaaggaaaaaaaagaaaaaaagaaaagacagaagttatacataacaagctactatgattctgatactatgaaattttatgcaatctaaaaatagtttttatattatcttagatgcagcatcaaaattaccaatataaacttatactctggctaatagattttccaacatagaaaagaagtgtcttactaattaatttccaactcatcacctctgtaattactaaagtttgtgaaatatatataatttctaaactaacgttatttcaattacttgttagggcagtcaaagctatttatacatgaataacaagttattcatatatgctttaaatttttttctaaatgaatcattcttttgttttctgattatcaaaatcctttaaaagaaataataactatatagtctctctgtgtatatatgtgtacatttatatattcactatttagcatctgattactgagctctctaacatgctgtctcaaacatttaaagttatttgtcactgtttttatttccaaatcttaaacaaaatataagatttaaaatcagcttgccaaaacttcagcatcttatatggtttgctaatttttttcttataattctaacaaaaagcaaacctttttgggagcaaatacttcatcttgtctgccagtgaatccccagatccttatatgatgactgatacatggtgggagctcaacaaatatttttagcaagagttaattaatgactgatcacttattgcatagcaattaccactaatcattcctcaagtatgttttatctctttgaactaagcacatcactcttaatcagatttacaaaatttttggatgtgatgtaaatactctaatccttgcatttgagtcagtttctaaaagagaacaactgcaagatgttgttcaaaatcagttaattgggtctattaattgggtctatttattaactaaacaagcactgcactttaagagagtacagttaatgagatgaaaggaaggaagcaagtcattttcttctttaagaaattattgaagtcaacattgtattatgatattttatggctgtagttctctggctacagtgccttataaatattgattatttaagagtagagtaagacaagctggagaattacctaaggagaaggccaagaagacaactaacatcccaagtggccagtagacataattcaactcaaaagcaagtttggtttctttagatcagcagagtgctgcctgagtggggactctgtctctagagatggtgctaatgctagatgttgaaaataagttttgaaggaagcattagcaaaaagtcaaaattttataataaggtgcttaaaaatgagtttccttatattattctgtatgtgggagaaaaatttggataagtttaatgttgtaacttttaggagttaaaacaatcaggcaagataactacatacataattataaatctatttatcatctattttaaaactgctccaaaaaattgtggccttttttggtatatatgagcccatttaacactggaatgtaggtttcagaatgaacgaccagaattggtaaaggtctggagtcatagaagaatatagagcgtttggggaactgtgtaatgagtagatgtcataggtgatggagatgagactgaagaagtaaggccaggttataaagggtcttcctgtgctacactaaggaatctgctttatccattcttaaagtgaagtggcaaggtacggttgcattttgagccatcatttagacatttccatgaagggtaagtgggtgggtctttactagagatagagagaacatttagataatagataatagaacatttcagtatattacaagagatagaaaatgtatttatttgaatgtagaatggaagaaagatctaccattctccattatagattgattatgtgttggagaaagaaggggtctaggttgttaactgagtcaacgtagttgtggaagcaattgaaagggtgatggcgacactgattaagataaagaaggaagggaggaggaagaacagattgtagaagagtatgaaaaattcatgttttgatttgttgaagtggggttatctttaatgacctagtgaaatgagcatcagcagccagttggatatattgctcagtgttcaggggagagatctggactagaaatgggatgtcatttctagtaacaatgtaatgtaagtgggtgtcaatgcaatgtaatgtaaatggtgtcatttacatataggtggaaggtgaagccatgaaaagtgagatgaggtcaagaatgaaaccctgaccaggtgcagtggttcatgtctgtaatcccaccgttttggtaggttgaggcgggaggatcccttgaggccacgaattcaagatcagccttggcaacatagtgagaccttgtctctatggaaaaaaaacaacaacataaaaagccaagcatggtggccagtatctgtagtcctaactactcaggaggctgaagtttatcacttgagcccagaaattcgaggctacagtgaactatgatcctgccagtgcattccaaactgcacgaaagagcaagagcctgtctcaaaaaaagaaaaaaaataatgaaacctttagtattgacagatttgtaagggacaagcacagaaagggtagaaagggacctcctgaagggatctgaaactgaataatgagagaaacccaaagaaaatggaagcatggaagctagaggcagattaagaagttcatcatgcatttctctaatgataagtgatgttgagctttttttcatgtttgttggctgcatgaatgtcttcttttgagaagtgtctgttcatgtcctttgcccacttttgaatggggttgtttttttcttgtaaatttgtttaagtgagataccatctcacaccagtcagaatggcaattattagaaagtcaagaaaaaatagatgctggccaggttgtggagaaataggaaggcttttatactgttggtgtgaatgtaaattagttcaacgtttgtggaagatggcgtggcaattcctcaaagatatagaaccagaaataccatttgaccaagcaatcccattaaagggtgtatacccaaaggaacataaatcattctgttacaaagatacatgcatgcatatgttcattgtagcactattcacaatatcaaagacatggaatcaacccaaatgcccataaatgatagactggataaagaaaatgtggtacatatacactatggagtagtatgcaggcatcaaaagaatgagatcatgtcttttgcagagacatggttggatctggaagccattatcctcagcaaactaatgcaagaatagaaaaccaaacacagcatgttctcccttataagtaggggctgaacaatgagaacacatgaacacaaggaggggaacaacacatactggggcctgtagggagtggggagggagagcatcaggataaatagctaatgcatacagggcttaacacctaggtgatacattgataggtgcagcaaaccaccatggcacatgtttacctatgtaacaaacctgtacatcctacacatgtatgctgcaacttaaaaataaaaattaaaaaaattttttacaatgaacaatgtcatgtattggaaataggccaagtgaaacaaggacaaaatgtgaaaattgggctgggcacattggctcacacctgtaatcccagcactttgggaggctaaggagggcggatcacatgaggccaggagttcgagaccagcctggccaacatggtgaaacctagtctctactaaaaataatcccagctactccaggggctgaggcatgagaatcacttgaacctgtgaggcagaggttgcagtgagctgagattgagaatgcaccactgcactccagcatgggagacagagcaagaccgtgtctcgattaaaaaaaaaaagaaaaagaaaaagaaagaaaattggatgtggaaaatagtacttcaatctgactattacatgaggcatttcaatgtaataatcagggttgatatcagttgaagaactagaggaaatgagtatagactattctttcaaaagtcttacttggagaaggaaataggtaaaacaggatatactataaaagatgtctgtgtttgtttgttaaataaacaaggctgtttgcatgcagtggaaaaatactaaatagaaaggcatcatttgaagacataaaaataagggctatgatggaatggcttggttcctgaggagatggaaggcatgagaactagaatacaggtggctatatgtgtggcattgggcaagagtgaggatgaaggaagtaagaaaataaaagagtgaggaagagaggaaaagggccacaactgatgtaaattatagaatcccaagccagaatatataaacaaacatgggaatgtgttgactctcataattgggtaggtcaggaatagaactggttccatagagctggatacaaaggagcctagttatcacaatcgtgaaatctggtggtgctagcttaattttgtagacaggctttctttgtgtcattagtttgatggtcactgtgatgtccggattctacttgcattttagcctcaagggaaaagactcttccactcccagtgttggtatatcaacccagaggagttctgtgcatgaccttcattggccatgtgcctgtctcagatcacagacagaggagagggtgaaaaaccattatagagaccccagacaagaccacaggaaatggagatgagatgggaaaacaagaaaaaactgacaacaacagggaaaaagagctatgaacttatatgaacaatatgaacaataaagaaaaaaattggtataatttgagagagggcctaagtgtaagagagtaaacacataaccatctttatttttatttttatttttttgtagagttgtaaagtagaaagagaagttgttaaagtgagaaggatcagagtcaagttagggacttgcagacgatgatgatttccaactgtcattgaagagaaccagaaagaaagctggcctgaatatgtaaagagatggacaattttgggcatatattatttaagacagttgaaaagatactagagttagttcagacggtttggagtatattctagtgctgctgcattttgcttgtatgtgtttaggcaacatctcttctctggtcctctttttttccccccttttttatttgtacaaatgaaatgtgcaaaacatgtgattctcggtgctagccacaaacaaggtattgcattatggagtcatagactgagaatcagatgaaggacattaaagtgatctagaagacaaatgtatgacttgcttcctggaaaagaaatgacgaatgggtttctattgaaattgtccaactctcactgaatagaaaacgtaaaataaaccaaaactcacttttccttccctagttttaaaatatgttaaagatgagcctgctatattggtgatggtttgcacgtatgcactcagatttgaataaaccagtggagaatataaaaagaggaatagatccaagatgttactcatggggtctggataatactaagacagatttatagcagttactttccttatctcattacataattacccaatcaaggacatcaacaggatttagtctcattaaattggtagtaaatgtagtaaattttttaattaatcaataggaaatctctaggtaattcaactaggtgatagctttagctttttaattattccactcaattagtcaatcacttgtctagatctctaagatctttgggtaaatgtcacatgaatttattaagtataggttctttgaaactatctagactgtagccaaactccacatagtttagttaactttgctcatctcagaagaagtaaagtaagatcaattgggtatgaataataagtgcttcataagcacaatgagtgtacgtgtatgtgtgtctacacaaacccttaaattgcatttatcatgtgtcaggtattcttctaaatacttcacatacattaactcatttaatcttcacaaatatgcctttagatagatataattgttattattagactagtggtattctgatttttcagataaggaaattgaggcatagaaagctggcattcaaatcaaggcagtttggttccagaatctgtgcccccaataacacaatagttatgccataaatatatgctattttagagagattatttacacagggttaaaggtttttgtcagaattgacaggatttggtaatgttttataacaactaaacaaatatttattgttcaatgtctcctattttaaaataaaaattattttctgactaatataaaattatcatggaaaagattgaaaggaaactaaatattacacataaactgcaatgcagaactaataacgattattcattttggtctacttccttccatccttcttatgaatatgttaattgattttacaaaatttggatcaagtattaaataaacttgtatattttgtttctttcacttaacatttgattagaatcatatttctttacataatcttcaatatgactttgttcttcatttgttttggatgtaatattttcatatgaatgtatcatatgctaaataagtctcctattttgtttactttgaaaattcaagtaatttattatatcagataatattatggtcattgttaggcattttgaacattttttaaggtagctgcttagatgttgaaattattcaattaaatcatatggtttttaaggctttttaaaaaacaaacaaattgctctccaggaatattattattccagtttgcattcttaccagcagagtgtgacagtattcaattcatcacatactaattagcatgaatattttcatttaaaaaaatctttgacactttggtaagtgacaaaattatatttcattggtgctttaatttttatttctttgatattaaaatgacacattttatgtttgttattcatttgtgtttcttttatgaattgctgaggtcttttatcatttatctttcttgttatttacacataggcaatttgtttttcaaatccctctccactctccctacattgacattgatcattcagttttgtttgtggtaatatttgatgatgttcacttgggtgtaatcaagtcaagtggtcctccatgtgttatttttcattttgatagcatatatggaaatgcctttctcatgtttagattacagtcatctgtatacctttctagtgcttgtatgtctacattttttataattacactttgatacacctacatttctcctttatatgtgtgagaggaggacgtcaacatttctttccagagtactttggaaattactagtttaccatgtgatataattttttaacacattaatttttttccaggtggatctgatctcttcaggttttggtactctcaaattcctaccttcactcccagccccatctccacactttcaatacactatcagaaatttcctggatagattttcctgcttctgtaaattataaaacatttcttgatttttctcaaaatatgatgtagaaatttcaatttaaaaatttgctaaatccctttatattttaacatggtctcttaattttttgaacatttctctcggaggctattttagatacagtggtgagggaagatcattctgagacgatgacagttgggcagagagagctgagtgaagtgagggagaaaaccagaattattaacagacatgaaggaaaagcagtctaatgagagctaggttaagaagaccatgaaacctgataagaacactctaatttcctgaatgcctaaaactgtaggcagacaatgtccttaattattaacaactattattacatggacagaatcttaggcttcccagaattagaagggtaacttaggacaaaaaacgtctactttgataccctttctcattggtaggaataaaatcgcttagaatttaaatgtgttatagatctcgtaatcagtggtagaatttagagaagatacaaatcacttcacttcctgttttatatccagtcttttaagcctcccaacctccagtagttgattctgtggtactcatgttttgggaactatagattacctattacacagatattcttggtaaaaagctcctcaataattgaacacatctttttgatgttgtttatgttttttctttttgaaaaacagattctaaacttccaaaatgtaatttaaaaaatactaagagattctagttttcatatcaggatatagtggttaacacacttataatagttacattttgtgacagtctttttcattaaacatgtaaattagcctttctgactttttataactcaataggagggggtagaatttcatgaaggtcaaagcagtatgatgttattgttatagattgtgtagaaaattagcattaattggaaaatccacaaattaatataattaatgttattctactagtcccacaattttaaatgaaaggataacagtttatcattcaaacataccagatgttatatttaataaatacatttaatttttaaatgagaaaatatagaatctacaaacagttaaagacaaagttaatgatattgaacattttaaaatgtgagcaactttatttaaaatttatttttttaagtcttaagaagttgttccacttggagaaaaaagatttgctgatacatgtatggcaaaagcccctgacttatagagtggaagggcccttgcagatcatctagttcactaggaagatacagaaactgtggataagagaagccatttggcccacacccctaagaaacaaaagcatcacatgtcactcctctactactatcactgttcctttgaaccacataaatgaacagatcaaagggtatgtccatctttaatttcattaaactttgcctgaaatgtaacagtttataatacagtcagcagtacatgagagttatcatttctcccaattatttctggctttaaatttttactaatcttgatgctagtagattcaaacatcttgtcgtagatgtttaactacagatgtttccacagataacccagattataaaaggctataggaaattaaataatatagtatcaccataagaataaacagtagatcaattaagcaggaaaaaaccttaaacctatgtgtatttaaaagatatacaaagcagtggggaaagagttgctcactgagcaaatgatgctgggatattttaccacctatattgaaaaatacatgcttaatggatgacaaaatcacatccaaatggatttaagatctgtatgtgaaattcaaactttgaaacattttaggaaaaaatatctttttgatcatggggagagggatggatttgttataaattctcttaaaaattttctatttgttaaacaaaatttaaaagatggaatgtgtaagagaaataataaataagattcattaaaatgctagaaacacatttttaaagggcccgcaagcaaagctggcaaaaaaattcacagactgagtgtagatgcaatgcatatttctcttagaatcttaataagcaaaatattcatattaaaagtctccttcaagtcaataagaaataaactctaaaaggagaatgaagatggaacaaaagacataggccaatatatctatgaaaagatatttaactctacaagcatcaagactggtaaaaatttaaagcgtattgctgatcgtattataaattcttacatttcaggcaaagtttaatgaaactgaagatggacataccctttgatctgttcatttatatgactcaaaggaacagtgatagtgatagaggagtgacatgtgatgcttttgtttcttaggggtgtggaccaaatggcttgtcttaccctcagtttctgtgtttttctactgaactagatgttctgcaagggccccttccactctataagtcagtgactgttagtctattttcactttgctgataaagacttactcaagactgagcaatttttgaaagaaagaggtttattggacttacagttccacatgcttggggaggcctcacaatcattgtgggaagtaaggaggagcaagtcataccttacttggatggcagcaggcaaaaaaaaaaaaaaaaaaaaaaagcttgtgcaaaaactaccatttttaactctatcagatcttgtgagacccagaacagcctgggaaagacccgcccccatgattcagtcatctcccactgagtccctcccacaacatgtgggaattatgggagctacaaatgagatttgaatggggacacagagccaaaccatattagtgactttagccatatacacataacacagattataaaaaactataggaaatagcataataatttaattaataatcctcttttccctccttcaaaaattgttgtgcttatgtttactttctcttccgtttgaatttcaggattaatttttcaagtcccataaaaaattatgctagaattttgttgggagtcgtattgaatttacattaatgtaagaaaaattgccatgtttaaaatattgattctttccatttatgaacatggtttctctcttaatattttcagttcatctttcatgtccttcagtccagctacataattttctgcaaagaattcttgtatggttttgaaggacttactttgaggcatcttttaaaatagttattagaaatgacattgttttacaatgcatatttcctaataaaatgcaactgatttttatatatttacatagaatcccgtaatacttttttgcagatactttttcctacataggtaatcaaataatctgaaaataacaatatttagttttttcttttcatatctttccttatatatttttctgacattaatttggctaaatagtccaggaaatgtcacatttctttctttaggtcttatctttttgttttgttttttgtttgttttttaacctctcagaaatctggcaaggcctcccagtgtaatgttgagtagtgctagtgattgcctctttttctagtttctaactttatttttatttttatttttgagatggagtctcactctgctgcccaggctgcagtacagtggcgtgatcttggctcactgcaacctctgcctcccgggttcaagcgactctcctgcctcagcctcctgagtagctgggattacaggcatgcgccaccactcctggcttttttattttatttttttagcttttagtttttagtagagacgaggtttcaccatgttggctaggctggtctcgaactcctggcctcaagggatccgcctgcctcggcctcccaaaatgctgggattacaggattgagccactgcacccagcctagttatgcttctaatgttcaccgatattttgaggtgaaattataggcttcactagactgtcagaggagttcatggcacaaaaaacgctcagaaccttacatggaaattatcagtctagggatttggagcaaacgctgtggagaaaagacttcataaagcttgctggttgtccttctattttttatcattccacaaagcatagggctttgtaccaccctgatttacttctgtggatatcagaactagagctctgagtcactgcacctcttaggacaggcattatttagctcaaggaaatggaaggaaagaagcaagaacataattcgatttgttctttactattttatccttccacactcctgactatctcctgctcaaggtgcaaacctgaacaaaacagttcaacttttgcctgttatcatctttattgtaactaatatgtatgtttcactaatttctgttcaaatagaagcttctttctaataaattaatattatatttaaaaatctgaacatcttaagtttcaagtttagttcattctttttaaccttttcttattttctgatatatgcatttaagcttatgactactcctctaagtaaaacagttcaacttttgcctgttatcatctttattgtaactaatatgtatgtttcattaatttctgttcaaatagaagaagcttctttctaataaattaatattatatttaaaaatcttagcatcttaagtttcaagtttagttcattctttttaaacttttcttattttctgatatatgcatttaagcttatgactactcctctaagtactgctgtagatatatcccacaaaacatatatggtgttctcaccacgtcaaacatgtatatttattatttcttctttaagccatctatttttaaaggggtatttataaattttctaagccttggtttgggaattaggagtttttttttattatttctacttttgttgcagtgtggtttgtatgctgttaaatccttagtatttattaagactttcttggtgatcaattcttgtagatgttccatgtgtttgaaataatattgattcactgactgttctggctagggtttcgtaattatctattaagtaatattatctttttttctaaatcttccatgtcttagtattgctttcatttgtttaatacattagatattaacctatctatgttaaaattgtcaaattccatattggcttttgtcaaattctctttataattcaagttatttatgtattttgcaacaatattgttaaggaaatacaggtgaagtattattgttttcctagtgaattgttctgtgtattacacattttatctctaatatttctttttgccataaagtgtattttatgtgaaatcaatgcaactatgccagttggcctttctgagtatttgcctaatttctctttcttcattcctttcttgaaataccttctccgttgttatgttttaatagttttttaaacagtaagcagctgttattttcaatgcattttaagtttctgtctctgaactaagtttatttaatatctatttattttggttactgatccatttgaatttattctttttcatcttatgtgctttataattactagtttttgttgtattttatcgcttttttatttttgctttttcattcttcttttctaccttctgtttgatattttcttcattctactttttatgttgtacattttatttctactttttagtgttaacattagattttttaacactcttacttgccaaaataatgcttaacattaaaccataattatatcttcttttctaaagtataagaatcttagaatattattttactttgatcactacccacctcatcattttatatattcatactactttgatttgttttagttccaatttgtgtttaaatcaacctaaactaaaacatactctttgttcatattcttggccattatttttttctctatgtggacatatttttctatgtatttgccagccattattttttattttcccccactttcctcctggattgaattctcttttcttgatgtgcgttctttgtcatttctttcaatggcattctgtaagtggtacacttttgcctatgtctatctgaaaatatctttatttcagtcttagttttaaattatggtttagttgagtataaacttttagggtaaccactagttttcctgggacagcttgaatatatattccattgtagtctggtctctatcattgctgttgagaaatctggtattgtgttcttggtattcaaaagtaatctttttatccctggtgtcttttttcctttttcttgatgtgctgcactattattttggtaggtctaaggtttgatcttatttattctacttaggatttgttctgaatctgatcattaatatattgtatctatcatgaaaaagtctcagtcattgcttctttcaaaattttttccttcacagtttctccatttttctcctctgaaacttttattaggtgatccttcagctttctttttttttttaatttctatctctttatttctctacattatattctgggtaaatccttttagttaaactttcatttcactaatatctcctcaactacacctaatctgatctttagattttcttctcaaccccctgttcactcctttctcagcctttttctttttctgcttactttttttttctttttttattattattatactttaagttccagggtacatgtgcacaatgtgcaggtttgttacatatgtatacatgtgccatgttggtgtgttgcaccaattaactcatcatttacattaggtatatctcctaatgctatccctcccccttacccccaccccacaacaggccccagtgtgtgatgtcccccttcctgtgtccaagtgttctcattgttcaattcccaactatgagtgagaacatgtggtgtttgggtttttgtccttgtgatagtttgctgagaatgatggtttccagcttcatctatgtccctacaaaggccatgaactcatcattttttatggttgcatagtattccatggtgtatatgtgccacattttcttaatccagtctatcattgttgaacatttgggttggttccaagtctttgctattgtgaatagtgttgcaataaacatacgtgtgcatgtgtctttatagcagcatgatttataatcctttgggtatatacccagtaatgggatggctgggtcaaatggtatttctagttctagatccctgaggaatcgccacactgacttccacaatgcttgaaccagtttacagtcccaccaacagtgtaaaagtgttcctatgtctccacatcctctccagcacctgttgtttcctgactttttaatgattgccattctaactggtgtgagatggtatctcattgtggttttgttttccatttctctgatggccagtgatgatgagcattttttcatgtgtcttttggctgcataaatgtcttcttttgagaagtgtctgttcatatcctttgtccactttttgatggggttgtttgtttttttcttgtaaatttgtttgtgttgtttgtagattgtggatattagcccgttgtcagatgagtaggttgcaaacattttctcccattctgtaggttgcctgttcactctgatggtagtttcttttgctgtgcagaagctctttagtttaatttgatcccacttgtcaattttgtcttttgttgccattgcttttggtgttttagacatgaagtccttgcccatgcctatgtcctaaatggtatttttttattgcctaggttttcttctagggtttttatggttttaggtctaacatttaagcctttaatccatcttgaatttatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcatgatgcctccagctttgttcttttggcttaagattgacttggcaatgtgggctcttttgtggttccatatgaactttaaagtagctttttccagttctgtgaagaaagtcattagtagcttgatggagatggcattgaatctataaattaccttgggcagtatggcgattttcacgatattgattcttcctatccatgagcatgggatgttcttccatttgtttgtatcctcttttatttcattgagcagtggtttgtagttctccttgaagaggtccttcacatcccttgtaagttggattcctaggtattttattctctttgaagcaattgtgaatgggagttcattcatgatttggctctctgtttgtctgttattggtgtataagaatgcttgtgatttttgcacattgattttgtatcctgagactttgctgaagttgcttatcagcttaaggagattttgggctgtgacgatggggttttctagatatacaatcatgtcatctgcaaacagggacaatttgacttcctcttttcctaactgaataccctttatttctttctcctgcctgattgccgtggccagaacttccaacactatgttgaataggagtggtgagagagggcatccctgtcttgtgccagttttcaaagggaatacttccagtttttgtccattcagtatgatattggctgtgggtttgtcatagatagctcttattattttgagatacgtcccatcaatacctaacttattgacagtttttagcatgaagagctgttgaattttgtcaaaggccttttctgcatctattgagataatcatgtggtttttgtcattggttctgtttatacgctggattatgtttattgattttcatatgttgaaccagccttgcatctgagggatgaagcccacttgatcatggtggataagctttttgatgtgctgctggattcggtttgccagtatgttactgaggatttttgcatcaatggtcatcaaggatattggtctgaaattcactttttttgttgtgtatctgccaggctttggtgttaagatgatgctggcctcatataagcttacttcttaattaatatttttctgggtttcatgtctgctaatactgtctgaagcagtcatgtttgtgctaggcttcaattatccgccatacatttatgacttccatatctatatctctaggatggttcttattttccttgatacgtcaaaatctcctaaactgagcattatttcctttactaaatctgctcctaatttagctccctatagaatcacatgctgaagccagttttaggagtcatcctaagttgccattaacccctgaactatgccattaatatcctatgctataacaccactcaccaaattccatttattctactacttaatgtgacccacctgtgatccttagcacccttattattctcacttgagtgctgtaattcctcctcactgacaaggaagcaagatagtgggtaaaggatgggatatgagagcaagatagacagaatttgaatttacacctctgggtttactctatgtataatttctccaagcctcagttctttacataaaatggtgaaataataatacttacatcataaagttgatgtaaagaatttaaggaaaaatgcacgaaaagtgtttagtgcagtatctgacttctagtaggtgtcaatgagtgttaacgtgtgttattactaggaatatgtctccctgcatctgcattcgataatacctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaataaaaacagaactttaagccccagagactttatctacttcccacttagaaattctttatcataatacagtagttctgtttactacataccattgatgttactattgttgttagcgatatggagtaacagactttgtccagttttgagagatgggaggaaaatgtgaagtggcagataattatgtataattatatatattagaattatatataaaataataattatagaattctctacgtatagaatttctatacataaaattctataaattctatttttatgttcagtgtatgtaaaaacatctcatagtgtaaagaatagatatagatagaagatttttatcaaaaggaaattgatttttctctttcttattaaataaatgctgaacaattatttaaagaatattggttggaaagactccaagttgttagcctgcccagggcacccacataccttggtacagtcatggtcttataataataaggcagtgtctgagtactcacagttttaaagtacatgacagatccttacatggtatctgctcactcatgcttgatttaataatgcttgtcatgacctagactttgaggttgctaaacacttatgactctgtatgttaagtcacactgtaatatttttttccacaaatatttttacaagagtagacctttcaagtggtgagtagttcattttgacaacaatcaactctattatcaagagtggatattctatttttcaatgttcagaagtgattattaattttttggccataaacgttaaattctagttcttggcaattttcctagagacttagtaagagaagatcttactttcccaatttccaaagtatataaataaatcttcaggtctaaaggagtaatttcaatgaaatgtgatacctttatttgtgtgtgaactcttagatgacacaaattaagttgatttgaggtttgtgctgtgtcaagctatgtatataataaatgcttccagagaatatgagctactgttctgatgttgccagaatttcatttttcacaaaagggatacatagttttctagctaatgttttcttcatgagcacacgtttcaagttcacttatgtgtgtgcacgtatgtgtgtatgtttcaccaaacatgtaagcttgttctttatactgacaagtatatgtaggaatacttgttatatgaaattaggtactacaagacatgtattaataatttggttcagcatataaatattaagtgtagagcaactgggaaagagaaatagcagacggcacaaatcactgaattttaatcgacgtcccctcccctggcagtacttttaagttcctatatgacattcacaaagggatttgatgttaaaatattcagaggaaacaatgatcaggccagctgcagaaggtaaaatgcacttcctagtcttgaaagacttatatttgaattgctgttcactgtagttacataaactaaagttgaattatatatgaatcacattgtgtttatgaattatatatgtaattttatagaccttttgcaacttatacagccttattcatagtatcttcttttttcccccacaattaacatgccatatagatgtatgtatatggcatgttgtgtgtgtgtgtgtgtgcgtgtgagtgtatttaaccctattttataaactaacacttaaggatattgaatgactaacctgaccttacaagtattaagttccatatccaattactggaagactaagaatcttagttaacatctactaagtaaatatataagaattctgcaatatggaaatgaaacaaaccttctagcaaatatatgctgagtacctactgtgtgcaaagcagtgtgggaacctcattttctcagggctcagcagcatgttctaaatcccttgggtgttttatagttgcattttccgtcattataaaggcatgaccctcttctgggcttcaagccaaacactgaacagcatgagataatgtgcaaacgcttattcttgacatctgataatttataaaaacgaagttgtacatgagaaagattcctataaatatattttatataaaatcatttgtagaagattttactttttaaattaaattatttgtttttcacttaaaagattgttgataaatttggcctactaagctgttacagaccagacatccctagtgtctgcaattctccctgggaatgcttgtcactttgtaggaatcatattatctttttgaggccacctgaagatagtttattaatttgttggtttaccagtctcttaattatcctgaaagacttaactccatttccaaaggtgctacagggtgtagcactgtaaatctgatacttgatggtaatttttacattatataaatttctttcatgggaaattccatatgcataactagaagggaatcctgactgggatttttttttcttttcttattatcttcaatttaaagcactttgcttcttttgctcgctgaagagaagaaataacacatatgagttattggtagcaagataggaaaatagcaacatcagaaatctgataattaggaggtttataatggcacatatgtgtcataaactgccaattaatcttgatgagaaatgtaatcaactttagttatgaataatgcctcccttcagaagatttagaaaaatgtcaatggtccatacaatttttatctttgtttctgtttcattggaccactataggcacaccccttcagaatgtttatctgcaggctataggtaatgctggttctagttattgagtgtaatccacacacttgcttatttatacactatatacagcatatgtgtacagcatttggtgaattaatgaggaaatgtatgtaatggaatacattctgagattctaaactgatagctcatatgtgtgctttagcgttttcagaaatagtgtttttaatccccgtatattgaatttacttcagatttacattttcaacgtcagtaattcaaaatctaacctaaaaagaggaaaaatagagtttgcaaagcacatatctttctgttaaaatattttgatattatggagacccttgaaatctcttaacctcccatctgctatccacacttgtctactgcattcacagcccaaggttaagaaagacctgtttatacccaagatttccatgtcctcttttctctttcacccttcaacccactccagtctggtttcacacgaactctccaccaaaatagactttttcatcacttgatgtcaccattcatcatctttcagtcctcttcattggtgatctctcagcaacatttgacctccattgaccacgttctctttcccttatcttttcttcctaccattcccattacttctttcagaattccctgcaggcttgtcctcttaagtctatttcgtgttggacttcctcaagacgaaaaactcctaaataaatatttacaattaaggcctcaaatctaaagagcagatccagagatttcagagcctgtttgatatcttcagttgactctctcatggacacctcaagtttaacaagtctataattgaacaaaatatgcccttcccccaccccttgcccccgccacacacacatggactccttcacatccagacttcctcttccattctgtgtctctgtaaatgacatcactcttcaaccattgcttgagtcaggaaacagagacttactctggatgcccaactttttcatcttctttattaagacatcacttttaatttatgaacacctccttgaattatcctagttccagtttccactgctgtaacctgaattcaagtcactttaacccctacctggcttacagcattggcagattgtaatggagctccatgcatggaatccagcagccatattgcaaccaaagcaaacttttgagaacatagatctacatcatgccagtgccttacttaaaattctgcattggcttcctataattctttaattagtgaccatgtgtttaatatagcccataatgccctttagaatttaatatctgcctcctctccagagaattctgatattctgcaccactcttctcctaagggtctttcagtatatcaagctccttggtatactgttccttggtatacttggaatattacctccaccttgaaagttctctgcatccgttgtaccttacctcatctcccattacctaaactattcttcaaagcttggtgaaaatgtcacttcctcagaagcccttcctgaccattcaggatcttcttgttatcctaactgtcattggcagtcgattcctctctgtcactgaatttagcacaattattaaataatgacttaaataactacttgtttgaagtctttctcatctgctataatagaggctttatgggataaagaactatatgtatattgttcattgctgtacaacacccaaaataataatttgcctgttacagaatttgtatgtatatatgtttaatgaatgaacaaatgaacaagtaataatttcaagagctaataccacgtatttctaaaaccactagcatatagttggcaccaggtaaatatttataaataaatcaacaaatataatgaaaatatacatttttgcttagtgttcctgataaaccttgaaccttgaccatattattaaccatactttttacaaaatggtgtctgctgttttttcctttggcaaaaggaattttctatcctcttgaaaacatacttacgagagaaaagaatttggagtgcttctagttcgacatactaaaggtgagggttgccattttatatctaggaaatgtcttcctgttagagtctatatatttcagattttaacgaaatgaggttgaataaaactttctgcaactcttagatttaactgattttaccattatattattttagttttttttaactgtcaagatttcttgggcaaattcatagtcctttgctgaattgtaacatttcccttaattatgaatttagacaacacaccacactagtaactagctataattgtgacttcaacagttacagaaaacacaaatatttcatatcattttacagttgttacaggcattttaaaatattatttttactcatccctaccttgaaattatggtagctattaaacctgctactatgttttgttacagaatgtgctaagagacatataaatacccatattacatttatttaaaatattgttaacagtattactggttccatcagaattctatatttgtttacttttaatgaattttaaaacattctgggacaatgacttggttcaccagattgccaagagatccctatcacaaaatgatcaagaactacagcattatgctatattttcagttgtgtcagtcattgtgtttagtgttcagaaaaactttttaaggaggagactctagtttttaaaagaaaggtcaaaatgaaaaagaatgtcacaagttgtacatttaaactcagttgtaacacttggtttttcaaatggttgtgcaagtgtcttgccttacttaatgtgcagtattctttttcgtccttactcttctttgcacccaaacccttctcacttcaggctgaaacagattttaatgtagagttgggtcactgaacacttgctacttcacacttctctgcaggaaaataattcttttggattaaattttttcacttctgctgtagggaataagtacatgtttgctgctgatgagaaagaattaacctcaggtttattctgttctggaccacacaaatctatgcttttgaatggaaggaggaaccaagaaccgcccttaacattttgtcacactgagagtggaggaattggtcgaggaatcttttcatggtttgtaaaggacaatcaaatccatccaattaaaataaaaaaaaatgatagcacaattagctctctcttcttaactggattgttttgttttggaatggaaattttcatttctcatggtcattactaatgcccaataggagaaaatatatttgaattctatgattgctattgaaataattatgatttcacttagtatgtccaccatggtacatggtcttcagcaaattagcaagtaatcatttgtctttgtgattgttttcaggtaatagttatttatgtaaatgtagaattttttatatgttgtattgatgaaattatttcaaaatgcagtacatctttccttactttcccaaatagtgtgtgtgtgtgtgtacatatatattcctgcctacattctaaaaatgatttaatcgtgactataagtattacattatgctaaatatggcccacttttcctgacagttgttagaatacaaaaaaatgcaaacaggcattggtattagggaagacattggctttgaagcaacatatctgggtttaacttctggctcctttgttaaacatgcagttttgtgaccctagacaatttatttagttacagcgcagtttactcaactgtaaaaagagggtgttaacactacctcatactacctcattaattgagaggtacatatcaggtacctaataaatgttagtgatagaattagtgtgttgtaaatgctgtcttcaggacaactgaatacttggtgttttttcctataaagaagatccactttagggttcttttgtctacttttagaggctaacatatcactgctaagagtatttgtaacctgtaactcctttcttatttttgctttggctttttcttcttctctttgtaattttggttcataatgttagtgttatgattagcaattcttttgttttacagccagggttacaaaggtattactacatgtctcttctatttgatcaatgaggtaataaattaggttatgatgcatgtaattattttttctgacagatccttttgtgtcttaggtgattttatgtcatctagggacttttcttttccacttggtcttgattgagataccatgaaactaccatggaaaataaaatgtaagccagggaggctttcctgtgtaatcttcgctatccctgaggctccccgtattatacatctgcaggaacattattacatcttagaagtgccaggagaaaatgggttggggtagaggtacgtgactcttcccgtggaagtggtttttcctctatggttgttcttctctggagccctctactcctgccttccctctgctcctttttggtctgctggtcctgtgggtcatttgccagtttcctctgagttagcaaccttgagtttttgtcctgctcattaaaaaagaagtccacagctcttcagtttgctccccaaggaatacagttctccagtcttatcgaactctcctctccagggctaacagccctagggcgaatatgagggaggcagactgtttcctagtagggtcgagcccagcccgaactcttttcttggtccacctgttcattctaaccccctgactccactgctccagctcaaccagcccatttgtatcaggtgtcttctcatttataatgcaacaattttccatgatagtcctgatgttcttttgatattttcatgtcaagttccatcatcccaagtccatcagaaagatggcacctctagaatacatacaaatttctttcataccgggtccatatttaagaatatgttgaaacctgaagttcattaaatagtatcttattgttataaagtctccttttccaccacccacccactgccacaaataaggcactaagtaaaattctaacataacctattcagctctaagtcaaaacttgatgctacaaagtaagtatatgtataacacatcttgatgtttttaacatttagatatttttaaggatttttaaactattttcatcccatttgacgcttttttccatatatagttcccattactctttctagatttgtttttattttttcaaatttttgatatcaaaaatgtatttagttcgtgacctgcctgggtaacatggtgaaaccccatttctgcataaaatacaaaaattagctgagcatggtggtgtgtgcctatagtctctactactgaggaggctgagttgggagggtcacctgagcttgggaagttgaagctccaatgagccatactgtgaaactaaacgctgcactctagccagggtgatgggagcgagaccctgtctcagaaaataaatgaataaattataaatagtatttctatattcatggattttaaatgatttttttcactagcaaacaataagtcaggatatataactaaatagcatagttagataagaatagtgccaacatgcttagattaatttgggaacatcaaaaattataccccatgtgaaatgataaggtccatacactacgtttgaattttaaaagtattattgtatattttttctatagaattatgaattgattgttttgatatcttttgcaccaacaagttaatttcaggagagtaggtttgcttgtaaactatgagaaatatccaatttcaatggatgtgaaggagataagcacatggagtatgcttcagtgcacagaacagcagttttagtcacaggaatagatttgataggaatcacatttggctgtaacaagaatctacatatggaacaatgtacaggataaattctccacttgcaggatcaaaatgtaaggtggatttaaatatcttccaaattttggaactccacataacacaatttttctttctgtttgtgaatagagaagaagcctgctggagaacaagtagagaaactgagactccaactctttctttaaatttggttcccttattcaatgtgatgattgatatcactcacctgccatttaacttaatactgcactcttggcaagggttagtctccattaggctcagcaggtgatatcatcactgtctgtatgattaaatgacacttagtaatatggatttcccaaattgtgtagtatcttcctagtatgtcatcactatccccattttatagccagaacacaggtgaatttggctctgcagtgaaaggttcaggtagataaatacgagaatgggaggttttcatttgctattggcattgtttaacatgcctaaaaaattgttttattgcccagatgttggaaatgtattaattatcgtattggctcttgggcctagttcttgcaagaatgatagtagatgccagaagctaaataaaccttttgtcatactgctgaataaaggattgtttgtgctctccagttgataaattatctttgtgccttgtcgttataaaaagaaactcatcttgttcactagtctgacaggagatgagaaggccctagagagagcacagagagtttttcctttcacaaatcacatgtaggatgtatgctgtgggtcctgtctggaaatgaatgtggaaagaatccaggatgaagcatacaattttcattgttactacttggtatatgatagattattacaaattcgcgagattaaggttttccttttactcatactgacttatcttaaatctaggaaccaattctagcacggacaaatgttcttttgtgcatagttgagaaagaaaaggatagtttaaatttcagtgcagctaagataatatcagtaattttatggttattctatgagtttatgacagggatttatggaagcatttgatatgaaggcgtctcatttagtattgaagagaaaaagcccagctattcctttagaccagtgtttctgctaaacaaaatgcactgaaacttgcaaacgacaagttgtttttgtttttgttagtaataaactttattttatatagcctgttttaggttcacagcaaaactgaggagaaagtaaaaaaggttcccatatgtccccagtccccacacactcaccacctcccccattattgacagacaccctgaactcagttggtacctgcattgatacatcattatcacccaaagtccattgttaacattagggtacattctaagtgttaacacgttctgtcgatttagacaaaggtataatgatttttatcctgttgggtgttccctgagcttccttgatctgaagtttggacattaatgtggggaaattatcagtcattattgcttcaaatattgcttctgtttctttcttttccttctggtgttcccatcacatgcttgttagaccttttttggttattctacaattcttgaatattctgctttgttgtgggttttttcagtctttttttctctttgcttttcaggtttggaagtttttattgtcatatcctcaagctcagagatttttttcctcagctgtgtccactctactatgagtttactgaaggcactttttatcttaattctttcttagaattttcatctctctgcttacattatccatctgtatttttcaagttgcctacttttttcattaaagttctttgcatattaatcatagcttaaaaaattccttaccttataattatattgcagggtattttcttgaccccttcctaagattcatgacaggggtgcatcacttaccaagcccacccactcaacccctcatgggtggaagcatgcaaacaaacaagggcaggaaccagcctctttggtgctggaagaagtgaactccaggcaggcccatgggagtgtccaggtcagggtgcctgtgacctcaagaccccagaggctgagctctcttagctctgccatctgtagacagcagtgtgttatcagctcagtgggccctttgtcttgtagcatggggcagctgccttccgccagcaagggcaaagtgtcagtgtgacagcctttttgggtattcacacccagtgcatcttgaattctagtctggtgcccaagaggattgaggtcacatggacgaattgaaagatggtgaatgtggagaattttgttgagtgatgaaagtggctctcagtagagaggggagctggaaaggggacaggaagggaagttactctcccctgaagtcaagccacctctctccgatgtccagccactgtctctgaagtcaagctgcctctctctgacatccaggtgcttcttcccgatgtccagctgcttctaacctctgccggctgagtctggggtcttataggcacaggatggggacaaggtgggccataggtagttttcaaaaaggaaacattcgattgataaaaagacattattcagaaagaaccaatcgggagagagtggacacacagggatggaagttctcactttgggctgcgagtttcaggctttttggttcaaaggtggggatttgccagggaccaacccctgtctgcctagagtttctctgcacctgtcactgtcagttacaacatttctatcatatctgactctgttctgacatttgttctgtttcatttttgcctttagtatgtcttgtaatttttatgttgaaagatgagcttgatgtatgggtaaaagaaatttcagtaaatatatcttcagtaatgcaaagtaagacgtgaaaagaggaaaatgtttcagtcttacaattagatctcagtcttttggtgaccccctatccctggactgtgaactttcaaacacttctcaggtcccccacctcccaaagtgggctaggaaaactagaggaagctggagttggatatttcccttcccctaactgcgttaggctctgataaacattggcacattaggttctggtaaaatagtttctcctgagggcagactttgttacagaatgttctgatgtatttgaaatggctacaattcccctccctctactgaaaatgagatttttttttcctttgataattgctgtgaggaggtggtagagctcctgtaggtaaaactcacaaaagaacgggtatgcccctatgactaatcctttctagacacttttggaacaagtctcactttcagacttgttcaaactgagccttcaccaatttgtcatttacagcttaggttttccttacccagcactgcttccagtggaggtttatactcatggatttctgctcaggtaagttgtgattttctatatttgcctttctcaccaatttttgaagcagtggtttgccctgtaacctcacttctctgattaatctaagaaatgttgttgatttttctgtttgttcagcttttcataagttgttaacacagaatggcaacttctaagctccacagataccaaagtagaaaccaaaagtcctggttttcttaatgaaatatgttctcattttttgatgaataaaatagatatgttctcactgtttggtgaaatcttccatcactttcattaatatatgtgttggctgggcatgtggctcacacctgtaatcccagcactttgggaggccgaggcgggcggatcacttgaggtcaggagttcacaaccagcctggccaacatggtgaaaccccgtctctactaaaaatacaaaaaaattagccgggtgtggtggtgggcgcctgtaatcccagctactcgggagcctgaggcagtagaatcgtttgaacccagtaggcagaggttgcagtgagcagtgtgttgtgttatacattgtgtaacaatgtaacgtgttacattaacattgctgtgtataatgataccatgatatcatgttaagttactcactgcccttctaaaacatactgactgcacacataaacaatgctcagtacataagtctgatgtattctgaatgaatcatatgagatttaatgagtatgtttttaaaagtcatacagggttgtattgaagaataattacctgaaatttatctattttttgagatttttaaaaatgtttgtttcaatagttttttagggtacaggtggtttttggttatgtggataaattcttttgtggtgatttttgaaattttagtgcacctgtcacccaagcagtttacactgtaccaaatatgtagtcttttatccctcaactccctcccatttttccctaccccaagtacccaaagtccattatatcattcttaggcctttgtgttctggtagtttagctgtcacttgtgagtgagaatttatttatttattttaaattttaattatggtaaaaccacttagcatcagatctaccctcttcacagatttttaagtgtacaatataacattgttatgtataggcacaatgtcacacagcacgtatcaagaatttattcatcttggaaagctgaaattttgtgcccattgatcagcaacttcttgtttccccataccacttagccctggtaaccacaattatattgtttgcccccttgaatctgataattttagtacctcatgtaaggggaatattgtggtatttgtccttctgtgattggcttatttcacttagtacaatgtccttactttaatccatgttgtcacatatggcagcatttccttcttttctagggctgaatagtattttattgtatgcatataccaaagtaaattttttatgcatttatatgttgatagacatctagattgttttacatttggctattgtgaatagtactgaaataaatatggaaaaaatgtctcttagaaaccctagtttcaattcttttggataaatacccagaatgggattgctgaattatatggtagttctgtttttattttttgaggaaccttcaaacagttttccacagtgactgtaccagtttacatccctcccaacagtgcgcaagggcaacaatttatccacaacctcaccaacacttaccttttctgtttttgataatagccatcctaacaggtgcgacatgatatctcattgtggttttgacttgtatttcctcaattattagtgatattgagcatcttttcccacccgttagtcatttgtgttttttggaaaaatgtctattcaaggttttagcccatttttaaattaagttattacttattttattattgagtcccttatatattttggagtttaaacgcttatcagatatatgatttgcaaaagtttcctctcattatgtaggttgctttttcactctattgatcatttcctttgatttgcagaagatttttagtttgctgtagtcccacttgtctatttttgctttggttgcccatgcttttggtgtcaacattcatcaaatcattgctaaaaccaacgtcatgaagttttacccagtgtttcttctaatagtttcatagtttcagatcttacatctaagtgtttaatatattttgagttgatttttgtgtgatagaagggtccaatttcattcttttcatgtgaatattcaatttttacaataccatttgtgaagaaattatcgtttatccattgtggtacttggtattcttttcttttagtttttaatattttatttttatactcgtagccctcatttcctgaagattagattggcattcttgctgaacatcagttgaccatatatgcatgggtttatttctggactcactattctgttccattcttatatattatctgtctgtatgccagtagcacactattttgagattcttcatttttatcataaaagggtcttgaattttatcaatttttttctacatttaatgagagaccatatgatttttatcctttgtgaactccattttacaaatttatttttttgactgctaccttcaatttagttttcttagattgtcattgaccttgtatatatagaatgtaccatcttgggtgcttctaaaaatatgctgatgaggaaatcatccctgatgatagtgacagattttttaatggagcacataatattaaaatagaaggaataatacaagggtaagagtttggatattctaacttactattatgtattgcattctctaattcctttttattgaatatactgaaatcaatatgtctaatccatacaactctcttgagttctagctccaccttttcatatactgtcttcatatctccatctagatagccagagatttatcaaattccaggtgataaaaacagaattcatgcttctcctacaatatactcctcttcctgaactttttgtatcagctaatggtatatcactcctcttgaactctcacccaaactgttgaaatcaccttccaacttttccttccacctccagtctcttctatctttgacatagatgccaataattatctttctatattgtaagcattgctatatctattgccccctctaaaacccttcagtggctcatcattgcctagaaaacaaagtccaggtttctcaacatcacattcaagaaatctgcctagctgatcaactttatgtatgttcttcatacagtattttcatggtattctctatcagacatattgcttcccatcattctgacaccaatagggcttaggaagtgaaagagtattagcagaagaccatgattttgagccaataaattactgagtataaaacctgacttcaataatttggtagtaatatgaataatacaaattgattagctttatctacttcatagaattatattaaggattcaaaagactgattctatttatatacatattatcttactatcatcactctgtacttaatgtattaccattctattcatatatctttaagtattagatctgccacttagtaggcaattaataatttgttaatgtaattatcctcatcagtcatttgttatgttctcataaaagcttcttctagtttctgttagtgaatttttgacacgcatcaagttgttcaaagagggatatatgcacattgttttataattccttgtgttcactatctatctcttccagtatgagtttctcatggcccttaaatgaagtaatgagaagggaattcagtgttagaatagaagatgcatggaggaattagttgcagaacaaagaagggcaaacacagaccactcattgtggaagtttattcatagctactattatttttcacttccctcactctcagaaaacttcttgcaaaatatctctcactctgtcttctgaatctcagtactctctcttactcctcaaccaaagacagtatgaattctgtacccactactcattgataaaattatttattcaaaacatacaatggactaatatatatatatttcactatatttcacaatataagtatatatagagtattgtgtcctctgtcacccagtcatgcttttccccatcctggggacaattcctgtgattagttttcttttcatccttccatatacagtctatgtattctcaacatctatgtttatatgtatgtgattctttaaaacattttatacagtcagcagcataatgcacttttctgcactttgctttcgcaaatttatctatctatctatctatctatctatctatctatctatctatctatctatcatatctatctgtcatctatctccatggtggtaatatagcatgccctattttctaaaccttcatgaagttccaatatatagatgtgttatattttatttaatctgctctacactagtggacaactagactgttcaaacctgtgacataaaagatatcactacaatgtatattctcatacaaccatccttttgtacacatgagaaaagcctttaaatgagaaattagatcaaagggtgtatctgtttttaattttgaaaggttttactaagttgtctcatcagaaactgtactactggtcacgttcctaccagctagatcttcaactgccttcaggcaatgatatcagtgcagtgtgttaccagacaaatttctttttgccaaactgattggttaaaaagtatcttattttcatttgcatttgcatttgtgctaatataagaaagatacatttttttcctaagattaaaagccatatgttgacttttttttttctttttggtaaacagttcacatgctttgctcattatttttctagtgagctagggattttttgatgagctgtttccaaattatacagagttatagatatttatatgtatatacatatatagttacatttactgtaactaattatatgtaggtatgtgtatacatagttatagttatatatacttatatattataaagtatatatgtatgcatgtattatatatatatgagtatgtgtatgtgtgtgtgtgtgtgcatgcatgtgtgtgtgtgtggtgtgtgtgagatatgagttgcagatatttccctcatttatctcttattttctgactttgttcatggagtttttcctcctgcttttgagaatcttttgtttcctgcttctaacaacctatgctcatatgtgtgagcaaagaaataacataaaactggaacttatatttaaagaggaagcagagtgtaaaactttgaaaaatgtgcagcccagctacgtggtagaaaagaaaaatccattttcaggggagaaattcaagctggctgcagaaattcgcataactaaaaggaaggcaaatgcttacacaatgggggaaaggcctcgatggcatttcagtgaccttcacagcagcccctctttacaggcccagagaggtctagaaggatataatgatcttgttggctgtgtccagggccctgctgtcctgcacagcctcagaacactgctcccttcatcccagaagcttgaactccagccatggctgaaaggggcccagctacagctcaggtcactgcttcagagggtgcaaactataagtctttgcagctttcacatggtgataagcctgcatgtgtgcagagtccaatagttgagtcttggaagcctcagcctagattactatactatgtatggaaaagctggaatgtccagtcagaaagctgctgcaggggtagggccctcatggagaacctctactagggcagcatggtggggaaatgtggggtgggagcctccacagagagtccccattgggacactgcctaagggagctgtgataagagggccactatcctccatactccagaatggtagatctaccggcagcttgcaccatgaacctagaaaagctgcaggccctgaacactagcccttgagagcagctgtggggactgaaccctggaaagccacagaggcagagctgtccaaggctttggaaacacaccccttgcacaagtgtgccctggatgtgggacatggagacaaagattattttggagctttctatttaatatttaatgactgtcctgctgggttttgaacttgtgtggggcctgtaggccttttctttttgccaatttctctcttttggaatggattatttactgaatgcctatatccccattgtatattggaggtaactattttttttttttttattttacacccttttaagtgactttccttatctcagatgagagtttggactttggacttttgagtaaatgttggaatgagtcaagacttttggggactgttgagaagggatgattgtattttgcagtgtgaggacatgatatttggaggggccaagggtgggatgatatgatttgtatctgtatccccaccaaatctcatgccaaattgtagtctgaagtgttggaggtgggacctggtagaatcatgggacggagttatcatgaatggtttagcgtcatcctcttggtgctgttctcgtgatactgagttcttgtgaggattggttgtttaaaagtgtgtagcaccttcctcctctctctcttctcctgctttggccatgtaaaatgtgcctgcttcccctttgccttctgccatgaatgtaagtttcctgaagcctccacagaagcaggagctgctatgcttcctatacagcctgcagatccatgagccaattaaacctctttacaaattacccattctcaggtatttctttatagcaatgcaagaatggattaatacagtcttgtaacatgctgctggattctatttgtacttagtccaatataacaggagtagatgcaaaattttgttgagatgagaatgaacaaatatagggacttgatattgataacctttgtcatttcactgaaataaaaggagtgataatccatttagtcacctagcatttgtaaagcccacactagaaaacaagtactgagttaatgctggggctgagaatatggaaagggcattatttctgtcttcaaaagcacacagctgagtgagtcagaaatatattcaacaaatcataatgtagtgtggtcaaagcttttgtagtaataggaccatgaaaaatcaggggccagcataacctagaatgtttgagggagttgcaggatgcataacaggtagtgacatataatctggcttggagactaaaaacttagtttttggagaaacaactgggtggagtttgttaaggaacaaacaaacagaagagatggttttaggtaacccagatagtaaaagaagagccaatttgaatttaaagcatatttttagagagctacttttataactagaattattgaatacaatagatgaaaagaaacttaggactaatctcatttttgtggccacctcggttggcagcatccttctttagcatgagaggtgaaatagtgagatggcaattgaagttagcaggcataataaggctggatagtgttcagtgtgtgtgcaagagtctaaggagtttgtaaggcattatgggcatttatcacagacaggagtaaaattgctatactatgtgaagagaggcattaagaataaacacattctgctggtataagatgcaagaaataattcagatagggagactgtatatctagtatttaataacctgctgctgaatgcatggcagacaacatacatataatatcctctaattcacagaaatcctgagacattggtatttcataagtgaagggttagatacactgtataatttgttcaagtcaaaagctggtgaatgacagagccaggattagaatgaagatatttgagactttggtgaagccacagatcacatggagaagtgtgtaagatctccatagaggtgctagccttctatccctacaaactttacttgttaaaaccatggttctccttgtagacaatatatgcctaaaagtattgaacacccaaatgaggcagtgattcaaaaagagagtagtaaagcctagaatcagcactgtacttatggcctggtgccttgtttttcactaatttttcagatcacaaattctgagccttttttctgatcctcctagttatatctgctcccatagaaagtttgaccttttatttattaacactgttacttccagaacctcccaggctgattaggagctctgagcctagtaataataataatgaaaatactcctgtagcatttattatttgcttgacattgttctaaacactttacatactcgtttaatcttcacagttaatactatgaggtatattctacagcattaagaacagtcacagagcttctaatgacagcaggatttgggttcagattttttaaaattttaaacatgttttatttggaagaacacaataaattctacttgtttttcaatacattctatgcattttcttaaattaaattacattttatattcaggggttacatgttcaggttataaccatagtagtgggtaattactagttacactagaagcccaatccccaccactatagcctaactgtcacagaaagaatgaacattgtgtccgacaggtaattttcaactctctgcacaccttccaagctccttatcttttgaagtccccagtgtctactgtttccacttctatgtccatatgtacccattgtttacctcccacttgtagatgagaacatgcgttatacattgattcttttgtctatgagttatttcacgtaggataatggcctctggccccgttcatgtcactgcaaatgacactgtttcattcttttttatggctacacagtattccatggtgtatccataccacattttgtttatccagtccaccactgatggacacttagatacttagattggatcactttactcttgcaaatagtgctgcaatgaacatatgcatacaggtgttgttgttgttgttttgagacagagtcttgctcagtcgcccaggctggagtgcaatggcatgatcttggctcactgcaagctctgcctcccaggttcacgccattctcctgcctcaggctcccaagtagctggaactacaggtgcccgccactacgcccagctaatttttttttgtatttttagtagagacggggtttcaccatgttagccaggatggtctcgatctcctgacctagtgatccacccaccttggcctcccaaagtgctgcgattacaggtgtgagccaccctgcctggccattgttgttattttttaaatacaattatttcttttcctttgggtagatacgcagtagtgggatttctgggttgaatggcagttctgattttagtcctttgagagctctccctacagtttttcatatgggtttaactatatttacattctcactaacagagtataagtgttctgttttctcctcatccatgccaacatctttgttgttttttgactttgtagtaatagccattcttattggtgtagggttatatcaccttgtggttttaatttgcatttctctaatgattagttatattgagcattttttatatgcatgttggacagttgtatgtcttcttttgaaaaatgtctcttcatgtcctttgcccacattctaaaaaatgaggttatttgtttttgttgttgttattgagatgtttgaattccttataaatgcataatataaaaatattttccctcactctgcacattgtctgttcactgtgtcgaatatttatttttctgtgcagaagctttttagtataattaaatatcatttgtctatttttgtttttgttgcatttgcctttgggatcttcatcatactctttttgcataggcccatatccagaagagttttccgagcttttcttctagaaattttatagtttcaggtattatgtttaaatattttatccatcttgagttaatttttgtatatgatgagagataaggatccaattttattcttttgcatatggctagccagttttccgatcaccatttgttgaataagatatccttttcccattgtttatttttgtcaactttgtcaaagattagtgggttatagatatgtggctttatttctgggttctctattctgttccgttggtctgtgtgtccatttttgtaccaataccacgctgttttagttactatagccttatactataatttgaagtcaggtaatgtgatgcctccagattttttcttattgtttagtattgctttagctatttaggctcttttttgattacatatgaaatttttgattgctttttataattctgtgaaaaatggcattgaccatttgataggaattgcatttaatctgtagattgctttggagagtatggtcattttaacactattgattcttcccatccatgagcatgagatgttttctcatataatttctttctttccttttttttttttttttgagacagagtcactctctgtcacccaggctggagtgcagtggcacgatctcggctcactgcaagctctgcctcccaagttcatgccattctcctgccttagcctcccgagtagctgggactacaggcacccgccaccacgctcagctaattttttttttttgtatgtttagtagacacggggtttcaccatgttagccaggatggtctcgatctcctgacctcgtgatctgcccgcctcagcctcccaaagtgctgggattacaggtgtgagccactgtgcccggcctcatataatttctttcattagccttttgtagttttccttatagagatgattcacctccttggttagctatattcctagatattttattttctttgtgcctgttgtaaatgggattgtgttcttgatttgactctcagcctggacattattgttgtgtagaaatgctactgattcttgtacatagattttgtatcctgaaactttaatgaagtcatttatcaagtctaggagttttgcggacgaatcttaagggttgtccgtgtatacaatcatgttatcagcaaacagagattacttggcttctcttttctaatcaggatgtcttttatttctttctcttgcctgtttgctctggctagcactccttgtactgtgttgaatagtagtggtgagagtgaatattcttgtcttatttcagttcttaggaagaatgctttgagtttttgcccattcattatgatgttggttgtgggtttttcatatatggttcttactgttttgaagtatgtttcttcagtgcctagtttgttgtgggtttttatcatgaagagatgctggattttattaaatgctttttctgcatctattgagatgattatatagttttggtttttaattgtgtttatgtgatggatcacatttattgatttgcatatgtgaaccatccttgcattcctgtaataaaaacccctgcccccaatcatgatgaattatctttttggtgtactgttggattcagtttgctagtattttgttgaggattttgcttgtcttttcatcagggatattgtcctacagttttttgttgctgttgtgttcttacctgatcagagggttgctggttttatagactagttataggaggaatacttcttcctcaggtttttagttagagaggaattattctttcttgagtttttgaaatagtttcagtaaaattggtaccagctccttttatgtctggtagagtttggctgtgaatctgtctggtcctgggtgggttttttgttgttgttgttgttgttgttgttgttgttggaagatgttttattactgatttgattttgtgacacattactgatctattcaggatttctatttttttcttctttaatcttgggaggttttatgtttccaggaatttatccatttcctctaggttttctagtttgtgcacatggagacattcatagtattccttgatgatctttgtatatctgtggtatgagttgtaatgtcacttttatcatttctgatatgtactcatttgaatcttctttttttcttggttaacatagaaatttatcctttctaagaacaaactttttgtttcattgatcttttatatcttttttaattttcagtctcatttaattgtgctctgatccttgttatttcttttcttctgctagctttgggtttgaattattcttgtttttctagttccttgagttgcaacattaggctgttaatttgagatctttctatctttctgatgtaggcatttaatgctataagcttttctcttatcactgcttttgctgtatcccagaggttttggtatgttgtgtctctattttcattcatttcaaaaatgttttttgatttctgtcttacttgtgttgtttacccaaaagtcattcaggagcaggttacttagttttcttgtacttgagtagttttcagagttcctttctggtattcatttctaattttattccaccatggtccaagaaaatagttgatatgatttttatttttttgaatttattgagattttctttatggccaaaaatatgctcaattttggaaaatgtaccatgcacaaatgagcaaaatgtatattctgttgttgttggggagaatgttctgtaaatatctattagatccgtagatatttagtatctatgggtctgtgtactgttgtcagtggggtgttgaagtccctacttctgtattattgaattgctttcagtctgttttcttaggtctagtagtatttggtttgtaaacctcggtactcctacgttgggaatatatatatttatagttaaatcttgttgcattgagtgctgtatcattatataatgcctttccttgtctttttttttaactgttgttggcttaacatctgttttgtttgatataagaatggctactgctcttcattttttaatttttaaatttccatttgtgtgatatatctttttctatccctttgtattttttaaaatgtttaaattgttgtgggtacatattaggtgtacatatttatgggtttcatgagatattttgatataggcatccaatgcataataatcacatcagagtaaatggggtatctattgcttcaagcatttatcctttgtgttacaaacaatccaattatactcttttagtgatttttaaatgtacaattaaagtatttttgactgttgtcacccgctatgttagaaaatattaggtcttattcacactttctaacaattttttgtacctattaaatatgcccgctttccccactaccctttccagcctctgctaaccatccttctactctgtcttcatgagttcaattattttaatttttagctctcacaaataagtgagaacatgcaaagtttgtttttctgtacctggcttatttcacttaacataatgacttccacttccatctatactgttgcaaatgtcaggatctcattcgtttttatggctgaattgtattccattgtgtatatgtaccacactttctttatccattcatctcctaatggacacttaggttgcttctaaatcttggctattgtgaatagtgctgcaataaacatgggaatgcagatatctgttggatatgctgattgtttttccttagagtatatacctagttctatttttagtttcttgaggaacctctacacctttctccacagtggagaaccttgacagcaacagtgtatgagggttcccttttctccatatccatgccagcatttgtaattgcctgatttttggataaaagccactctaactgaggtgaaaaagtatctcatcatagttttgatttgcatttctctgatgatcagtgatattgagtacctttaaatataattgtttgccatttgtatgtcttcatttgagaaatacctattcagaatttttgtccatttttctttttttctttttttttgagacggagtctcgctctttcacccaggctggagtgcagtggcactatctcagctcactgcaagctccacctcccgggttcacaccattctcctgcctcagcctcccaagtagctgggactacaggcgcccgccaccacgcccggctaattttttgtatttttagtagaggcaaagtttcaccatgttagccaggatagtctcgatctcctgacctcgtgatctgcccgcctcggcctcccaaagtgctgggattacaggcgtgagccactgtgcctgtccccatttttaaattatattattagatttcttttcctatagagttgtttgagctccttatatattctggttattaaccctctgttacatgggtagtttcctttattttgaatctgtaggtgtctttaggcattaggtgaatctcttgaaggcagcagatggttgggtcttgtttttgttggtgttgatgttgctttagtttttttaaatccaatttaccactccatcttttaagtagagcatttaggtcatttgtgttcaaggttaatattgatatgcaaggttttattcctataatagtgttgttagctagttgctttgaagtctcaattgtgtaattgctttatagggtcttctatgagctttgtacttaacatgtccttttatgacgatgagtattgtcctttcatttccatgtttagaacacctttgagcatatcttgtaggttcagtgtagtggtgatgaattctcttagtgtttgcttgtctggaaatgactttatttccctttcatttatgaagcttagtctggcagggtataaaactcttgactgacaaaattttttctttaaggaggctaaaaataggtctcaatgtcttctggctgagatgtttgcagtctgatgagattccttttataggggatttgatgtttctctctagctgcttttagaatttgttattttacattgaccttgcatagctttataactatatgccttgatgatattcatctagtatagtaacatccagttgttttctcagtttattgtatctgaatttctgcatctctagcaagatcaaggaaattttcctgcattattccttcaaatatgttttccacatttcttagtttttcttcttctctctcaggagtaactataattcataggtttggtcacttcacataattccatatttctccaaggctttgtttattttttaaaacatattttctctttacttttgtctaactgggttaatttgaaagaccaatcttcgagctctgaaatgatttcttctgcttggtctagtctactcttaaagctttcaactgtattttgaactcatttaagtggatttttcatttccaaacgttctgtttgtttttgtttttaagacatctatctcttccttcatttcctgggttgcttttagggtttctgtgtgttggttttcaaccttttctttgatctcattgaattttcttacaatctatactttgaatttttatgtaatttccgaattttcattttggttagggtccattgctagagagctagtgtgatcctttgatggtttcacagcattcagattttacatggtaccagaattcttatgctggatccttatcatctagggaagctgacacttcttgcttttgaagttacttttgtttggatggaactttaaaaatctatctttattttatttatttcccaccccaccttgaggatgtgactgtacagtatgttaggtaggggccttttggctttgcttctatggtcctgtgcacttctgttggcaggttttatattgcattgtgtggtttgacctaccggccagtaggtggcacttccgggtaagagccagcagcgcaaaagcaggtgagtacgtacttgacacttgtttactgtgaggtgctctctgttgtttcatgtgatgggctgggcagccctgttcggggtgaaggggggacaaagatgggcagatctgggccacctggcttgcccatgaatactccaatgaagagcacaagcaccagacttaagggggtgacagtgggggctcctggttaaatgcactgagatctttgctggggttgaagaggctgcaccagctgcatgccctagatcggcaagaacttgatctgtttatcacacccctgtcctgggggcttgtgactcttagttcagatccacaccatttgtccatctatctctaggccacagtgcagctgaatgccgtgggaaatgcctgaccctcagctctcagtaggaacggttttggggtggaacctctttgttccacccaataaagacggctttgtggctaacctgttcgtcaatgcagtaatgttgctactttgtgtagagaaggggaggatacctttcaggatgtgcgtgaggctgggtattagctgtggtggagttggctggttgggttgaccggcctctagccctgggtggagtggtcaggtgtcagtggtgtagaaatggactaggtaattccccaactcccatgttcctaacttatggaacactttcttttccttttttttttagatagagtcttactctgtcacccaggctggagtgcagtggcgcgatctcagcttactgcaacccccgcctcctgggttcaagcaattatcctgcctcagtctcctgagtagctggtacagttacacaccaacatgcctggctaatttttgtatttttagtagagacaaggtttcaccatgttggccaggctagttttgaactcctgacctcaagtgatcctgctgtctcggcctcccaaagtgctgggattacaggcgtgagccaccatgcccgaccttatggggcactttctgtgtgcctagttgcaccagccttgttttcattcccactgtgactctgaggtaggtattatgatccccatttggtcaatgagaggaaggaataaaggacactgatgagttctatgtgttgtcgtcctggaagagagagggtgtggatgaatgaaacagaagttaaactcacctaggggagagatattttctgttggaaagtagtagatatcaccctcaaacataaaagctattcgtgagggtaattttctgaggtgagtttagttaaattacttacagatatttaaccatatgagtgaattaaaaattttcatcatatttacttaatttagtactttttattgaaagctgttggcgttggtcttctatcagcagagaaaacattattgagttgttatttaaagtgttaatctgatggttctttaatttttcacctttctactaaaaaatctgatttgatgctgagcaaatgcctgctcttttgttttaattctgaaaacagagtttaaataattactttctaggctctttatagttcatcatttttcttttgtcatttagtttataattatatttaaatgctctttgctttagttaaaattatttttactgttcgatgctcattttttaaaatgagtttttaaaagtattttgggttttcttgggctttgctttaattgacataattttccagttctaccattttctgaagcttttaaaatcgttctttcttctaaaattctcactttcatttttgctagtgtttgacctactctgctcttcatttttagaatatacaattactttattagaaaaaatttatggctgtgtattgtgacacttacttttctttaaactaacatgcactccataaattttatgtttaagcatacaaatctaggtaactgttttattttgcctttttattgctattatttcctcaaatactttgatgccaagaaaattggtgaaaatatatagaggaatagcacttggagaccttgatttttcaagaactttaaagtttggtataaatgtagaaaaatagtgtataagcaaaataacatggtgctgtgatggacattgcaattttttaaaattttatattattgcttattctctaggatgtttaaaagtacaagaaacctttatgatattcaatttttagaaaaaaatctttacttctatttagatttttattccttttgaaagctatttctagcacatatgatgaacttgatttttattcacttttatttttcttaaaaattgtatttgtttttacctgtgtgaaatacacacacacacacacacacacacacttctatggaaatcatgttattagtcagtcaagttctcatattctttattccagctaaactttcaactacctataaatctcatgctttatattcaaagttaagttaaccaattatttaaacatgtaattctcaacagatcaaagatttcacctttgattggcagccagtctaaagctctaccttacatttgattcttttaagcctccagggaggatatttgatccttttctaagtcctctgctcttttttgccctcatgccactcatctccttgtaaaatcctgcatttcattattagctttacacagacccacaaatggctgttttctcttattaagtttccccgggctcttcagccaaagtggagttctattttatagaagtgcatttcaactcctactattactattgcctttcactcattgcttcaatttcctcttcactagatttcctttgaatttcctttaatttggcctcttaactcatgaattcgccaaagctatacttccaaatgtcactaataatcatttcttgttaaaatcccagagcttttactctgttcttgtctttctttcactcttgattgctttagatatgtttaaaagtctctcttcatttgctatatacatctttcagttccaggaccctagagaatggtagatatttgatgccatctctttgagatacatctgttaaagaaaaccatatatattatttggtctcttagggcaaattgtggatatttcaaggtatagctatttccaggattggaaatgtaaaggataattgtaattaccttcatattcctaatgttctatgccttctttattttgcattttcgtatagcctattgaacatatccactaggataacccatagtcgtcttaaagcaaaccagaatttaccaactccttcctatttctaagccacttgtcttacttgtatatgtgtgtttcttgaagaaatcttcatgattaaggagatactataaattgtctgtttcatcataataagcaaagtccgatagagtagtcactagtaatgtgtggctgctgaacacttgaaatgtaactggttacatttgtttcttttttatttctaaggttggccacttaaaaatttaaaattacatatgtggctcacattttatttgtattggacattgttggtataggttatgccacagtcataatcacaaaaccttagtgactcacaagtacaaatacttattctccctgatactccatgtttattgcaggttggctgaaagttctgctcgatatctccttactcctgaaaccaagttgatggagcaaccatattctaaagactgccaacagtgggatagagggaaagagaactctagggatcttgcattaaaaatgaaatgctgtggcctccagctgattaattttgcatgcgtattcttgattcactgaccagaataagtcccatggtcctttcctgtagttacttagaaatgctattttggcaatcataccattatttattctagcataatggtaattattagatttaatctttagaacaaccttacattattttcagtttctgattagagcttagttattattggataactcacacaaaactgttatacttcaattaaatctgtattagaaaatttaaaaaagcaaacattggaaggtgtttacttatcccctttacttacagattgttttcttcataatttttctcaaagaatttttaattcttcagaattctacagagatgcatgcccagtttaacagagatttcatagcaattaacactgttataagctgtaatgactggaaaaacacagaaaataattgagttatttattaccccatgagtatgcaggcaactccccattctctgagatgtggcaggtcttaggatcacttggttcttctggaaaataaagcccgtaatcttatttatggaagttctcccatggctctctcagagaaaggttgtgaaatcctgtatgacagacccactctccatgaaaatgaatgaccaaacgacatgtttgacacaatcatcaaaaaatatccttaagatacaattacgtatagaagcaaggttgatcatgtagaaaggtcttggggccgggctcggtggcacgtgcctataatcccagcactttgggaggtcgaggcaggcagctctcgagctcagaagttcaagatcagcctggccaacatggcaaaacccagtctctactaaaaacacaaaaattaaccagacctcgtgatgcgcgcctatagtctcagctgcttgggaggatgaggtgagaagattgcttgagcctaggaggtggaggctgcagtgagccgtgatcgtgccactgcactccagcatgggtcacacaatgagactctgactcaaaaaaagaaaagaaaggctttggaacatgggctttttagccagaaaacatcttcatggcaccatttgctaagtgactttaattaaagtacttaagcttattcagtcttattcctgatcaggaaaatggggataatgcttaccttgtaggtttattatgtgtctaacagtcttctggcacatattaattccacagctattttaaaagaactataatgtaatttcatatcctaattggtggccacataaacaacatattacttttcagatagattcttttgcaaataagtgtcctcattaatttcttaatagtgttttcactttatcttgaaattataaatcatgttcaatttgcccttctactcggattcttgatgtacctttactatatattatcaaattcattaggttgcccttcattcaaatcactgggggcttttcttcaaactggccccagctgggtctctgtcttcaatcatttctttctgtctctcttccccccatggcactttgcttatgccggtttcatggcaattattacatatgcccttaaactatactcttgtatacaagaattattgctctctaaatcttatgctttctagggcaggagctataatagtaagaatcaactaaaatgaatggcaaacctattccctactaagttttctaatttctttatctcaatttaaatgtctaaaggacataaagaagtgggaaattaaggccaagacagtaattacccaaggccacaccaatacaaagtggcagagccaggattcaaatccaagttggcttctacctaaaacttaacttttaaatcagtttccacatttcctttcctcacacctgcccaactctggtggagctccccaccccctgcaacattcaacataaagccttgattcatgcttttaattgattaataaataaattcaaatttccttaactatcattacttttattagtaagcagctgttatgttctttgcaaacactgaagggaacaaaagcactaataacttacagagaataataccactctcccccaatcacagggcatgctgagagtgcccgtttcaaaaacacatacaatttaacagaatgaaaacggatagattaaaaatatagagtaaagggaaataagagtagaaaaaaacagatatttcaggcatatggttagtccacaaggatacaaatcagaagacagtgagttggaacagacttcaaatttggtgctgaccttctttacatcaaagtaaagtggaaagacaatgagctatgaaatatagtgttcctaatatggaaaaaactgtttgctcaaggaaatttgttaacatatgaaggcacttttgatgttgtgaaaaatatcctgcattaaatacaacattcctttttgcatggctacgtgataagttttgctttgtgatgcagcagtgtagcagaactcacttattaagtagcgtgcattctgtctctcagccaaacacccacattattccctactatattcagatatcagatcataagtgacaggactatagacagtgctctgagccttagtaatatgtaaaaaagaggaaaaaatgcaaggagaattgtatctaggctgctcagattatcagacaccacatctagagtgagaggatcaaactagtataaacagtgaccataagatgttgactcacttttgatgaacaagacccacttttaataatggatttatacatttttaatagttggcttacatttcattatcgtttattcagtaccattgcaagcctttggttttctgttgtcaaaataagtaggaaaaacagaagatcaaatggtcatagtattttttgcttcgaaataaggcacatgatttaaatacaggcaagggcatgcacagatgaattttgatagaactgagaaaacattcactgtcatcaagtcaggtctcactgtctgagacatattaactcgtttgcagtcatgtgataaaacaagagaaacctcagtctcagaagttttacacagcaaagcacagcatcagggagtggtcccctgtgaggttagaaagtataaaccaagttgcctcttggattgtgctttttgggtgggtgggagccttaggaaacttgactggcttagggaatccttttctgatgattcctgtcttccccttctggtatctgtgaggatgggaagctgacaattgatccagcagatgtctcaccagctactgagttcttccaagaggtgatcaggcataactcttaggttctgctacctcttaatcacagtctattctggagatggttaatcttccttgctaatgaggatttaattctattttaattgtgatgttccgttttctttgacttattcccagctcccagcttccatttccttacctttgttcactgagagttaattgctcatcaatacctgggggaaaaaaagtaaataatcttttcagttttgatgagtaaatagtaagatattaaggcagtattctcagttgtgtttaaggactatctaaattggagtatcttcatgtacttgttaacatgccaacatggcctctactccaaactcactgaagttggagaaccaataccttacattaactagcatagcaaaaatgtaattcctactttatcttaatggttttaattacttaatgatttactctgtataaaaatgttgaataatagctagctgtcttttcatgatgtattagtcaggactctccagataatcaaagccaagagtaggggatatgtgtgtgcacgagtgtgcgtgtgtgtgtgtgtgcgtagggagagataaatttattataagtaattggctcacatgattatagaggctgacatgtcctaacatctgaagccagcaagttagagactcaggagaactgttgttataatctgagtccaaaggcctgagaaacgagagccaatggtgtaatttccagtctgagtctgagtccaaaagcaacagaagaccaatgtcctagtttgaaggcaggcaaaaagagtgacttctcccttactcaacatttgttctcttcgggcctacagtggattggatgagacccacatacattggagaaggtaatctgtgttactgagtccaccagttcactgttaatctcgcccagaaacactctcaaagacacacacaaaagaatgtctgggcacctcatggctcagtcaggttgacaaataaaattaatgatcacaaatccacgtgttgtcaacttgacatccatatgtatctccttaagtcacacttaatctccaaataaaaacaataactaggttataattccaactattatacaagtctcctgcacacaaacagagaatacgctaattccttccatagacaaggaggtaaagtcctcgagtaatgttaacttttctccttgacattccataacttaaatactgtgatataaagtcagtacatcttacgttacatgacaagaagggaagaaaaaaaggtatttgcttagtgtgtgtgtgtgtgtgtgtgtgtttgtgtgtgtgtaaatatatttataataaaataaagaagaactactcataacaattacaaccctagtttctgtaactggttatatagttgtagctggtatttatggctactttcttctactatgcattctgtattccctttgccttcagcaagcacctcagctagctgtggttctttactggtggagtgactcaaactttcattcctgaagggtctggactatttgtagtgctgcttggattgagttggtgtactctttcattgactttatgcacaggacatagtgatatcaagagatgccctaaaggatctcctatgttccagacatcctctttcttacctccattgtggagttgcactccagttttcctttggtagccaggatcagtcagcacaactagcacagtaactcccttctttgtctgttgattcaaaggcataaagagttcaaagtggctgtgtggcagtattagcttccaggtcaatggaataattgttgtgtcacctaggggaagcatttctttccctgaaactaagacttctaggccagcaaaggataaagctgtggaaataggaagcaaaaatgttgtaagtggtgtaatagtgactggtactacttctgtttccacccttgattcccagacccgtgaatcctgggagaaacagcaccatatattggatgctgattcagaccgcatacagccttctggagaaccttgccccatccctgcaaggtattgccagctagctgtcactgtaacgaaatctttagaagaccattccaccattctctgaaaccagctgcttcagggtggtgggaaacatataaaactagtgaattccttgagcatgggctcactgctgcacttcttttgctgtgaagtgagttccttgagcagggacaatgctgtatggaatatcataacagtgaataaggcattgtgtaagtcattggatgatagctttggtagaaacgttatgcgcagagaaggcaaatctaaatccagggtaaatgtatatttcaataaggacaaaatgctgcctcttccataatgaaagcagtgtaatacatttaacctaccactaggtaactggctggtcactggaggaagtggtgtcatgtcagggactcatagctggtctccgctgctgggagattaggctatcagtgatggctctagccagttggcctttgtgagtagaagtccatatgtgaagcccatgcctaaccttcaaccctaggtaattgcggaaagaagccgtctggaatccacagaatatgtcatgctattcagtaattattaaaatattcctctgctagggtcaccctttggtgaacatttacatggagcaaatatcttcatggtttttttttttttgctcattcagaaaatcctatccacacacatcttccccaaatttccttgtcaccaattttccaatcatgtttcttccaagtccctaaccatctggacaaaccatcagccacagcccctgagttagtatataatcatacatctgaccatacctccttacaagaaaagtgaacatcagatgaactgtctgaagttctgcccactgggaggatttccttcactgctgtctttcaagggtgtcccacagaggtcctgtggtgctacatttgtccactttcgggtggtgcctgcttattgtgcagaccatctgtaaatcatacctagctcttttcttcctctgtcatctgatagtaggaaagtctccattaggccataggtgctggtggggagaaagaaggcagtgtagcaagagtggggatatgtacatttgggtcacctctttatgcaactcacttgtgctttcaggatctgtttgggctccatcatatatatgtgtatatatataaaaaacatatatatgttatatattatatatgttatatataacatatatatgtacatgtatatacatacatgtacatatgtatatacgcatatgcatgtatatgtatgtatatgtatatgtatgtacatgtatatgtatatatacatatgtatatataaaatatatacataatatatataacatatatgttatgttatatatgttatataatatatgtatgttatatattatatatttatatatacacatatatacatatataacatatgtgtatatatgcacatatataacatacatatatgtacatatgcacatatatacatatatgtacatatgcacatatatacatatatgtacatatataacatatacatgtacatatataacacatatatatgtacatatatacatatatatacatatatacatatgttatatatgtatatatgttatatatattatatgttatgtatgtgttatatatatcttatatatatgttatatatatgttataaatgtatatataacatacgtgtgtgtgtgtgtgtgtgtatatatatcttagtgatagagtgctgttgagtagggcaactttataatggtttactgggttagataagacccagtttatgatgggcagctcagaccacttggtaatttggtggcttctggttaagtgttcagtttctacgaaggcccagtagcaggcccagagctgtttctcagaagaagggtagtcatctgcagaggatggcagggctttactcccaaaccctaaaggcctgtgctgagattcccttatagggaccattcagaggctccaaccagcatccctgtctgccactgccacttcaagcactgttgaatatgctaggtcatatggttcatgtggcagagcagcttgcacagctgcctggatctgctacagagccttctcttttgctgggccccactcaaaactagcagcttttcacatcactcagtaaatgggccagagtaacacatccaaatgaggaatatgttgactccaaaatccaaagaggcccactatgtgttttgcctcttttgtggtcataggaggggccagatgcaacaacttagccttcagaaaaagaaggttgtgcattatgcattggctcttaaaccctccacctggaagtgacacatgtcattttcagtaacaagtctttggcagtggctcctttcatgggtccatgaaatcttaagcagggccaggaagtgcagccctgccatgttctcaggggtcagagaacagggaatgtttggtgaacagagctaatgactgactgcaagttctattgaaaagcaagtgttcttgttgtcaaactcctccctcctcttagacactattccctagtgacaactactcctgcttctgtgtttagctcctttggtgcatattttaatatgacacgttgacacatttttttctaaatcaacttatatattatgtatctattcctgctatatcactgaagggtttagttcattcacaccatcaaccttttctctgctcttggcacccaaccctttctcccacaatcacagtttcttaagaagttaattgaagatgtacttgggtaaaaaaacaggatgtatcaaggatgataaatacacaagcacagtgacgtgccatcccactatgatagctgtactgctgacctagaggtcagtggacagaacactctaggaaacagtatatagggaatctataagatataaacaatgttttacagcttgtacacaataaagaacattataaaggcatttatagagtgctaaaaaggagaattcattctaaattgacactaaaagtattttccttatagaggcatggggctacaaagtatatgggggatgaaatataatcctagtgtatgactcagggttgcaacaaattatatttgtgtcattattgtaataataacatttattagatttgaaagtttggaactaatccatgtaaacataaaggtatatttaaggctttgtgacttgggtggtgcaaaaaagaaggtgaagagagagggtaggaacattaatatcatttcttattctataaaatggggattcagtgcatattgtctatgattcatgaaattcaaaatgaaggtttagctatgctgtttgaaattgtaaaggtatcagttgatgaaatgaagacagtgatataattatttgtaggtagggggattaacttagtaagaaaggaaacagaagtggtaaactttctgattctttgcctatctaaaaatgtctttattcagtcctcatactcaactgatagtttcactttacatagaaattatttttgtagtgcattacttcaaaagttttgtcttatttgtttttatacatctaatgttgctggcatctggtttgattcctgtttacttcatcggtgacctatttgtttctctttaaaaatatttgtgatgtcacctttgagcttgatgttaatttttacaaggtgtacgtagatgtggattttgttcattctttttgctgggcatttgatggaccctatcaaccaaaaagttaaatcccttacttagggaaattatcttctaatatttatttgataattttctactacatccatccctccccttattctctcatacttaaactgtgatttatgagttactgggacctctctgtttgatcccctgcattaaatgttttcccttatttactttgtatttttaatataattggtttattttaaaattattttataaaattttagctttatttcttctattgaattttgattttgaaaaaattcatttcccctttctaagagccctgtcttattcttgtatggctccatttttgttgaatcctctttttgttttatgtatgcagactctgcagatcttctctaaatatacaaggggagacttttaaaaagttttattctgttctttaaagggtgttttcatctctttggaagttaacttttttatttgcctagtttaggcttcctccccctcattcccattgcttgatttcctcaaatattcactaatcattgctcaccttttatggttagaagtgaggtaaataaacatttcctagaagcgctgtagatatagacagatttgattattagtctctttatggtaaacaggcaagaagctaacccttatattgggggactgataatgtgagatgtttaagttttcttcttatattttatttaggaaagaaacttctgttttttgttttgttttgtttcttttaacctagtataagtggtgtgcggggtattttacagtatgaggacttctctttagaggctttcattctaacccctgtctcatctcccaactctggtattgtttatatacagttgtcttttatatttaaagaagattttgctatagttgacatttatactctaaagtgattgaaaatacgtgccacatgtctattgtcttttcaattctcagtaactatagaacgtatccttttatctaaatagttgtagctgatgtgactgatgtctagagttctgagtatttcctcttactttcctaccccatcatgtccaggttccatgtcttcaacttttatttcacagtaggtggtgtagcagaatgtattgaagaaaactcagtgtttacttacagcattttatctagctcttttgttaccctgcctttgcacaactcagatgaggatatgatgtagcttaattctgtttgatttcaggaccatattattgaattttttcttgtatgctataatgtaagaaaactatgtttttgaaccagaaatcttcctacagaaatgttgcttttatagcttccagctaatttcacaacatatgttctgattttctacttttgtctattagcatagcacttaacagtgttctgtaaaaatagcaaaaatggatgtattgctaatgaatctatcacttggatgtcgggcttccctaacataacttagtaaagaacttttagctttttcaagataatctttcattcccagcattattctgcctttttaaagcagtacataaactcctgatgtatacttatgaggatatacactggggtaaaacagttcttgagtaattgtcttgaggatttttgatgattccgacagtgtccactgagtgaaaagtttatcagaagatagcaagcgtattctaatattgtgttctgaaacacgactaaaagagcttgaataaagccagatattataagtgaaattcttgtaacagtaaccaaagaaccttggatttttaaaaataaaacttctataggattgataatgattcttttatttatatgtgcaatttaaattgtttattgaactctaaatctgtgctagtcagtatagtagaagatagaaataaaatggcatagaaacagacacaatctttgcactcatgaagcttagagacaagtacagagagaattgtaatacaggataagttcaacaaaatgttatttgttatgaaacataggtgaatgacagtaaaccaaggtttgagtgcagtgatagaagtcagggaagacttcttagtgggaataatatcttagatgaaatctaagtgatatatagaagccaggcatctaagaggttaaagatgaatgtttcagagaaaactcctatggaaaattctgaagtatggatagaaatgtggtataattgaggaacagaatgttctgagtgcttggagtattatgttgaattgcgggtaatagtggaataaggtggtaaggcataatagcatgccaagtcatcataaagacattgccttcttccaaaaagaaaaagaaaaaaaaggaagcccttatttaattttaagtagtaaagtaccaagattatattacgtgtgtgtgtgtgtgtgtgtgtgtgtgtgtgtgaattactctggctgctgtgtggagaatggtttatagagagcagcagagaaagcagaaagaagactatgcatttatttcagacataaggatgtggcaatcatgacagagaaaagtagatgtcataaaataggtaggttctagtaattgattggctatcatgaatggggaaaaggactcaataagcaccctaattctagcttgggcaactatgtagccgtatagtggctaccagttccattccctgaaaatgagactacaaggaaaggatttaatttgaaaaaaatcccttgagacaagtttgagatacattgagtttgaatgatctgtgggatatccaaatagaaatgaaaagaaagaccattataagaaagaccaggaaaaaaataagttaaaaaaagatttggcctagatatacagatttggaattttcagtacataggtggcaaattaaatcacagagttcatgttataatcaagaaagagactataggatgaaaaggaaaagggcgcagaagagaaaactaaggaacctcaacattaaagacatgggagaccaagaagtccctagaattagaaagaacgggagggagaggtatcacaaaaaccaggaagagaaattgttgcaagaggtagggtgtaaataaccaaaaatttgaaatgatactgatggatcaatatatgataaaagataaaagttgtctattatatttaactataaggaggtcattgataactctgcaaagttttgtgtgtgtgtgtgtgtggttgttttttttgtttgttttgttttgttttgtttgagatggagtttcactcttgtcgcccaggctggagtgtaaagtcgcaatttcggctcactgcaacctctgcctcccagattcaagtgattctcctgcctcaacctcccaagtagctgggattacaggcatgtgccaccacacccggctaattttgtatttctagtagagatggggtttcaccgtgttggtcagggtggtctcaaaccgctgacctcaggtgatccacccacctagacctcccaaagtgctgggattacaggcatgaaccaccatgcctggccctcggtaaagtttttattatcaaagatgaattgaagccagaaaggcagaaatagaaaaaaatgtacatttcagaaaacttacaactttaacaaagtatgtggaaatacactttctttaaagctttgtcaggagagaatgtagattatgctaggttgataaacagattggtttttttaaaaatctgagggtaatggccccaccatccatcccattactggctatatacccaaagtattataaatcattctaatataaagacacttgcacatgtatgtttattgcagcactgttcacaatagcaaagacttgggaaccaacacaaatgcccatcaatgatagactggataaagaaaatgtggcacatatacaccgtggaatactatgcaaccataaaaaaggaggagttcatgttctttgcagggatatggatgaagctggaaaccaccattctcagcaaactaacacaggaacggaaaaccaaacaccacatgttttcactcataagtgggagttgaacaatgagaacacatggacacagggaggggaacatcacacactggggcctgtcagggggtggggggctagggaagggatagcattaggagaaatacctaatgtagatgatgggttgataggtgcagcaaaccaccatggcacgtgtatacctatgtaacaaacctccacgttctgctcatgtatcccagaacttaaagtatatttttaaaaaattcaaatggtattgatcaaagatatgaagccctgatggaaaggagttcaaatatatacaatgtaacaaatatgtcagcataacactgataggctggaggtatcattatggttggatttatgcagacatttagaaatacaccactgcattctattttgtgaaatagtgaaacccctggcacttgggattttctgaatcagcactaatttttgtatcacatatgataggtatgtatatttttcccgtaccgtgaaccatctatataatcactttaattgtcatgttttgtctgttgaggtccctgatgtacatccaatccctaaaatactgtctggaatgtgtgagatgggcaatatatatttgttaagtgaacaaaagtttattagagaagtgctgttaaataaaaatatattggttaaatgaagaaaatctgaggcgttctcataggagtaacaaaaaagaaaaatgcacataaattatattccactagatctgaggtttctgaatttttccaggctatagttctaatattccgctatatttcctctgtctgttatgtataggtatgataagccttggcagctgggctgcgctattaaattcatggattattgttcaactgataatgaaatgataacaactgtcaagaatcattcctttacacaggcttttacttatacacataaagttgagcagtgtccaccaatgttctatatcttggatgaagaagaaaatgattaaatatcttatattcttgattataatgagaaatactatttccttgcaaatattatttataacttagaaagtaatatgtgcatatgcataaaaaagcaatgagtacaaaattaaacagtataaaataataatgtgccctcttattataagtcccttgcttactccctggaggaacccattttttcagaacattcccatgtttctataagtaagatgttcattttggagatactccactttggcatacttgttaattaaacttgggactcgaaagacttgcattatttaaattattcttgggtaaaattgctattttttttctcatgactacttcagcgaatattagtctgaatctctccaaatcttgttttcttactacagaccaccatcaactgtcatttgagttctctatcattatgaactacagtcttgtaaatctttcattcactcaacaggattatagcgcatactctgaaagaagtacttcatcctaattagttccacaggtgcctttcctttaaaaaggaaatagtttccacactgtctccagaagaatgttatcgggtcattatgcctttgataaatgaatgtgctgcggagcctgggtttccctgaagggtctctgcaacgcacaaaaatgctgtgttataacttttgatccatgattgccctaattttctcaatttatccaatattatatccagatatgcagtcccagatctccaatgaaccacactgatgcttctttgttgatcttatatacttatttttcctcaggttgctactaaacataagttcttctcttcatactaggtattatgtgtcagcttttagcgaattagattgtttattgcattgggatgagaataaagtacttacagacaatggattagtggtttgaattcttcccaggctatcagcaatcagaagttgttagtactctcttggggtctatataaaatgaaggtggtctgattacaattctgggccagcaggaaggagtacaatttctattacaggggggtaggaacggaagtcttggtaaggaggccagatgtctccttctaatggcttataagaacaaaacctgaacatgttttaattttttttttcctcaaagcactatctcgggagtagtgctaaggtatttcattccctccccacaatcattttctcccactataataacttattcgttaatttacttacgcatttacttctttctctaacactcaaaagttcaaaaagttcattgagattgtctctattttacttgttccaagccagtgcctaccaaaaccaaacacttttggcccttcacttaccatatgcagccaccttgttaatcactgtttctctggacctcatagtttattgcctttgcaaataggggctgtaaatctattgtgcttctctaaaattaatttctggtcaatatatcaaagaagctttgatgacatttgaccaaggcagacgaagatacaaaaacctatgtaaaatgattctgaaatgcttcctatagatcagccagacttttaaatcgtgtatgccttactataatgaaaaagtgaaagagaaagcatgaggaaactagagtaaactgggaactgtgcttggaacccagagtgataccagcacctcacattttttttttttttgtagatcatgtgatgcttctgtagtggttatagaagcagtgtgatctgcctgtagagctaattggcatcaatgagttttaagacaactttctgaaggaaaatacagtatgtgattttagtttggtaatgaaggctggatttttatactattgaaacagcttgaaacttttgaccaaggcctgtagaaagaaatatatgtatttaatattagaatctagcgaacacaaacacgctaacacgtgtgtgtatgaaagtatatatgtatatatttatatatatgaaagtatatctatttctatatgaatataatttgaagtggagattctattaaatgattcttaccttgctatgtgtaatgtcctctgacatattctagtatttattctacacggtaccactaaaaaataactcaagtatctggccatataccattagatctatttcatgcatgcttaatggcttacgtactgcagtttgaaaaacattgttctattgttactccttacgaattgtggatatatatttctatattatgtcatttttaccacaattgctttcatttcaaaaaaaatttgtgttaaaacatgtttacgcattggttttttaaagtactgaagactacaaatatgttcaccatcattgtggattgaaatagtttgtaactattcccttttcacacaactagataacaaatccagataaattatatgtttgagagtatcaagatttttcttttcactcatacttacctgtttcctgagtaaatgaaagatagcttcctagagtgttattacaacatatttacaagttctaaatattctttagcaaaaaccaaaatatttcttttttattcttttggttttttaaattttaaatttgtatggctacataataggtgtatatatgtatggggtacatgagatgtagaaaacatttcacattttgattaaacaaagtgattagatttatttcacctgtatgcgtgctttactatagtttcagtgttaccatgcagatttttccatttattggtccatattcctgtgttaataaaaaaaggtacctctcattttataacaaaatttaccttctccctgaataaaaacaaggcttactctttattagattaatttatttacaggagggatgctaaatcatgcaatacttgttgtaaaaattgtttgaagcagttttttatatgcttatattactggcggaagatgactatgcatatttctgaaccaaatttagatagctgacaacattaacccttaggatttgaaggacaagccaatcctgtataagctatttaggatttcttctacgtacaagtcatccaacattgctcactctattatggaagtcagtcactaagtctctcctaaaagctaaccttttccagtgaaccattattggtgacataaccttatcttctacttcagtgatgaattccacaggtcactggcataagatggttttcaaaatgtagaagatgacgaggagattatgaggatctaggtcaactgagttaaactctgaaagctgtaaaagtgtcatgaatcctgttgttggttcagtcaaggcttgatttttaatatctcaattgaaggtcttcatgctgcctacatgccatacaatatggcagcttgttctaaatttttctttagcaatcttaaagacttttttcaagggacatgtgaacgccaattatatttagataattaaaatgaataaaattttgtttataatatatgcagagagatagaacaaaaatcagctataatattatcctcttctcttgattagataatgggataaaatatatgtcatgttttgatgaatagcgtgtttcggcacacatgcatgttgtcaaggaaggatcatctgctgttattatatcctccaccaatcttcacaaagaactcaagttcaagaagagcaggaaggtaaaggaaataacccacatgaattcatcaataagaattatgttagctatttatcttacatttccctttaacacataggagctctgatatggccatttgataataagtatatttcctaagactgctgaaaaaaatagcatttgctaaatacttggaaaatgcataatgtttacaaaccacatttgtaacctgcaatgtctttttgagaccattagacagctacttactgaagttaattttactaaacctgcaatgtctttttgagaccattagacaactacttactgaagttaattttactaacacaggcgttaatggtacactagtgtcttaaacagcagaatgcaaactagggtactattcagaaacattatagacattgaatggctgtgattcattaaaatatatattataacctattcacttttcgctacattgtataagggatacatttttatttaaatattcttccgatttttctccctatacacttgagagcttccgatttttctccctatacacatgacagcttgtctcctctcatctcaaatatttttacaaatctaagcagatttctgcctttactgcattatcaccttatttgagaaagctcattctggttcttctaatcacttctaatcttgtctcaccttcattgataactttaacggtggagaagtcacagattaagttggactggagttgtggaaataaggtgaggtgatttgtcacagaaattagaggaatcttagtgataaatagtgtaattttcaggatcttgctaaaagtttttccaaataacaagcaaaaatagagttgaaattaaaggtcatcatattttagaaaacaaaccacaaaactaaagcagctcgatgtgtaagctacaggcagaagctaatatctgtattatggattctgctaatatctgtattatggattcattaaattgcttgtatactctttaccacttagttaatatgtgagctttaaatagcttaaaagctggagcaattgtttcatgttttttaaatattgtgtttgacatcaattcttgttaatgatctctgagcctaagaaggcttatatttatgcccagaggatagttcacatttaaaaaaatcattttttcttttacatgtactccgaacgtactatgatggaatcctttaattttaaggattattataattacttgcttcaagagaaaactttttatggagtaatgtgaaatttctttcaaaggcaggcagggttgcattgtgatcttggtaccgaaatcatccggctccatattccaggttacccatttactactcatgtgacccccacacaagctacttcacatctctgaacttacgttttttcactcatataatggtaactattgtacctacttcttcagaattctgtaagcctggctgacaccaaaactttacatgaggtggacactcaaaaatagttgtagtggctgctatttggctcctaggcacctattagtaaatagtaggaaactaagtaaaacaaatatatcaaaagtgatagaaaatactctttgtaagccattcaggagctggctactgttaagaaatgaatgatctcctcctttgagaagagaaaattacttcctccatattgaaatagacttattgcagaatagtcatactatcacacatgagaaaatttctgcagtatgtgagcctaatcccctggaggagaaatttattttcaccctcatgaaaatgtggagaaatctttttgatggctatagtaagagctgaccactggggaggagagaaagtcagcctatggaaatcactctcaacaggtcagaagaagtcattgtggttttaattacaggacaagttttgagcaattattgacctttaactatgcagaaataatttgagagagttttttttttctcaaaggatctatgcatcagataataattgttagcagtggagacctaatatgagtgcctctaatttttcctacaaatttgaggttgttgcattaagtggcattgttgcaggacttttccctaggttagctgaaaaaggagtccttgatccacagccacaaaacttgaggcttgcagacgatttgaagggtgagaataatgggatttattgggcaaaaaggaaaaagggggtaacaaggactctccacaaggccagagttcttgctagtagtcttcccacctcacagattgaattccacgtttcacacaggaagaggaggagccaggctcctcctgcctgcaaacggcatgaacttcctgagtctctagctgggcacgcaggccagttgcagttttgccagggagcccttcccacctggctgtctcagcatcatttgtttatacatgtgtggtactgttaatgttttgtcatacttgtatgtttatataacacacagtagtgtggaaaaacatgctatatttttgaaacttgaaatctgtatgagaaattctatttagatcctgttactcaaaatatgatccatggatcagagacataaaatcttgctaaaaatatgttctctctgtccctggctcagaactattaaatcaagtactatgttttagtaaaattctcaggtaattcagtgcacattaaaatttacggggcagtgcgttagatcacaaagctattcctgactttggagctccttatgcctccaaattgtaaatacttggaggattcgccttgaaaatccaaattcccaaactatgggatcaccatagttaactagtaccttaagaaataaatctggataaaaagataactaattgcctgtgaatagatgcaaaaaggaaattatattatttactaagcctgatcccaagacctaaggaaacatcaagaagaggttctaaatatatgaagggttgtccactagaataggaatggcaattactctttatagacccagagagaattaattactaggatcaacaaatagaattcacaggaagagagattttggtgccagataattgaactatgtgtaagtgcaatgctttttctcacaaatgaaatctatttatctcctttcttcaagccgaggtttacccaatatctgtcatgggctctgttgaaagagcctcataagtaagaggtttgaactgaaagactacagaaaaatgacctcagaggtcactttgaagtctgaaattctaggatttgtccagtcaaggaataacaaatgcctgtgaataattgaatatatgtgacaagtgaaaagagaactgtttgagtgaacataagtagtggttaggtttaacaactaataagaataatcagctacacagcctgtgcagatttaagaggcaaattatatgtttagaaaagccgactaacagaagggctcttagctattttgtgaagacttggaaagttactcattgagccctctgctggctgatatgcagggcactgatttttggatcggaaaggagactaaattttccccctgggaataataggtgatattcgcacatcaaagagaagtagtgagaaagagcaaggataagttgattaagatggcttatgagaactgcaacttgtttgattcttggacatttatttttgattatctttgtaatagcagttgattcaattgctaccatatggtgacaccagcaaataattttaattttttaatatttgaatccactttatttttaaaatctatgtggggaattataattctataaagcttccagatagtataattaataaagtactagcagtttccaaaactaaaaattaaagatgatttagaattactttagaagagaaacacacctgtatgaagtttcttcatgtctttctgtatgtttagaagcatgtttattttcagactaaatctacagtgaaggttaagttactatcatttctagaatgcagtggtaagagagagaatccagtgtatggtaatgaaaaatacccactgtagagtatttccatcatccccaaatgaaacatatcatcatcccccgaagttcctcccattgtgcatttttttctcagtcagtttgtaacacctgcacaacccagaaaactactcttctgattttaattaattttgcttcttctagaacttcagtagaaatgaattgtgtttgacttctctggatttgaaagattcacccaggttgagtttatcaccagtttcttcctttttattgatgaatagtattccacaatttatcagttcccatggtgatggacatttagcttattatcagtttttggttcctttgaaaaaagctgctatgaatttttaatttctcttccataaccatctaggagtggaatttctggtttttagggtagatgtgtaactacagaaatctctcaaactgtttttcataataattttaggttcatttattatgaagaagttatatattctcataagtactgtatgtgtgagagctcaaattgctccattatcttgccaatatttggtattttttggcttttttgttttagcccttctaggggatgagaaattgtatctcattgtggtttttaacttgcattactccaatgactaaagatgttgaacaccattctgtgtgctaattgaccatgtatatgtcttatttaatgagttatcttttcaaatatttgcccatttttattgagctgtttagctatgtattgttgatttcttaatatattatagaagtaagtttttatcagatgaaggaaattcattattgttggtttgtgaaatatatcttaaaatcatgaatgggcataacattttggaagtattttttcctctatcaattgagatggttgtatgacttctgtcctttaactggtgaattatattgaatgattttttaatgttaagcctccttggacttactgaataaactttaccaatggaatctttcttatgtggttccatccatttgctaatattttagtaaggactgatgtgtctaatcttaggagaattattagttcacatttatctatttttcttacatgttccttctcaacctttttttatttgtttgcttgttttctgtttttgagactaggtctcactctgtcacccagcctgaagtgcagtggcatgattacggctcgctatggcctcaaaatccccgggctcaggtattcctcctactcagcctcccaagtaggtggatgtgcaccaccacatccagctaatttttataaatatacatatttttttgtagagatgggattttgccatgttgcctagcctggtctcaaattcctgggctcaagcaatcatccaccttggcctctcaaagtgctgggattacaggcgtgagcaaatgctcccagccccttgtcaagttttgatatcaggattatacataaaatgaattgggaagcgttctatactcttatgttatctgaaaaaatgcttttaaaagattgacattatttattccttgaatgtttgaaaattcaacaataaagcctcttggcctatttcaggaagtttgttttaggaatatttttaatcattaattcaatttttaaaatagagatgaagctgttcaggtttttaattttctccatcgcttttgataagctgtgtattaacagtttgtctgcttcatctaacttgtgaccttattcacctaacgtccctactatttacaaattttatttctatgatctaaaagattttttgttgatcttttctttttcattcatgacatgcctaatctgtgttttcttattttccttcatcagtcttcctaatgttttttgatgctattgatctttacttaaaagaaacttttggttttgttgggtttttaaagattaatttctgtgtacaagcacacattccttggctatatatgctcttctttttctaacttattgattctagctgtcagtttctctctaagcactgctttagctgcaaatcacaaatttcaatattgtatgcttttattatcatttagttaaaatattttctaaattaccttataatttccttcttctttttctaatttgtttttaggagggtgttcttaatttctaaatatatggatgtgtttttatttaaagacttttatttttggctgggtacagtgacttatgcctgtaatcacagaatttagggaggctgaagcaggaggatcatttgagcctattcaagaccagcttgggcaatataatgagtccccttcttataatttaacaattagtccagcctggtgcacgtgcctgtagtcctagctactagggaggctgagtaggaggattgcttaagcctaggatgtcaaggttgccttgagctatgattgcaccactgcactccagcctgggtgacagagcgaggacctgtctcaaaaaaaggaaaaattgctgttgatttctaagttaatgctattgtgcctgagaaaatattctttattattttaatatttaaagttattgaaacttattttttgccccagattatggtatatcttgataaatgttccatgtgcagttataattttttgtgactatatggatatataaatataaatatccattaggttgatatatttattcagattttctgtaggcatactgattttttttgtctactcattctatcagtcactgagaaagtagtgataaattttccaaccatcattctggatgcatttacttctccctgaaataaattttgatgcttatttattaggtatatacatattcagttgtcatgtcttcctgatgaatggacctttttataattacgaaatgttacttttatctctgataaaactctgtcttcaagcctgtttttctactatcatcatagccacaccagatctcttgtaattagggtttgtatggcacctgtgtttctatttatttttaacccatttctgtctttatatttgaagtgtgtctcttatgcacagcgtatgacttatctcatttttttctcattttcaaatcttatctttaaattatttactccacttacatttaatataattatttataagattgtgttgaagtctactttcttttattgttttctctttgccctatttaactttcttgattctgtttttctgtgctctttaaataattgaatgtatttaagccttctgttttatatcttctattaactttttatctgaatccctttattggtgcttgctattgaaattacagcataaattcttaactcatcacagtctaccttgaattaatattttaccacttcacatataataccagaacccctttccatatattttatgctgttgctgtcatttattcctatgttagtaaccccatgatgctttgttattgcttttctttaaatattcaattgtctattaaacaaatttttaaaaaagtattttatatttacacatatagttaccatattttctgtagattcaaatttctacctggcatcagttcctcttgaagagcttcctttggcatttttcttgtaattgacatttggtagcatcaattttttcacttttatttatgtaaaaatgtctttaaaatttattttttgaagtatttttgctgtctatacaattttggattaacaaatattcttttttcccctttctccaccttaaagatacagttgcattgtcttcttacttgtattatttctgatagaatatcagatgttatcttctccaccttaaagatacagttgcattgtcttcttacttgtattatttctgatagaatatcagatgttattttctaattattattttcctaattgtaatattatttttcactgcttgctttttaagatgttctatataccattggttttcatcactttgaatattgtatccctaagtgtgattttcttcctgttcatcctactgtggtttgttgactttcttatgtctgtaaatgcacatttttcatctgattggaaaacatctggtcactatttcctcatttgcccccccaaccccatcctatatatcctctcctcctgtattccaaatacttacatgctaaagtagttaatatcatgtcacaggcactaaactctttcattttttagcaatgttttttctttgcttcagtttgaataatttttattgacccgtcttcaagtttactcattcttctacaggacctaccccattcagttcatctagtgaattatttttgatggctttttagagtttctatttctcttttgaaacagaaaatctcttcattcattatatccatttcccctcgaccttttaaaatcatagttataatggttattttgaagtctatgtctgttctgttacctgggccatttgtgggtctgctttaattcactgcacttttaacttggatatggtcacattttcttgcttcttcatatatctcataattttcttttgtatcctgagtattatgtctaatagaaaagtgaatattgtagtaaaggctttgtttgatttttgttgttgttgtttatccaagtaggtaagctcttttctcttcctggtggttaagatgtaggaatcctcggtcagaatttttttggttgaatagatctgatatggcactcatatttaattaattgaattcatctatgaatagatgtactagctaccatcagtattgcctctacctttttgatcttagtttggactttggaagtcattgggctgaagtttcagatatttggtttatctttggattcatttctagtaaagccttaaaatcaaaggtgcttggaatacactgtgatttctctcaattttcggccccttttccactactggtttcttggcaaaattcaataggcgagaattgatggcccaaacatttgttttagcatatgagtctctttctgatctacatacagtctacctactctgcgctgtctaaggcatggcctatttatccttatccctgaaaagtctccctgtctgtggcagaccctttcttgtgtctgcctatacatagactaaggacttgacccaatgaatacaagatgctatactcatggctcacctattgaatgcttgcccttgtctggactttgattcattaaggctttctagcacccaccatgcttcactaaccacacagaatattagaatttttaaatttgtctaggatttttttattcacatcatgacagtgaaggtgttttgacttcccctatatcctatccagaagtagaaagcccaccagcaagtaaatactttaaatcaaatctcaatttttaaggcatgtataaatagaagtcgagatataacgaaagagaattagagatgtaaagaaaagtgttatcttaatatatgttttattttctatgaatgctagaaggtttttgatatttttatggctagtaaaatgaaatatatataagtagattttaaaattgcatataaacgattttctgtcatgaagagaatacttctaattattaatgaaaaacactaatgtagattatcatttgacttcagtgataatgttactttgtctagatacacttttttttttttttttttttgagacgagtctcgctctgtcgcccaggctggaatgcagtggcacgatctcagctcactgccagctccgccttccgggttcacgccattctcctgcctcagcctccctaatagctgggactacaggcgcctgccaccacgcctggctaattttttgtatttttagtagagacggggtttcaccgcggtctcgatctcctgacctcgtgatccgcccgcctcggcctcccaaagtgctgggattactacaagcgtgagccaccgcgcccagcctagatacactttttaataaatctgagcattatgaattttttcctaagccatggaaatatggaatggcaaggaaactgagtaaaaataggaaagaaagaaagagagaaagaaaagaagcaaggaagaaaaggaaggaaggaagaaagagaaggaaatgaaaaagggaagaagaggaagggagggagggaaaaggcagaagaaaacaagggaagagaagagaaaggggaggactaatttcttatttactccggtaaatttactcctgtagatttaaagcaatcaacagaatgattttttttttttattattctagcttcaaatacccgtctattttaggttagcaccagttttactacaggtcgtttagttttggactagattcttgggtatattctagcatgttcaaatttcagaggtttgtaaaatttgcagaaagttttagttagttccgtttaccccaagataacaagacaaaaattagaaataaataaatgactcaagattaagtaaaaatctatgaaagcaccttaaaaacaacatttatatttatttttcacatctggaaaaccctttttgagatagttcagtactagagaagttcttcggaatttgcaaggtatcaacatatctatatctttctttctctacaccctataaataatattcattgataatagctatgaaatgctttgaagaacagaagatcatatattactatgtttaactgaaaataaatatattaaagatatatagcaatctatcaactatcatcatacagcggggtttgtattgtttgtttgtttcttagtcttatattaaagaggagcctagattgttcctaatctagtccacaacaccccagaactaacaagtaatttcttctgggcataagatttctgacactgcaaaatgtctatcattacttggcaggaacttccggtagccttccagactttcagtttaggaatgactgctctctagaaaggctgacatttgatctgttttagcaagaaaactatcagataacttgtgtctgaggaagcgttgcctttacttccaaagcctcttgtctctggtacaacacgccttggttccatatgtggttgtgatgttgacttctagcgtctgcctcctcccttcaacatctttctgccttttgtttccaaatctcgtagcttcctaaatcctagtacaaaatcccatcccgaagccttattatcttcaggcagagatgaagtggaggtcatgatggctgtagatatatctctcacaacaagatcccctgagaaacataagcagcacaaagactttccctttcaatttagaaaacataatggcaaaaattaaatatatgtggtaataatatagaattaattaaaattagagaccaaatactataataaatattagttaaagacttttctgtgcaaaagaagtgaggcattgctccaaataaatatttattaccttactaatcaacagattcattgaatttttaaataatttattgagtccatataccatatcaagcattaaatttgatactgtgaagaatacagagattatttaagacattatccctgtctgtaatgaatttaaccatccaatgggagagagaaaacgtgcacattaacaggtatagtacaaggtataatctgctgaaggctcgaaaacattgcagaaaaatgctctagtggtttttttgtttaatggtgtgacaattaaacaaaataaagcattggagaaatagggctatagatgatcagcacagttaaggtttttgtttttgttttcgtttgtttgtttttttagatggtggggaagcatgaagacattttagacagcaagaataacgtgagccaaaaaataaaggagagccattgaaaggcatgttcaaggaatgaaaggcagcacgtttgaccagatgccagggaatgtagaagagagtagcttgagctaatcctagaaattgcatatgtgtgtgcatgcatgtgtgtcttggccatgaggaatgctgcaagtgaacttaattcaactaataaagacaatagtagactgggtgctgtggctcacgcctgtaatcctagcactttgggaggccaaggtgagcggatcatgagatcaggagatcgagactatcttggccaacatggtgaaacctcttctctattaaaatataaaaaattgactgggtatggtggtgcgcacctgtagtcccagctacttgggaggctgaggcaggggaatcgcttgaacccaggaggcagaggttgcagtgagccgagatctcgccactgcactccagcctggtgacagagcaagattgtctaaaaaaaaaaaaagacaataagtaactttaatttatgtaagactttgaagtttacaaagtacgtttatatgtcaccttgctcatcttatcaacagagatctccactgataattccatagtcttcttggttggatattcctcatctcgacatttaagatacaacattcaactgatctgaagttcaattactgggtctcatcttatctgtttatactcactcctttggttttcttcatgcagcctcccagtgagccacagtttttcaaagtcatgtctgtattccagaaagctctttcaaaaatcagatttgtagctaaggacacaataactttcttttggctatctccaccaagatgtctaataagattgacctaccatgtccaaggctgaactatttatctcaccaaaactcccctacccacacacatacacacaaaaaccattccacctgcagccttctccacctgagatgatagggattccactgtttgaattagtcaggcttgtgctataaaatgttgcagtgtccagcaaatcaaggtggttaataatcattcactgaatgaaataatacatttttcttatgaattcctgttagcttactgatctggggcatctgaggacatgagctggcctgtagctttacagccatcgaatattgaataaagagaacacagtgtgcttgctcatagtatttttacataaaaatttacgaacataagaacattgataatgtgcatgcacttgctagttaataaacatcagctgggcctttgagagatgccccatcctcacctgagaaaatcggaacaaaccaatatatctgttgaaaaaatctaaaggaaataacgtataggtaaatctgccctgaaagccaaggaatgatttaagtttatcttccataaagagaagtagtaaagttaaatttaatgctgaaaatgtaagaaagcaacaactttatctaattgcagacccgccagcattaccaggactcctgattctctttgatacgcttgtatctgttgtctctcatgcagacttacattttactgacatctttaaaaatgtgataatattctgcaacaaagccacagaccttagagtcattcttgggtcatctttttttttctcatacccttgtatattataaatcttttgggatttacctttaaatacataagaattccatcctttcctcaccgcctctattacatccaccccagttaaagccgtcggcatcttccatttggatttctgcaacaggcttcttgctcgtcttcctgtttccatctttgtccctctacaaccagtttctacacagtagccaaattgaatttttacaaaataaaatgtattcctctactccttccactcttctgctcagattcctgcaaggggttccagtttctctctggataatagccaaaatccctacaaaggcaaacaaggcctgacctgatctggcccttactacctgtcagtgccgtctcttgtcttgcttccctcctttccctgctctagccacactggtttctttgttgctctgtgaacataccagttgcagtcctgccatagggcctctgcactcactgttccatattcctgaaatgtttttctactcaaaagaagttagctttctcatcacaccttccacgtgttgtaggcacaggtttccgttaaatgcttccgtattttcctctatgctctttatagatctgaatgaagggaaaatacaaaaataaaggatcagtaacaaagaatacagattttgatttatccaccttaggaagacattaagtaaaaccatcctactgagaaatgaatatttaagtagatcagagtttgttactaactgtgtaaaacattatgagtcctcagtaatatttccagttctcttcatggattacactgccatgtgctcttgaagtttgagtgctaccatataacttgccttgaccatatgagacaatgttaagtgatcttctgactgagcatgtaagatccagtgtagaatcttccatactcttttcaccttcatcaactctgagctcctgaggagatagcagcctcagaagatggtgtaactttcattactgtgaacccttgagttactgtgagaaccaagaaccccactgaatcatgttggacatgttgcaaacacaagaagtcaatcattgttgctgcaaacaacaggaattttaaagttgttattatagcctaactgaacttgttttaaattatatcctcttcaattattgccttatgttgtacctgggttatctcctgtgaagagatcagcaagctaataggaattcataaggaaaatgtattatttcattcagtgaatgattattaaccacctctatttgctggacactgagaatatagtgataagcaaaactcctatcttctgggagcttatactctagaagttgaggttctgttgagcggagggaatgatgaggctacatcctgccaaaagggaaactctgcccaggatgataaggatgagagacacaaggagtacggggcaaagttagagaagatgtcagtctgggtatgtgcagtataaggttgggaagaagcagaggaacatcagaagtcagttctaggaaataggccttatgagaaggacagccaggtgaaaatacaagacagtagtcagttccaggcaccttgaatagaccaaatatagtgaaataggctgccttacagatggagaatgaagtgactgtgaaggctaaagcagatgttttgcagtgaagcagcatgggattgagaagagggagattgcctggaagtagaacagaagtgaccgggatttggaagttgagcagcaaaatattttccacatcttactaaatcccaagacctatgctgttgaattcctatttggtctactccactgtagccaggaaaagagctagagtgcattcagaaagctatatatctacttctaataattatgatgggcataggggagggtaggaattaaaagatagcataagaacactggcacttccccagagatgtaggtttattacattgcacaggaaaatagaggaaaactacaaggtaactctcaccacagagaaaaaagcagcagctccagacatgcgtcttcaaattcctagttatatgtattaccacataaaggtaaaccaatttatactacccccaaatgctttgaaagacagaaatattctgagacctgacaatttttatttgagcacaattaattgcaaggaagatgaagcagatattagaatgaaaattttattaaggccatagatgtatgtattgaagagcatttcttttgtgtgaaagtaaacaataccaattaaagctgtttaggtatatgaaaattcagaggattgaaccaattttccattaattgtaaatagagatttaatctctcactatgttcatcctcttgaaactcaaagtaagtaaaattatttgtagagaaagaagggatgagcatactgggattagataaagaccggcctatacggagtgaggtattgtgaggagacgtaagcctgtaatttttatacagcagtacgttattatttcaaattaacctaaaaaagagcttgaaaatattcatgactgtatctggttagtaaatgggttaaccgatctgtacatttcatgcatcatggtttcagtaggaaatatagcttcaggatggagattgaagctacagacctgagctgcttctctaggttttaatcgttaggcattgttcttgaccttccttaacctcaacttcaacagcattcagacaaattggttaattgtatgggctagtaggtcacccaaatatgtgtaattggacaaatcttatgcaaattaagacaatgatttgggaattaaataatgcttgcaaaatttgattatttagtaatacccattaataaaattctgtcaaattaataaatttggaaaaaaaatatttcctttctgaaatattctcgctctctgccccatcttatttcattaaggcttacttatcctccatacttagtctttctcaagtacttttccagactccctctctaccctctaccctcaccctgcaaacaattaaatgtttccttaactatctgctattaatccttgcttcagcacttatcatgttgactcatacatatttatttttgtgtacatcttcactcttaagactgaaaatcctttaaaaatgccctgtatattggacacttctttatctctagcatttggtagactacctttacatagtatgtcttcaaatttgtattgagtaaaaaagagtaaagaaaatgtaaataaatgaaattttcctctattttgaaaactttagaaagggagatttatcctctatcagttcagtgtataatgaagtattctgttatcaaatggtaccatgagatgccactaatgtcgagtaaacaattggaaatggatctcatgctgtgcccttgtgggacctcattttcctctttagccttagttattaaaaaagaatagtgcctattcttcttaaaatacctattcctcttattgactttaaccttggtagttaagagaattgaattattttatgtgtgtgtgtataaattctgagaactgtaaaacacatacatgtaagtttctattactgcattaacatggtcaccttctaaaaaataagataaattagagagggcagattcaccaagttcaagaaccctcatttgaagttaggattgaatgtatgactaatacatacatttaattggaaatagttaataatactcttaacccatataaagttgagatattgatggaaaaaatgaaatattttgtagttttttagtttttaaaagtctgttatactagctttattagataaatagaaataaggaatatatacactcattcaaaaaataacgtttaatttttatgtgcttcaaatttctggaattcaaatgcatatatttttatataattgaaattatagcacaaatttaattttgaatactttcttcacttaaatcgtatgctgaacattttactgtatttttatataatataataaaataatatttatcaagtgtattagcatattttacctaaatatttcactatttctgggtattttaattattcctaattttgctgctataaattattgtgaggagcatatttccacatacaggttttccttctctgggattattcttttggattgaatttctagaggaaggataattaaagtattggacttgatttacctctagcaaacccctgtagaggaaagggaaaatatttaccctcttagtaaagaaatctcttattgaacatcaagactctgaagataaattaaactattaacagtaatttgaataaatgaataatgaaaaatatttttattcattttttatttgacaaataaaaatgtatatatttatggtgttacacatgatgttttgaaatatgtatacattgtgcaatgactaaatcaagctaacatatacattacctcaaaaaataatgatttatctttagtgacaacacttaaaatctactcttgtacaatagatttccttccttccttccttccttcctttccttctttctttcttttctttcttttcttcccttttcttttctttcctttcctttccttttcctttcctttccttttccttttccttttccttttcttttttttcttgacggagtcttactctgttgcccaggctggcaatttcttggcttactgcaactttcgcctcctgggctctggcaattctcctgtctcagcctcccgagtagttgggattacaggtgccccccaccaggcctggctaatttttgtatttttagtaaagatggagttttgccatgttggccaggctgccctcgaactcctgacctcaaagtgaaccacccgcctcggcctcccaaattgttgggattacaggcacaagccactgtgcccggcctcaatagatttcttaaacttattcctcctaattgaaattttacattccttgagcaacagtgaacaaaagtatttaagaaacaaaaacaaaacaaattaggaaaatcaagttagcttcaggagggaaaggagtgtctaggacttttttgtttgtttgtttgagatggaatctcgctctgttgcccaggctggagtgcattggcactatcggctcgctgcaagctccgcctcctgggttcaccccattctccggcctcagcctctggagtagctcggactacagacgcctgccaccatgcccagctaatttttttttcttgtatttttagtagagacggggtttcacctgttagccagggtggtctcgaactcctgaccttgtgatccaccgggctcggcctcccaaagtgctgggatataggcgtgaatcaccgcgcctggcctaggacttctttcttcaacactctgtgtttgttttctcagagcttttccccaaggaaaaaaaatgctgtagcacaagggaaatgcatggttcttaaaaagtgcagtaaaattactcttcaaaaggattttacactaataatgtgttagtttatcctatcagttctaggagaacattaggcacaatttgaaaatgtgttttattagacataattttaataaaattattatatttagtttttcttgaaaccagcagaagtaaaataaaacaacacggatacctgggattgtgagctttagtttatttacttattacttcaaaatctattataatactagctctttttaagtgagagatttttccttcatctgtcggtttatgaattaatcggcagtcacatgcattttgttactcagggcttttattaatttttttaaaattttaacattcaagttctatcaaaaatctttactatattatagacatattttcggagaaggctatttttattttcttaaaacagtagtccctcaaatctccttaagagtaataggttaaattttaatttttttttcttttttctgaaaatatctgttttctcatcatggtttcttttttttttttctatttatttgtttttcctttttaatgctatttgtttttcagatgcttgctgtttctttttttctgttcaaatttatgaataaaagattagggtgcttaatgtaggtatctagcaagacatctctgtcatggtcctagaagttttaagagctgtgaattgggagctgctggggtccatgactgtcattttctggcaatatgatatagcataggcagtaagttcaactgaggcccatttctttggaatgtattctacactaccacacattcatgctttctctaagaaattacttagcagatagcattcattcattcatgcatttcttcttctacaaattctgattatgatactcaatagattcaaaatgctggggaacaaaggtaggaatgtagataaaactctgtctcccaaagaacaattaatataagcaaatatgataaaagataaggataagcatagtttgagtaggcttaaccccaacctatcttgggagtgggggccagaaggggtcaagagtggcagtgaggggtgaggtaggatagattgtatctctgaagggttaatagaggcagtgctgactaaagtaagaattgatggatctatagaaattagaaaggtggattgattaggaaagggcatccaaaaggaaagcctttcaaacagggagaaaaccatgtgcaaaggtgaaatgtttcagaaagagcaaggtggatttgaaaagccacaagtagcgcagcatgcttagagaggcagtgtgtggaaagagagattgctgggcaggaagggaagtggccagcttggaggtggtagctgaagctattcacaaccatgtgatctgggagacactataacatggcatttcattaggaatccagagacctgaaatctttaactgggtgagcttaaccaaataattttaatttctgaggcctctgcttccttctttgtaaaaggagcatgtgatttttagcgctccaggaagccctccccccaatgggtgctggtggggatgggaacttggtggccagagctctttgtcccctgcctctttcacttatactatgtcagttttgttttcgcctgaattatttgtttacaaattaaagtgaatttatttatttaagagagagtctcactctgtcaccccagctggagtgcagtggcgtgatcttggcttactgcagcctccacctcccaggttcaagcgattcttgtaactcggcctcctgagtagctgggattacaggtgtatgccaccaagctcagctatttttttgtattttagtagagatggggtttcaccaggttggtcaggctggtctcgaactgctgacctcgtgatccacccgtctcggcctctcaaagtgctgggattacaggcctgagccaccatgcccagcctattaatttattatttttggaaaactggcctccacaaaaaatatgttgaaagccacaagactaagttatctgaggtctttctgtaccccacaccacttaaggaaaaatagcagtgtttactattagaaagagcagtagacctggagttcaaaggttggatttttatggttggcagacctctgtgtggccatagggagccaatttttcttagctgattgttttaattataaaagaggaacaaatattatctgcccttcttgtcttgatttttttccaaaactgaaataaaatcagatatgttgaagtgcttagtgaatagtgaggtattttttaaatgactgttattcttaaggaaaatattacctacgctgaaagctgtctctaggtgtgagtatctaatatataaaagatgcccttggcatgatgaatctggttatttaatggaggtgtcacactttttatgttgcatttttcttggctcaagttcccatacctaaaagtgagataaaaatctctgtactggacaattttatccatagttttctagatttatcagaatgaattttattaaaagaaaaataaatattaatggtcattttaaacttcattggaaagtgatggtaaccttatatcccaggatgcttccttgagttattcactgtgcttaagagcatgcattaggctggaatattatgaatcttcttttcatagtagtttcataacaaagctcaggcgaagtaggtttagatgtttgttttttgttgttgttgttggtggtgatcttttaatggagcatttcaaatccaagagccctttctcctattaataatactgcccattctcaaaagcaaaacttaggtatgtgttaggttaaaagatcttcctttatgcaatgtgaacagggtaaaaaattaaggttgaaggaaatagataactctgtctttctacaaatattacagccacttccacattgcagatgaggaaaaagaataatttttccctctaagaagttattactcagagggataatatagttaaatatcactcacgtttttctgaatgcaaatcctgtgcacatctccacatgctatcaggatccaatttaaggaggactttgttaccattctacagagtctaaaacatgtctggatccctgttcttaacccaggctgcatgtagtgataatttgaaagtgtgacctagccccagctccagagattctgatttaattggtcttgaaggaggggaccaaatattggtatttttactcccctcccaagggatccaagggattctaatgtgcaaccatagggagaaccactaattctggtaaaaattaagcagataaatgatttgttcagatttgtagtataaaaaacattattttggtgtcagtgtgaaaaatagattggatgaaagttagatgaggagggcagaggccagtgaggctggcacagccatgcagccatgaaccaatctgagtccatgccaagaatttccaatattgcttgcaatttctggatgaagaatcttgttgttaccaaatcctctgtgatctatttccctgaccttagttgacccttctgctttcatatttactggtcattctctcctggtgcttctagttacacctttctctggttgtcatagttatgatttcgagccagtgccctttcccagataaagagggaaaccaaatatgttgctgtgaatgcagaattttgaatagggcatcctgggtattttctctcatctgatcagtcctttcaggaggattttgcttacacttcccaatttgcagtctcaccagagccctcctcttgtcttcctttgccttaatacatagttcagcttcacccagggaggaatcactgtatctcactacaaggagacaccttcatcctctgagtaataacttctcctgccctgtgtgaggcaggagaactaaagctaccccaagtcccggtgttatttctgcctcacaagaagtgctgggagcatcccatcactacaaggtgatgctctcttttttagaagaacccctcaactgtccattccatttgtattacttccgaaccctgaaactatttcctcagtacctgttctcttcagctctgagttaccacccttcacaatgaacaggaagtacaggaggcttggatttaaacttggatgtaatctcagtttaatccgttgctagcagcagcaagtcacttagtgttagtgggtttcagttttctgacttgtaaaagtaggaaaaattatatgtaccctccaaactggaaaaaaacctgtaagcttaagaactgagtacaatattggtacagaggatgcattcaacaaatgagagttgatattatttttgctgttatgattattaagtgtgcatgccttcaagtcagctgagagagcaaatacatagttaaaaatgttagtctttgtaatggctaaatggggatacatgtatcttcatatgtatattatatatattaattatatacatttaattcagtatatttaatatataatcatttataatataattatgtatattgtatgtatgttgaaacaagggaaatagagtaggggagaggaaaatggataatgagtataggaagaagacaggctttcctgagatcttattatttttatgctattattattattattttttctgttatatttgtttcctggtctagttcttagtgaatatgggaagaggaaggatagagaaaaaaattttgattgtgtcaggattaagagtcaaaaaaagatgaaaaggccgggcgcggtggctcacgcctgtaatcccagcacttaaggagactgaggtggtcggatcacaaggtcaggagatcaagaccatcctggctaacacgctgaaaccccgtctctactaaaaatacaaaaaattagccgggcgtggtagcgggcgcctgtagtcccagctactcaggaagctgaggcaggagaatggcgtgaacccaggaggcggagcttgcagtgagccgagatggcatcactgcactccagcctgagcaatagagcgagactccacctcaaaaaaaaaaaaaaaaaaaaagaaaaagaaaaaagaaaaaacattgccattatatcatgaaagttcatttaaaatatatgcagtcataattagttttgatgctaaattgcagtttaattaccgatttgttttaaatttagattaattttgaagtttttattaaatgtgctctttttataaggtaaagttctttttaagtcaattgaatgctgtcaatagaaataccttttgataactaaagtatagttgattaattaaatagaaatatttgtgtagcagggagtaacccaaatataagatcttgacttctgtctttcaattgaggacacagagagaaaatagatgttaaactttgactaaattgaattaaaattcaatttaaaattttatatttaaataatttaaattaaactctttattagtaagtaatttttaaagcatcattgaaaatactaattccaaaacagttgatggttttaaataatttatttaaagtctgtaatctaaggcaggcaccttactaaagtctcattcctatttcccatgaaactaacatacttaatggacaagcccaattacaaaacaaattcctttaggaattttatgactcaaaaaaggaatagagaagataacatgagagaacatatattgaatactacagtagaatgattgttcaacttttaagggatttattcaactacaccatcatttagcccatatgtcacagttttgttcacaagaaaactaggggtgacttttgtaaaagcccttggatgcagttaagataaactatgcaaatgacacatttgatctgccactccaataattatttaaaaaacacagacaggatctcactctgtcacctaggctagagtgcagtggcacaatcatggctcactacagcctccaactcctgggcttgagtgatcctcccgcctcagtctctcaagttgctagaaccacagtctcatgccaccatgccgggctattttttaaaaaatttgcatagagacagagtctcactgtgttgccaaagctggtctcaaattcctggcttcaaaggccttggcctcccaaagccctaggattgcaggtgtgagccactgcacccagctccagtaattctaaaaataaaaaataaaaaataaaaaaataaaaaaaaattatggtgactttacacttagcaaacacatatgagcatcagttttagaatttcagttaatgtcaagattggtaaacttcagtttatggaatcttgtttgaaaaccaggacagttaattttcatggcactttttcatggtgacttaaaaataatagatattagttccaagaacacttcttcacgtacttttggtattctaaattaggtaacaaatttggacctgaaatcttaaaacaaatttaagttaccttcaggcattcttatttcttcaccatcatattcttttccagttcaaacaccattcttccctatgaagcaattggagctgagatttaatagttttgcttttctcttggtcatttgttcatattatatagttggctccaagcaatcttattctgatcccatccttggctgtcattttcttctaaaaataccacataaatttctttctattattgctggcatttttacaaacgtcagtcaactcagtatcagtatcattaggtaatcatactcttctttcatgttgtttttaagtttcgtttcttttcagatctttctttttaaatataattctcaaatacaaagttttcagaaacttgcctgtaaaaccatcctgataatttgtagaagcctttgtgatcctttatctagattgtgacagagctttagaatgatatggaataatatataaaattttctttttaacttgtttcttataatctaaagctgcactatcctttatggtagtcactagccttatgtggccattgagctattgaaaaggaattattccaagttgagatgtactctaaatataatatacacattggattttgaatatatttatatggaagcaattaaatttctcaataatagtctttcatattgattatatgttgaagtgataatattttgacatattgggctacatataatacagtattaaatttaatttaacttgattcttcattttttaatgtggatgctaggaaatttaaaatttcctgtgtggttcacattatgtttctatgggcagcactgattatttccataatatttttaatatctttaatatttttaaataagtgtattagttttctattgtagctataacaaattcccacaaatttaatggctaaaaacaacacaaatttattatcttacagtttaggatgtcagaaacctaaaatgattggcaaagcctgtgttctttttggaagttctagaaaaaattccgttttcttgcctagagaccacctgttttccctggcttgtagctccttctttcgtcttctaagctaagagtgtagcatcttcaaatctacctgactctctctttctccctcatctctgtttctgttatcacatctcttactcttattctgacccctgaaccctctgccttcctctaataaaaacccttgtgattacttggtacccatctagataacccagagtaatctctccatctcaagatcctcaatttaatcacatttgcaaagtctcttttgccatataaagtggcatatgcacagattccaggaattaagacatctgtggcgggggagggtggtggagggtattattccaattaccgtattaagtatatttaatgctattctttcttgatttgttaatttcaatttttaaattttgcttgtggtccaatattttaagatcaacgaaacggtaataccaaaaaacaatcataagaaacatcgagtcaggtgtggcatggcacaacagcttctcatctgggcgatgctgctgacctcaacgtgatcttagttaagtcatttatcttcttgtgcttttttctgtttagcaaaaggagtctgtgagtctatgaaggaactttaaaactgcagttctttgggccactgttcaaatatactgtagttgttttaatgattagtttgagtccttgtatgatgaatttcagctataagatatatcttctagcttcaccagacttatgaatgatgaggatgtgaattgtgagttggtttaatgtattacacataagccaagaattatattctcattctatcaaataatgagtatactttctgttatcacataaaccatctatcctcatagtctattttgtgatgtaacaaatcatgctttgaactttcttcacattgccttttctgcttcatctatgtaaacaactatgtctgaaatattaccatgtcctgctttccttctctcccttcctcctagtacaatttataaataaagggtcaaaatttaattgttttcttttgtaacaaatccaccatttgttagcttgtttatcactagggaaggtttgggaaacttttatagaagaggacacaagaaaaggctgagagtcatgaattttatgatggttggaaggttgaacaatttcttatgcattgaatgtaacatagttttgtcattctgtttaactaaatcattctgcttgtttctaggtcatcagaaataattttattcacatacaagcaaaaacaaactctaaaaccaaacacacatgatcttagaaaaatatatcatctttgaaaaacttgtgacatattttctcagtttcttgtaagtaatcaaagcttaaagggacagattaatgtgtagatagataggtgatagatggatagatagacagatatatagacagatagatagagacagagagacaagaagacagagaaataaccattcctttagaagatgtcattttaggccggatgcggtcgctcacgcctgtaatcccagcactttgggaggctgaggcaggtggatcacgaggtcaggagatcaataccatcctggctaacattgtgaaaccctgcctctgctaaaaatacaaaaaattagctgggcgtggtggcaggcacctgtagtcccagctactcgggaggctgaggcaggagaatggcatgaacccgggaggcggagtttgcagtgagctgagatcgcaccactgcactccagcctgggcgacagggccagactccgtctcaaaaaaaaaaaaaagaagaagaagatgtaattttaagggttcctttatttaatattttggaaatcatggaactaaatattttgggacaggtagaagatgctcattaagttgctaattgaacaataatgaaaattcaggctagtgtttacttttaattatgtaattagcataaaatcctatccaaaaaaagagtacccaactcttgtctgtgaagtcaatgagatgtcaataccactgggatataactaaaaatttctctttccatctcgaactatagaacattaattttcatgtggtttcccatcctattaggtcaaactttatagtatattctgctaatactggaaacatagactcaaataaactaatattttacaataagcattaatagatgatatttaataagatggtttcctgattgtgttttttcagtacttaagaaacatctaagataattttatacaatttaactcattctatactacattgcaatgtcaaaatcaatcatggtactatggaattaaaagccaccaaaatatcaagagaacctgctctgaggttattagagggtcagcgtaaatactgcctcacaaatgtacttacattcaaaaatgaagaaaatattctgcaaaataatgcatcatgctattattagctaaaacatttgaaattggaaatttctatatttttcaattttaccaattaaataaatgtataaattatagatgtaaaaaagacctttttctaaaagaaaacagaatcttaattattagcctaatggcaccattatttgaaagtttttaacaagtcagaattattcaagtctgttttgaaaatctggatttatttctgatttaaacccttttaagagtccctctgtaaatatcttttagcatctctaaccaacattgatgaaaaagccccatttcaaaagtggcagtctcatgctaaaatatctagtcttgggtagtcgcagtggctatgcctgtaatcccagcacagccaaggtgggcagattgcttgggctcggaagttcaaggctagcctgggcaacatagtgaatccttgtctctagaaaaaaatacaaaaattagcctgatgtgatggcatggcgccggtattctcagctactcaggaggctgacatgggaggatcacctgagcccggggagtttgaggccgcagtgagccatgatcgtgcctctgcactccagcctgggcaagacagtgagaccaggtctcaagataaataaacaaacaaacaaaatgtctagtcttgatcatcacttccttagtttccattaccaatctctattccatgaaatataaagatacatctggtatatttagcatccaggcaggtgtgttctcccaatacgtatctgaaatatagtcagtaccagtcaagcattttaagtagtcttttctaattaagcaggattgtgggagtagattcttccccgtagaaagaacctctttgtaaacagtcacctttgcagtagttagaacttacaatgttgcaccactttttatttttgtttctttcataattcccaattgccattcatttagattcaagtcttgagcacttaatatgaggttacatcaggggagttctgaagatggtagaggatttttttttctccagacttgctttacaattctgttttattttatttctagcttcagaatttttaaaattatttttaaaaaattgttgtgggtatatagtaggtatatatgtttatggggtacatgaaatatttcggttatttcttctttttcagacactgagctgctatctttcacaacatcctaaaacgtttatcacaagccagagctgaattgatttgacctggtcataaaagatgtgcatttatatgatttttcaaaaaaaaccccaccttttctcaaaataactcttttgtattaaaagcaacaatgaaatacttactcctctatttgttatgaaaactatgctgcttcctcacatgatccatttggtattaatcaatccatcattttctatttggtatagaaaccaaaataagatatgtaattctaagatgttttttatcagagctgaaattttaataacacggttaaattggaatgccctatagtgctcaggtttaccaatcttggtcttttatttccattattattattcatactaatttttactttcctcctgtattgatttcattttctgaagaaattagcaagcccatctaatgaagagattctcttcattagagaatttattctcttcatatagcaactagttttattgtttgatctattaagtcagtcatttactaataatttgtatcatgaaggatacaaatattaagtatgtttctatcctctctgtcagtaaatcaccagggagataaatgaatttgattcacatttttattctcaaacacctttcctctatccctccttctcctttcacttctccttttactcctctttcttcattgactaccttactctgtgaactcattttacacttaaacatactgaaaaatgaaccttcagttctatattaatatctaatacttgttcagtatggatgctgaaatattaattgataatagtaatagccatttgcactcaacaaataaatcatcaataggaaactaaggatttgtggtagttggctgttttaaagtcaactctcctatgatatactttggattatgcccagtatacaggaggtattcaataagtgtttgctgaaagaatgtcagcctctccaaatttcagaaatataatggtacatctgcttcttctcccttatctttctattatcaaaggaaattaaattggcatatcactatttccttatcacaaatctgttttggttatttccaggaaatctattcagaatagttgaaaattgattgtttgacaattaactcaagcatttttcctgagtccagggtgcattgaatagtattaactgctcaattgagttataaaaaatgccttttctaatatttggtatctcttttgcatggattatgaaatataatgcctagtgattgtgaaatgagatttccagtccccatatttcatatcaacaaagtcttcttatttgaattcacatacatattttaaatactctgggtgagttttctttcatgttgtaatttcagcttatggctactctggctttggtagtttttagttaactggtcagactgaacatgatcaatcagttgattgactgtttcacaatttcagaggccctgttactatttgtgagatcaaaggaaaatacaagaaagagctagttgaggattacatatatatttttttcaatttcaaccatattttcccatttaggtggtaatttttgcttcctagctagaatttctaatatcaattatagaagtaaataagcaccattccatttacacttcttagaaatatttagtagtacagttttttaaaaaaatctccatataaaaagcacattatgaaatattgatatttcattttttcagacttaattagaaaattttataatatggtaaagattcacaggaataatgtagtctaaatctttaattttaataaaatatttaaagcatataaacaatttatatagtaatattgtaaacacccatgtactcaagattcaggctgagaaatagagcacagtagatacagttgaagcttctggtgatgcctttccaatttcatttacttggcaccctccccacagtaacctctaccctgaatatcatgtttgtcattatcatacatgttgatatattttgctgtatataggtatgtgatcaaatataatagatgtaattattttacctgtttttgaattttatatacaaatatcatcatcctataagcatctttccgcaacatcctttgttgttgttgctgcatattatattttttgagattcatttatatcaactcaaggagctgaggtaacattcatttttcttgttaccgtttctactattgcagtatatgaatattctataaatattttgtccagctatttatctgaaggtgtttagattatttctctctcctactgtttttttctctttcaaatagttgtggaatgaatagttctaggagtggaaaaactggattataggacataaaaatgttcaactattgctaaactgctctctgaacttgtactatcatatactctctgtaatttcttcacattttcatcaatattaagttttgctggacttgtaaatttctgccaatttcatgactgggaaacaaaaatctcattattttgaattgcatttctctaataactagggggattgaggacctttttcagatgcttattggacattgagaatctttttctgtcaatcaactattcatttccttaacccattctttcctattatattttttatcttttataagcccctttatgtactttggatagtaatccttctttgattatatgcattgcaaatatcttttatgagtgtacattttgatttatataattgctttattttaatatatcaaatttaatattatttctttatggactttggcttttttatgttgtttagtaaacctttctgttctcatctacccaaaatcataaagctatttccctctaaatgttgtaaaattttgctcagcatctttaggtctttaacccaccttaacatacatacatgtgaagttgcaatcttgtattatcattatttcatatggctaattcagtgtctgaatatgtcatcttccctcagtgctttctgatgtcaccagttatttatcaggtttccacaaatccatgaatatttttctggactttctattctgttccattggactagtttctagccctgaaccacatctgcattgcctcagttactgttattttatgttaagccttaatagttcatattggaacttcctgaacctttttcttcagattattcagattatattgataatttcttaccctttgcccttgcaaacacattttagaattaacttttaggcttccacaaaaaaattgtagtagattttattaataattacattacttctatagattaatttaccatattgattctcccatccaggaacatgtatatttattgatttatatgggtttaccccttagtgttaatagataaattagccgtgggccaaaaagtgatggcccaaagtcacatagccaattaatagcaacaccagtggtagaagaaaggtcttttgactccttaacaccttgtacactaaaaaggcttaattatttagtcagttaaaaaagagtgtcttggactgcttgcagctacagaacccctcacaatgaaagagaattcaacttctctagtttactaggcccaatttgtgtttcaagccctcaaagtgtgattagagcgcttgggaaaacaaagtcctgaaattccttgcattgactctttctctggagcctgtcggaaatgctaggggtaatcttgaggtcattgaatttaaaagcattcaggtaagcaacattgaggcctatgtaatgactcttaggtcttgttctgtgaccacaggcttacaggagctatcacttgctttgctgaatgaacactaaaagtcccaaatgagtaagagattatctaagaatacacacacacacaatcatattcctttaaaggaaataaaattttaaatgtttttctaaaagcagcatatctcaggaagagtgaggcttcttttaggtcgatagttattaaagaaacaaatacaattgctttgaaatcaccgaattgcctcaaattggcattttagctactaactgccattggggaaatttttgtagacaaaaaaaaaaaaatagaatccagaggagacagaaacacagaagattcagtctttaaacgtaaaacaaagaaacatcagatgctgtattcaagtagtcatatactattcatgttaattgcagttcagccttctttaactactgcagtagccagttatctaaaggggcagaaagaaaaaaaaaaaaaaaggtgaggagaggggatgggaaaaaaaagtgagatccctgcaatatcgcctggagccactaggggtatctttgtaccatttttcatcctgcaccgatttggagtagaaacctatattagggtaaaaccagggtcctcggcatttttttttttttttttttttttttttttttttgcgaggagtgcacccagaatccaaaaaagattttttaaaaaagaaagaaagaaagaaaccagagttttttttcagtcacccgaacagggttatgaaattgttcttctggacatcagcaccgggaattcatttttgaggtcaatttccaatcgagataaatctattggattagtaggattatctgattgcagccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggtaagtttgtggctcttttattgggagggggctgccagggttttgtgccactgcgcggaaggtgatgcggacgcggtgcctgtgaaatggagagagaaaggggaatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggcttctagggggatattttgcagggggaattggctgttttcatgttgtctcctcccccacccctctcttcctaccccttcccgcttcccgcttctctcaaccggacactaaagggttacagggtcactgcaccggatagagacagtagaagtgggtggctggccacacatgttgtcttgtaattcacttgcacgactttccataatacaagtccgaggtaactttcttcgagttggagcagcccaggaagacgttgcaggctttttgccgagggcccaggctagcgagtgcgccaggcagacggctgcatttctgatgcatccctgccctgcctgcctcgccacttactggcttttctttccaactgagcggtgcgcgcgcgttcccagacattttcttgcagctgaattcaggaatttttttctttttttaagaattttgtagctcccaagaaaaactcatctttatttgcagaaggaaatcaatttcagcagctataattaatcactcaaatcagtgaatatgaattgactcaggcaactaaaagttgctttggaacccagaaaagcatattattctgaagtaattttggagtccacgtagcttcagaacaattgcatacaaagaactgatttatttgagggatgtatataaatgtgttcagtaggttaacgaatctgagacttcaacatcacaattttagttggcttttttttttaaagccaattcgttaaattttaaacttgtagacattcaaatgctttggaataaaatggagatagataaaagataaaacatacattttgtatgttctaatctttagaataaaagtgttaccttttttcagggatttctggtttacagattatgactgtatgcagatacctttgtggttttaccactgaagtctgtgtgtgtgaactcatcaaaaggcaactcttcaatgtcatctgaagcacactcattctctagtactttttttcaggaattccagatacatgcgacgttctgactattaaaagattagtctaaccaaactttcttcctggatttgtgtgtgtatgtgtgtttctgaaatctaattttgaagcatgcatgtgagatttgttttctaaagatgaaatagcaaaatataaaacttttgtctcccaggaattctaaagtggaaaaggtagatatttcttatttcagtagacgttgtgtaggcttatttagagattatagaaataacaataaatagtttctacaaacccaattgttagttttaaggcgatatctgagaagctaggttagtctctttttactctgctataacccaattgttagttttaaggcgatatctgagaagctaggttagtctctttttactctgctataagtcacgtggttcacgtgcagactgagagtagaagaatggatgttctgtgtattggcacagtctagccactgatcctagccacactgtctaatagtatttaaaatattttcaaagtttaaacggattttaaaaagacagctagcaaatatcattaagtggtaatagcaaataagtaatgaaggtgagtggtaggtgggttggaatttctctttttaagctaatagagaatatggctgttgatataaaaatagatagataatttgaaacatgaaaaagaaggtccttttaaaattgatttgcatattccaaaaccattaaatcagtagtcattgcatgtgccatagtgttaaaatggaagacttaactgaatgtgcctttgtagtgcctggaaaatacatttctgtcagaataaacaatactttctactcccctattatattctcttttgtcagttaaaatgaaaagggagaaagtgaccttctctttgttataatctacttggaggggctgtatcctttgtttctacaagcagtacatacacaaaactttcagtaaactttgtaggtagtaaatccactttggaaagccaataacaatggaaataagtatatacaaaactacacaccaaaattttttaaaaagttgcggccagtaaacgaagagcaaggtacccagttagataaatgctctccctaatagagtggattgttctaggaattattgaaaaacctgaggaattcacttagaaaattaattccatttagctccatcttacccaatacatgtttttggtcctaattattaaaaagaacatggtagccttgatgagttgtgaattttctatcagagtaacacaaaatgtggtagtttggggtaaagagatggaagctgtcaattagccctggaaatctgcaagcacagtttctgatataagtgacaagaaataacattggattcctctaagcttatcactatgtaaaaactgatgttgcattcactggagttttgcttgacagctgcacctgtccctcaaaaaccttttatgtgttgcaactggcctaacattcaggaaaagctaacacatttgctatagattctttctatgattttgagatgattaactacattaaatgttattttacattaaaaagaagttagcaacacactcttaattagaagcaaagtgataagggcaattatttttaaatgacttgttgaaatttaacacatgacacttccaagtgcaaatcttccatctcttttgctttattgagaaataaaaaagaacaaaaaccaactttcaattaatttaaaattcaagtttttgacatattgaatttgccaagcattgaaaaatatcaaatttgtgaacactcatgatgagtctaatgtttttattgctttttaagagataatttaaaacatcatgaggtagctaaccatataatcctgtgggatagcaacattctgtttctaagaaaatgatttctaagaaaaatgattccttaatagtaacccatttgctggtcacttttgttctgttattaatgaaataatgttgataatgtcaaatattactatgttggtataaaatgatctgaataatctctgccttcaagagtcatcccccaaacaaagtaaaatcaaacaaacaaaaatccccacagccatttggtagctaacctgtgtgatagagaatgactgtcaactcgaagcttaagtgaagtcagggaaaactagtgaatcattccaggagtttgaaattattagacattaaacttttgggggatttttatatgaattctttttataacagtcagtataatctcttctgtgcctatttccgttgcatgtgagagaaattctagtcaatggcaaagcgcttcactgctgccattactgcagactttatagatcagagatgtgtcagcatgttagctttagcagtaatgcctcttttgtgtgaaaccttatgggccttgcaggcagtctgtcatcctgacactcataaaacgttcaagtccccatatttattatttaattttcttcctatatatagcaacacagcacttcaatatatgaatgtgtagtcaaaaaaatgacaggcaattgtggatgggactaatgagttttaataatacacatattagggaccgctaaaggaagtttaattaagaaaaacaagttgagcatgaaattcattttggaacaaatgcaagttaagttactactactgatgtaaattcaaaaaccacagtgatatatcacaggaaattaagttccagcctgagactagacctaactaatgcagttgacatcttaggacttagctttaagtggacaaactttgatttgacttatgaaacagaagaatatgtacttttttcactttctcctggtttgtatagaaattttagtttagtattttcactgcatatccagctacgctttatgtacataatattagttcacttgtgacaggccacacagtagctttttctttttctgtagcctacttttctaatgctacatatgcctacaattagagctacctgctgaggcccatgctgtctctttggaggtgctgtaggtggtgcttcattaatagaactgcatagtcaactttcctctacctataattctgtttatgttttgcataatttagaaaataaatagactaatgtgtttgcttgcttacttttatttatttatttgatggtggcagtgcatgtggaggaaaagcagaagttggggaagagattgaatattgggcaactattttcttagaatgtgattttcttatattttgcttgtattgaaatagcacagacactttctataaagagtaaataatcaggcaatgatatgaaggtcttattgtatacatatggttctcaacaaatgcctattgggaaacatccaattgatatactgttttttataccaatgtttgtcatcagttttttgtaaccataatgattcttttttcttccctgacacacccaatgaatggtagatctacaggagaagaaaagaggttacttgtaatgtttgaaaatgaattgaaaattgtcattgctttttaaaaaacagtcacaatgagtactctcatattgtcatatggaatactttctatgcttggaagatcaacaagttcaaacatgtaatcaagtaatattgagttgataaaatccaggttgagattatcattagtaaaagtttttttccatgtgacaaccaccacttctatgacagaactgaccagaaaaagtgattacagcatagaacgttgtgaatattgtgaatggttgtcacaatattcacaccttgaaaataaaacttgagcaatttaatagttaactatagagctaaaaggaataaaagttcacttcagcaaccattatgttacaagtcagtgcatctgtcatttctaatttaaatctgtattacttactgtccaacactttacacataagtgacagtgttatctattctttttcttatgggtagaaaaagtcaccagtttcattacctgtttaactgtgccaagtgttctaatacatatgttactacaagattgatgccaaaagtccctgttatttcacgccacggtctttaataacaacatctaagaaggaaagcgttttttgttttgaaggaatactgtactagtagtctgtataacctccaccatagtaggggatttttgtctggtttgttcggagctgagtgtatttctcttcatcgcctagagaacagtacctggtacataactggaaatcaataaacgtttattgaatgaatgaatgaaaatcgacttgtgttctagccttggatgttagtaactaaacatgtaacctctttatgtaatgaatacctgggatcttcatttttgctttttaaaaaatgtataatcagtagttatttgaattgacaaataattttaaataatgtacaaaattccaaagggaggaaggattctattcaaaaattgaatattaattagagacaaatagtaactgaggctttttagtgatttcatatagagtttatatacttcactttgataaattatttgatcaagacttacaagtgtagtaggattatttatattgttataatttactgaaggtacattagagctattttcttccatgaagaaaatgtgatatctcagggaacgttggaattactaaaagttatttcaaacaggtagaacgtgaacaataagacaataagatttaaaatataacggtttgggattttcgtcattacttaagatctttttccattttgtaaaactttataatcccattctccctattataaaatttgaatttaaatggtgactttatttggcaacctatattccatgtgtatattaaattcttgttaatattctattctattcattaatatattgatatactatttgtgttacacaaatggcccatgaacagggcattattttgaattttgttattgttattagtactaatgcaacttttatatgaaggaagaaaatgatgtagatatataaaggagattgctagtgtgatattctttctcctttggatcactggttgagctctaagccaggtcaggagtgacaggaaaccattattgctgttcggtgccttatgtgaaaggcgttggtggtcttagtccagttcctagtagacagctactccttaaacaatagtcaccacagtatttgccaattccagcaaaagcctgggactgaatggacacaaaggtttaactacccactctctgctgatcatcctccaaggggtcaagattgacacaccctggcacagggccatactcaaacttagcactgcctctgccaaagttgcagctattctctggcaacaagggattttttttaactggactttaattaagcagggaaccaggaatggcaattttccactcttcccaggcatgagcaactcactacacacaaaaataagcttaaagaatgagttgagactgtagcactcttcttaggttgtgctagcttctctataaagatactagcaggcataattaagttgcttctggaagcaatgacttgtgacccaaaggtggccccttccagacaaaatcatcaacttaatatcaagggaagtaatcagctctaccaggctgtctcttctgagctcttgagtgattattcattttcttctgtgggatcacagggtcatcaattggttttaaaaatgtatcctgtggtattttacatatacattaaaactgttgcccatgacttttgaataacattctgcctcattgatttttgcccctcttgcccccttcacctccctgttcatttggaagtcaggcttcctaagtagattctagatttaacaattaatatttggagattacacctgaaaatagtttcagaataaatagaaagtaaaacttatatagttaatgttaaattttttttcagccctcctcttcagaataacaaaataaagaagaagctgtctaatatttcgccattagttgtaatgatggttatagcagaaatactcagttttgtaatgcagaagacgatgctgtcaccttaatctttttctctttttgttgtcagaaaagctattatggcatcttagaatcttattgtattttcttttttgccacacaatagtggaattagctgccagtctacatggatatctatgcacacgcctacatgatgagaaatttccattgtattgtcatttgtttccacctcttctatgtttcgtcccccctggctgcaagtttaattaagctaaagccttcacagaggtcaagcatcacagatggataaataaaatctgagggttgtgttaattgatgaaaaatagtataatgaattaatgggtcattcattcaagaaatattttctgaggacttacaatgtaatgcattgttctggggatggttgttaaaaaccaacaattcaaaagacacaccctgtactctcaaagtgtaagggtaatctgatcatgccatttgtatgattataatgattctcatcatagtttggataagatctcacacccctaaaatggccaacaaattcttgagttgtcacatcctttctcctctcctgtctgatgggctacccttctctcagttcacagtgatttctttggaaagccccagcctccacagcatttgggtttcctgttacttctggcacattctataccttggttttcaattgccaactcctactcaatctcagaccctggtttccagattaattcttcaggaagatcatcattcccactccatattcttaaatctcccctcaaaataccctgcattatccttcttcatacagtatttattactagatagctctctgtgtaattgacttacttaaagtctatcttcccccattgaacttcagtctttttaaaacaattatttttgattcaagggtacatgtgcagatttgttatataggtcaacttgtgtcatgggggtttgttgtacaggttatatcatcacccaggtactaagactgttacccaatagttacttttttgtcttcatgaatattagcactattcctctcctgttcacgtcgtcctctccaatgcctagtactattttgccaaatataggaatgaagatggaaactgagattacaaattactgtggaaaaaagtactgtgtgtttagttgcaaaaaatgtaataagtgttttgagagataagagaagggagtatttttatgacttgaaggactagggaaggaagtcttattgacttttgagccaggccttgaaaggtactagctgtggtccctccaggagaaaactgatggggaaggcattctccaggaagaacaatcttggtgaacaagttgggcccaattaactgagcgctgcttccagggctgtgctgtattagtctgttttcatgctgctgataaagacacacccaagactgggaagaaaaagaggtttaattggacttagagttccacatggctaggaaggcctcagaatcatggcgggagatgaaaggcacttcttacatgttggcggcaagagaaaatgaggaagatgcaaaagcagaaactcctgataaaaccatcagatctcatgagacttattcactaccatgagaacagtatgggtgaaaccacccccatgattcaaattatctcccactgggtccccccgacaacacgtgggaattatgagagtacaattcaggatgagagttgggtggggacatagagccataccatgtcattctgcccctggcccctccaaatctcatgtcctcgcatttcaaaaccaatcatgccttcccaacagtccccaaaagtcttaactcattccataattaaccaaaaagtccatagtccaaagtctcatctgaggaaaggcaagccccttccagctaagtctgtaaaatcaaaagcaagctagttacttcctagattcaaagagggaacaggtaatgggtagatacagccattccaaatgggagaaattggccaaaacagaggggctacaggccccatgcaagtccaaaatccagcagtgcagtcaaatcttaaagctccaaaataatgtcctttgactccaggtctcacatccaggtcacactgatgcaaggggtgggttcccatggtcttgggcagctctacccctgtggctttgcagggtccaacctccctcccagctgctttcatggactggcattaagtgtctgtggctttttcaggtgaatggtgccagctgtgggtggatctaccattctgggatctggaggaaggtggccctcttctcacagatccactaggtgtttccccagtagggactctgtgttggggctctgatcccacattttgcttccacactgccttagcagaggttctccatgagtgccccgctgctgcagcaaacttcagcctgggcatccaggcatatccatacatcttctgaaatctaggtggaggttcccaaacctcagttcttcacttctgtgcacccacaggctgaacaccacatgaaagctgccaaggcttggggcttgcaccctctgaagccataggctgagctgtaccttggccccttttagtcacggctggagcagctgggacacagagaaccaagtctgtagattgcacacagcacagggaccctgagcctggcccacaaaaccgtattttcctcctaggcctccaagcctgtgatgggaggggctgctgtgaagaccttagacatgccctggaggcattttaaccattgtcctggggattaacatttggcttcttgttacttatgcaaatttctgcagctggcttgaatttctcctcagaaaatgggtttttcttttctatggcattgtcagactgcaaattttctgaacttttatgctctgcctcccttgaaaaacggaatgcctttaacagctcccaagtcacctcttgaatgctttgctgcttagaaatttcttccatcagataccctaaatcatccctctcaagttcaaaattccacacatctccagggcagaagcaaaatgccaccagagtctttgctaaaacataacaagagtcaccttttctccagttcccaacaagtttctcatcttcatctgagaccacctcagcctagattttattgtccatatcattatcagtatatttgtcaaaatcatttaacaagtctctaggaagttccaaactttcctacatttttcggtcttcttctgagccctccaaactgtttcaacctctgcctgttacccagttccaaagttgcttccacatttttgggtatcttttcagcagtgccccactctgctggtaccattttactgtgttagttcattttcatgttgctgataaagacatatctgagactgggaagaaaaagggatttaactggacttacagttccacactgctggggaggcctcagaattattgcaggaggcaaaaggcacttcttatgtggtggtggcaagagaaaatgaggaagatgcaaaagcagaaacacctgataagacaatcagatctcataagacttattcactaccatgagaacagtatgtgggaaaccacccccatgattcaaattatctcccactgggtctgtcccacaacacgtgggaattatgggagttcaattcaagatgagatttgggtgggtacacagagccaaaccatatcatgtgtgttaccttccagtagtattgtttattcacaaaattagtttgctaccaggtataacgtctaccatgtactcaggtgttactccttgttatttaaaaaaatattttgttggtaaatttttttctccaattaatgttaagttttagttggccttttctcattaacattctattttctctctctcttttttttaatgttattggagaggtacatttagtgtggaagtagcccaaggggaaagagaacaaatagaaccgtttatatactctgcagagaaatggggaatatcatgcaactctggaaaacttttgggggctgcccacgatttctcccaggaggaggttctgggcaaaattaagaaggaggcagcgtttgtctttagagagtgttaattcttctgccttatctctttctatttcttgaagcttactgaatccataaaatgtgctcttgttttattgaaggatgttactgtggctttgtgtttctgacttcagtttaattatctgttacaagaagatgataatgatctctacctcatggtacttagagacaataaaggagatgatgcagttagctcaatgtttagccccagtacttactcatttggtgcttgttgttaatccagttattattacatgatgctcatggcagagtaaacttgtcaccactttagttctcaatagccttatgttaatatggtcatgacatgggtcctagcatcccttggaacttctccatgatcaagaccttcaactttgatattctcatctcagagtaaaccctttttggccttggttttaattgttttatatttttcccctttgtgtccttctggtactgcttaagtctatgtttagatttagttgatctgttcaacattaggattaccatttctgtaacctttgctctttgctgttctatcattctttacttccttatccccaaccctgacttctatcatttattctctgccccaggctattgaatgttgctggaaaaaagtttcaataccacactctttggagctgctgcaaattatgactattaactaaccccggcaagcagatgagcagcctttttattttccttctgttgatattctgtgtgtttcactctcctcagttcctcaacctgagcataggactttattgaattggtctcactgaggtgcagagcacaaactcctgtgtcacaaaggtgcaggatatgttctttggagttaggcagtcttgggtttgtttcttggatctgccttttcctggcattgtggccttcagagagttatctgaccactttcacccacatttttctcacctcaaataagagggcttgtcttctaaatctgttatgaagactaagtgacatgaactatgtaaagtgttttggacagcgattggcaagtagagggtgacctacaatagtagctgtttttgttgccattttcacataattgtggatgaatccagctgatatttcaaactgaacgtggaattaagattctctctggtttcttttacaccaattcattcacaaaagtaatgattcccacacctttgtatctagtctgtacgtttgataaccaaaccatatttttgctaaaaggtgaaaagtgtatgcatatatacatatatgttactttttagtaaaaaatatggtttggttatcaaaaatttatgtaggaatatacatatatatatatttaataaatatttctatcaccagattgcaaaacatacacaaaaatagacactaagaaaatgagaaagataaaattaacagtattttaaaatgtcttataaatactgatgacttcattgcattattcactaatatctcaaggcacagagatttttagggcacagttcccagctactaaaatgggcattaattcagacttcaagttatcttcttgaggttttcaaacatttttttctgatttgttattatatctgattagatggccattatttttaatcttgtgatatagctgaagaagagcttgtcctaaaagtagaaatttcattttgcctttttacagttctttatttattattgtatttctagtactccctttcgttgatatttgataaaaagttaatccagtagtttgttttttaagggttactttaattacaacttgatacaaatgtgtaaatttatttatccaatgatgtaaactctaatgcatcactgcacattgaaaatgaacaattaataaaaacaaagtgctattggtggttaaccaactgcactacagaccaatctaccttcccaggaacactgtaagtgctatatgcatcaatagccttgtgatgacactgctgttacatcatatattcatattagcaaactttaattgctttctctttttgttttacataaaaaatggcaaatagaagttcaaccatttagttcccttatctaatcatcttgtggtggggtatgaacacgctgctttagagatctctgccccaaaataccaccggtttaattttcttgtgaatgaatttgataatactttccttctgctaggaacgtgtaatggcttttcgtcatctagagaataaaatccgaactctttagcctcttaatgaagggcttgcttgatttggctctagcctgccatttcaatcttatccaatgctcatcctcatttactctgtcttctgggcaaactagactgtgcgttcctcaaaaaagccttttacttttctttctgtcataagtcaggcttccaaaggaaaaaataagactttgagatgaaggtttgtctacaagaagtttcctgggatgtgccattggaaacaattcctgtaagggagtaggagaatctcaaccaactcctccctctgcccattttcatggggagctttggggctcctctgattattctgtattgagaaaaggaggccaggcctttgaatactggcaggaaccagtcattaaaatgtgagctgccctcaggaagggtgagcagcacagtatctactgaacattctttctgctgtgggatcccttctgtgaccaacagtgtttgtccagatcgtagttcttttaagcccatcttaaatttccctggattcatgaactcgtttctaatttactagctggaggtagacttgtctcttcttttgaagcctaatatcattttgtaaaattgtgttcatttgtttattcatcccattttaagtacttactatgtgagttaattacacattagttactttaagtattcatttgctgaaaggcgtcaaacagtttatatacattggacagctttattacaggcaaagaatacagtatggcaacagcagaagaaggatatgcattaaactgaatttaaaaatctcagactctggcttctttgttctcccactcctgggtcatgaagaatatccttttgtctctaggtctttaaccaccactagtgtatatgaaacattttgctacagggaactcagtatctgtcagtaatcaggttctcttacagtgaactgatcacatagatatattccaagtacatggctagccttggtcatcaagtttcaccacactctgctgaaaccagatattattaaattaccttatttgttaaattagtattactaagtccatttttatatccacttattattaccatatatagttaataagctagggtggcctgacttcaaacaacccacagacctataagtgcaaaacattatttgtctagttagtacagttgatcttcattattcctggtttctgtatttgcaaacttgtctgttcactaaaatgtatttgtaatcctaaaatcaacacttacagcacgtttaccatcattccacagacatgagcaaagcagcaaaactttgtcaccctatgagcatcttgccagctgaagtcaaacaaggcattgctctgccttcttgtttctactttatgaacacagattggagatagtagaggccgtgcagtgcagtgcaagatgcttcatctttgggatcaattggggggcattttaatcccaactctagcacctgttagtgaggtggcctcaggcacttaatgctttagaacctcagtttttctttcataaaataaaacagaatctactagttgcaagcattaaggattataacctataatctatgtgagatttgtatatctatgtatgtgggtatatctatgtacatgtgtgtacatgtgtgtacacacacacacacacacacacacacgtgtatgtctttaaaaacaaaaggtctgtgttccctaatttagtgttcatcatgactatagaacataactaccatgaataacaaggatccactctatattgtatagcattggttaagagtcaccatcaagccagggagctctaatggtaaccatgctgtccaatccagaccaactgagattcaaccatgcttgcactatataacaaattttcatatacattttatgagggacataaagatattttttaaaacacatatgcaaagtcttgccccaggtaagaaatttagcagggaggagttgagttcaacaagaaaacaaataaatgcaaacaagaaaacaaagcaaggtagaaataaaaacatatctttttttttagaaaaagatatgtaaaaggtacgtaaagttataagtcagatatttcctgctaggccctgctcccacattcatcatgtatttattgaacacatgtcacatttcatcttgcattagagtaattttttttagattacttattcctttacaatgtcataagctacttgggagtaatgagtagattgttcatgtctttcaattctccttaacattcagtgcaatagcttgcacattgtaaatatctaatgtttgttgagtgaatgaaagattggatgaatgtggccacccactgtagttatctaatgttctccctactcctttttctgagtttctcagaaacaaactagttgagggaccagcttttgatgaattaatgtaagggagaaaatgtattaccatttatgatgcacttttaattattatttatttttattttattctgttagtgggactatacatgctttaagtcaaaaagaggaataatggggaaatttatgagctagtatccccattgacttcgaagtcagacgaagctcgtcctatgtgtggattgataggctaatctgtgggtaatatctgatttggtctactgagtaagattttctggccttcttattttaatacattctgaaatatttcaaacatacaaaagaatacagggaattcaaatactaaagttttgtcaaacttgctgtagtttgctgctggccttttagggccttaccacaggttatccgtcttaggtgtcaattaaataattggcccaattaattgattagttgctagaatgagccttattctctttcctttctactcagagatgacagctatcctgttactatgtatttatgtatttgagaataatatataatattcttttacatactttaagctttaaatagtatttgctgtacctaattttctgtgacttgttttgccaaaaattttgagatttatatatgttgatattttgggtttaggtcctttattttcactaatgtatacaatttgaatttctgaatacatcataattaatttatcaatatctattgatggacatttaggttgtcatagtttggggtttttttggttactaataaataaccaaattattacacaaatcattgttttaacatgattttgtgtaatgacgtaagagaaacctatcactacattcaatagagtaaaactggtaaaatatgtataaaaatatatagcaaaataaaatattaacttccaataagaatagggtagatcattttttaatttctctgtcctatgaaactgtcagaatatttactgagacttcgtcttctgaagaaacataaaatacttttacagttcaattttaaatacactaggatcaatttcttaaaaagtgatcattgtgaattgagggactgtattatgtgcggtgatcataaggatggcctttaaatcagatagcaacgggctcctggatctgctactaattagctaagaggccctggccaaggtaaaaattaacctcttcaagtctgagttcctcatgagtaagaaggggataactgttgaatccacttcatagggttgtaaatgagacataaatgcatgaaaactgaggaatttttaatatactaaggaagcatcaataaatagggggaaaattgtcaacaaatttgagactttctgtttaggcatatatttttttaaattttagtactttaaataagccacatttttacatttgatttggatgactgctattattatagtagcaacttctgaaaattttggggggtcaatactatagttctccaaacatacaacatgtaaaatgggatatttttgtaacctcaggagctaaacatcattcaaatttgaaaatccatcatggcatgcagaattccaatcctgtgcaatttgcgttaaagtagcacatcagtgggaaacaggagcttctttatccttaacacagggatttctaagtacaaaaaaaggagtgttattttgttaataacaaaacaagtatttgatatcagttgtgcgaagaaaaacttttggaaattgctgtagagtacttgaaaattaggttgaataaaacatgatgatggacttttaagacctcaccacaggttctctgagttaggtgtcaaaacagtgcatttttaacaccaaaaggaacttgcaaagactcattcatgctgtggcccactatgatgctgcagaagagtcagcattatatacactttacagaaatgggtttgtgtagctgaatcttcgataaatgctagagttctggaacaggaattggattggtctaagcttgtcttttgtatattaatgtgctttcacagcaaaggtatgtgaattaacacagactaaagtattttcaaggaaagacatttatctccttatagccttctgtgatggattgttcagagctaaagacacactaggccagaaccaaatctcctgctgccctatatagtttttacaatctccttttaagtaacacaaagtcagggcagtctcactgccagaccaacacttctttagcaatcttcccataatatacaggatagaaccatctctaatacaaatcaacactttattttcaaagtaagcacttcaaaaggttgcttgaacaagaaaagacacattttttgagctgtgtgttatttgacagttaacatcacattgctctgtggattacgttgcactgaatgttatattttagtctgatgcagtttaagttgaactgtgtaaacagtgatagatgtttgattagtgttaatatgcaagatgctgtgattaggtatgattatttttttaatcaccacactctctttttgtaatcttcctttgatctctaacagacagtgagaaaaaaactgtaatttaaaatatattgactttgagtcataaattaatttttgcattgcaaatttattgatatctataatatatagcaagatggtaaaataacttgtctgcaaaaaaagatgtaaacttctatcccttttacaaattgtatctaatgccattttctcttttaaattcttgaatcttaatttcaaataggaaacctataagcaaaattttatgaaaacatttgagatacagcaaggaagtgaggtagtttcatctgaataatcatagctgaactcatatgaattttcttgtcctcatattatcttgctttttttgataagcatgggattgggagccacctttttgtttgttttccaatgcatacaatcattcttacagagtttgtatctgttctgctagtttactgccagtttcttaaaatattttctgctattgggttttaaaactgaaacagattaatcttctattgcttgaagtgattgaagactattaataaagtataaatttcacacctaacattcagtatttttaaataatttactgtgacatgtttctaaaactgtgtattttaataaagcctgcttccatgtaaatgtatataaagtcagcagatgcatttctcaataatcttataatcagttagtttacttgtcatctcacttcaatcgatgattttcctatggtaacatttaacttacctgatgctagtcattattaatgtatttctgtagattgtaaaacatctagttatcacactgtctatgttagcttgttccagctcatgatttattttcattttttctaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatggtgagtttattgcaggaaaaacagggagatatatttatatattttttctattctaagttctaacaatattaattcatgtgtactggtagtatgcatggcttttcctgttggcatgtagacatattttacatgcgtgcatggtgctctttttgtttatgtgtgtcagtgtatctgtacttatttttttcctgtgcttactcattttctttcctccacagcacgtatatttaggtagaaatgggtttctaatttccatttcctaccaaatgacttctgagaagatgcatcaacatttcctcattgcatgtgcaggctcaacgaattggggatctttcgcactcagtaaatgcaggagcgtattgagttagatagtggtgttgcatgttccggcggtctatgatggagcgccatgttattttctagtcttctattcatttttcagtaaaaagaatatccaaggaatgtgccagaaagcccggcaagaaaatatgtagaaaaggaggtatgtataaaagtggaaattaaaaatgggggaaaaagcttgcagaggaagaacaagatactctccctaaggatgatttgctgatgctgggaagtaaatggttaggtgatgtttggaatctgatgaaggctgtcaaggaatataaaggtgtttaaggagagctctagctgagtagattacattggcaaagctcattggttgtgccttgtgttctggtgctggtagcatcggcaagagttgaatcttggctttgagtttgtgtttagtggaatatgtacttaggctattatgatacctgcaaggaaccaaaacaatgctgtcttaggaactggtaactttgatctctgaactcttttctacagatatatatttgtgttcctcttagaatttgatcactcaatcacaaatctagttgttttgtttattctcagcattccatctgaacactctatggactttctcatcctaaggataaattttccataattattgagcaattattattattaaggtaatagtgtttttttcttagtcttttcattttcagtcacttttccagaggagaatgagattttgcagatttgatactaaatatttacagtcttaaaattactttaacatttttatatttacgttaaacaatttaaaacatagagaagtgcatgattcagaagctacaattaaatcaaccttcaaatcatcctctagccagattgagcaaatgtagacactgacagctgcaagcttgcatctgaatgtagcttgtccacactccacttttatataacattcagtaaatcactcataggagagtatgcttttctatggcagtaaatcatctaagtgttattttgaccttgttcataactttgtagaatttccaatcttcatacagaagtcatattaatattctaatgctgcacattctatctctctatgcacttctaatatcctggctggaccaagtcagatttcattatagcatccttgtggggcagggaatgtctaaactgttctgttctactgggattgcatttatatggaagacactttataaataacaaaattcataactcagttcagaattatttgcattaaattgagggtttttttgtttgctttgtctttgctgttatttcttgggtaatactggtagagtgggatttaaccttcattctttattgatgttatgaattgggttaaaagcacactatacttaagaagatggatatggaggcaataagggtgttttaaatgactaaaaaagtctctttttttctgcaaatgaaaataactgcagtaatttacatacctttaattaatgtacaatactgcagtagttattatgatgcagcttatcaagcatgtgtaattagctaagtgactttcgcctcctattacaaagatgttgattcacaaagtcataaataaagatgctattgaagaatgcatagagcataataaataaaaacatgtatgatgaagaaaaagataagagcaccaaaaggtaagctagtgagtgagaaagtgacctttcttctcatacaactttagaggataaaagatttattagaaaattctttttcattgttctttgtattgttggttccatttgctttagtaagagagttggcaaagagatgtgtaggcaatgctatttaccttcacaaactctgaactaagtaataattagaatgaggacaacatctatcaatgcccacttgagcttgtatggtttacagtttaagtcggttgtgcttattcatactattaactatgcattctaaaaatcattttggcttgggaatttaatatatccaattattattattaaatacattctgctcatttattagctctttgtacattatcctaaagtctaaataacaaaaatttttgatgtaattttattatataaatagtatttttaaaataaacaaaaactaaagtttagagtttagcttttaactagaggagtagaaatcatttttccgaacttttacctgtttttttaaattatttttctaccatgaaggggctattttggttatttcaagataccatattttgggagtcaagaaattattagtccctttatatctgtttatatatatactaatatatactgcatgtggactgtgagattttcagtagaatgccaagagtgtataaatgatggtttaggaactgtgagaatagttgctttgccaggactttatgaatgatggttcaggaactgtgagagtggctgctttgccttttatctagatgccattaaaatcctgtcttgttattatttattcttttattatgtatggatcacctgcagagacagatggactcccatccctgagccaagtactctataatctgtgcatattgtattcatgcaaaactatttcctaattgccaattacaagccacatactattcaagtcagtcctcttcccatagaacttataatcaaacaactttacaaagagcaaagtattttctgtactttgttgtgtataaaagaaaagaaatcttatccctcctccaagagatgttgttctataatttttaaatagagcatttacaatattttcctgcaattaaagaaaaaagctcatttttatcaataggctgccttcattttaaaacgggtcccagttgtactttttaatctgttttttaatatttcccatgatagttttagccatatgttaattaacctctagatctttcttcagagttttatccttacaaaatggaaaagaagaatgaattcttaaaatgagatgattttcaacacttgaacaaacaggcagataacatgatagaaactggagtttggttgtggagaacagacacctggttttatatattaggtgttttgcgtaatttatccatttaatcatcatagcaacattaggagaaaagtatattactctgtctgttttttaattttaaactttttatctctattttacaagtaagaaggtagactctgaaaagttaggtattccaaccttaccactggctgctagttagtggtagaggcaagtttggccttaattcttttttacattagatagatttccgttatgttaaattacctcctgtgatgatttccatagcagagacttatatctatccatccttcctctctctcttttttccttctttctttaacacattcaaatatgtcatgagttctttttattctatcagttgaccgtattttagacagacttaatgctcaccttaattgaattgaatcaagctaatgttagcagccaatttccaaaaatatattcagtaatcatttagtgaatactttaaacctcaattacttttgcgccaatctaataataccacatgcttcttactgtccagattaagatccccacatattcctcctggctgctatcaaggagttgctttaacttgcttaagtttccctctgtttctttaggttgctctcctgtgagagtcgctaacaaacaagaaagtggtcaaatattagacagtaaacatgagaaggagaaacaaaggacccagagaggattcacaaacacattgtctggctcatggattctctagagttgtgtagtcttgtgtttctccagcacttttactattatttgcatagctcttctaagatggatacagaactaattttcattcctgcacttgtgagacattaacttgcttttctatttaccccaatttgtattgtgcagaagattaaaatctttgtatatgactctggtacagtcatttactctttgagcattttggtcgtgattttcaaaagtgttttacgtgctctggttcatggtctttacctgagataatattgaattctttcaagagccttttccacaggtttttggtttgtctggttgtctatttaacatagggactgattttttcctaatttaatatgtataacaatgactcctagtactgtcaaggtttttaagactctaaaaggggattatattccagaatgttcttcctttttgcttatacatttctcactcatttacttattcatttgacaactatttattgagtacttactctgtgctgagtattgctctaggtacagagtaaataaaagaagacaaaaacctttcctgcttgtataaagcttacaacctagtggtagagacagtttgtaaatgatgaacacaataaaaactaaattaaaaaggtgtgagagggtgagaaattgaaacagagtatgaaagaccaagagtgctggtatggagagtgaaaatagttaaaaataaaatgaagactacctcattcgagcaaagatctgaaggagataaagtgagtatctagagaaagatatttaaggaacaattaggaatatagcagatctggaaagggggaaaagagagagagacagaataatctgacttgatatttttaaaaagtcactctggtggatgtattgagagtaggttgtaggagagcatggagaaatggggagagtaagaggaggctccaggtaagacttggtcatggtccaggctcaaaccagggtagtaaccacggaagtgatagattcttcatatattttaaagatcacattccttgatcaatttgctgtgggctgtgaaagaaaagaagaagtcaaagaagattactatgttttttatctgaatacctggaataatagatttgccatcaattaagatggaaaggaagaagggttacgggagaagcagagtacaaaaataagtttagttttggacatgtttaatttgaggtgacccttagacattcaagtcaagacatcaaaaagccagtttcttgaaccaatatcttgaattaaggtagagagaaaggtctatgtagagatataaatttggcagttactctaatatagaaggtaaagatttcaagtcatgagcttgagagagaataaaaggaagtgaatgaagataacaaaagaaacaagacaacaaggtttaatttataggaacattccaacattatgaggtctggaagaagagaaggacagcaatggaaactgagaaagaattatgtatgaggtggtaggtaaaccaagattttttttgttggcctggaagttaagtaaggaaaatgtctccaagtgggcatagtgatcaactgtgccaaattaacttttgtggggtggtgtgggttttacacactggagtgtgtctaagagagaatgggtgaagatttggagtggcttaacataaataattattttaaagagttttgctttttaaaaaggcatcagaaaaatacgagaagtgaggaaaatagaggttgcttttgttacggtaggttaagatagaagaaataaagaaatatttttatacaacagcaaacgaacaatattaaatacaggcaaaagatggtagaaattctggaacagtatccttcagtaggtgagaaaggtgggatttgcagattttgaattaaaggaaggaacgtgggtagaaaaattagtatgttgctatgcacagtacatgagtgtgagtgcatgggcagaagtatagtggggttctgctgttatctgattctttcaattgtttgatgtgtaatgttaaggaaaatgaagatagaattaacatcagtgagatcttcctatggtctagacatcatggcatattaatttatttgatatcgcaacagcctcgtgaggttctcaccgtcactttccagatgtagaaatggaggaacaaagaagttaaattatcttgcccaaagattcataatttgttgttggccaactgtttcctttgaaagagttattttagaatggaggaactaaaacacaacaacaaaaacagcacaaagcaacaataaaaatcatgtttatatgggatttaagatcacatagaaaatgaaattggtggccaatttgctagtagaaaaatcaccacacactgaaataattaaaacgcctagttcacttagagtttgaagatgaatgtaaaactatattgaaccagagatttggcttcatatttgaattagtaactgtggacagatgtggttatgtcttctaaaagctaaacagtgtaagttgggactctgaaatgaagtagatctaaagggctgtaaagttttaaaagaacaacatcagttgttccattgtttactgacagacagagacagtctcctgaagcagatgattaaaagaccattatagttgtccaattcaatttttccaaagaataaatactttttttcttatagaaactggggttgaagttgaaaacatttaagatttatgccaccagcagaaagagttatgctagaaaataaattcttggtaaaaactgctatcctttctcctaccgtatgtaatatctttccttatttattcttttcacatatatggcattcgatgagcttaataattagaatgcaatggtttttttttaagttgagttctatattactcaccattacacattttgtagataatattctggtctttaatatctctcctatgaatactcttctccttcttcctctcctggcaggacatgctaacgtagtttaggacatggcagaattcgaacgtcacaccagtatagacgtttgctagtaacaattccggagaatcattctgagtttgatcaccttaaactctggacaagttgtagaagcataatttctaatcataaatcttcacatagccttttataactggacagagtactttatgtaacacttcttgtataagttgcctaggctgctgtaacaaattatcacaaactgtgtggtttaaaacaatagggatttattctctcaaagtctggagtcaagaagtttaaaatcaaggagtgggaaggattggctctttctggaggctctacaggagtacctccctgcttttttctagtttccagaggttactaatagtccttgctgttccttggcttgtagttgcatcactccaatttctagctctgttgtcacatagctttctttcctgtgtgtctccctacatccccatgtcttcatgcggtcttcttacacaggtgctggcccctagacttagggccctttctaatccagtgtgacctcatcttcattatatttacaaaagcctatttacaaataaggtcattgtatcgctttggtgaattgctgtaacaaagtaccacaaactgggtagcgtaaacagcagaattgttgttgttttgcagttctggagactaacaagtctgatatcagcacatgggcatggttggttctttctgagggctgcgaagaagaatcagttctgggcctctctttgtgtcttatcaatggctgtcttctccctgtgtctcttcacatggccttctgcctgtgtatatgtctgtgttccaatggtcaatattttagaaggatacaagtcatattggattatggcacaacctaatgacctcaacgtaattaattatatctgtaacgatctcatttctaaataaggtcacatttgaggtactcaggttaggactttaacatatagaattttggggagacacaattcaacctataactgtcacatctgaaggttcagctggacataagttattgaaggacactaaggacattgccacttttttccaaactaatcctcagaatgatcccaaatgtttctatcattatgtctattttaaatgttgaaaaactatagcttattggggttaaataagttgcccaagttcacatgactgttaggagtactgagactcctattcaaatcaaaactcaatgtgatagctccctttaccacgatgacccttcctacagataatgaattttctgtgccctcctgagaagttcttttaatttgttttttggtatttttctatcaagataggatacgatgcattagtccatatgcttttataaatccaagtgtttgactttgtgtcaacaaaatgattcagttttttgatatatttcttgaattttaaacattttatccagatggttgcttatatgcaaacatggtttaagttaaaatgaagatcctaccaatttaaaactgtaatattattgcttttcagttctgttccatttgttactttagggaattgaacaacgttatttttaaaataatttttaagttaagacctaattctttgtttactataatcctattcatttggtatctatgaaatgataccactaaagcaatttaagcatagctcataattttcatgaaagcctgtaaaatgttgcaaaaatcagatttaagcaatgacgaaaagaaaataaaaggatctggagtcattgtaaccataattatcatttttaaaagtagaaaaatctgattaatgaacagtggtcctaattttttggtccccattgcaggaatgaaggagggagtcttcactttccttttcttcttcttcttttttttttcttgaggcaaagatctttggagtagttattccacttaaaaaaaaaaaaaaagaccatatcatctcctagtcttagaagcatataaaaacatctgccttttcatcttacaaaagtgctcacattttcttttctccaaaaggtttggggctcctcttctagagtcttctttctgagttcccctaattggaaagtgaaagaaggaagagcaggggtagagggataagtatgagcaggggcagggggataagtatgaacaggacaggttgacactaggacaagtaatgtaaccctgtcgagtagtagtaactatagctactctcagtaaaggaagagggatccctggttaaaattattaaaaatatatatgtgcttcctaatttggactcctaggcctcttgggaacaggtatgttctgtggaggatctctaaaaagaagaatgcctgcaacatcctctaactctccatccctgctaagttcccacaaaccatcttcctcagctcaccatctttctcagcgcaccatctttcctgacaatgagcaggccaggcctcagtttgcaattctgagctttcattaaagagaactgatatgttgctttggcacagtaatttacaaggaggcagatcctgaggtttctgagctcctccaagctaggcagccaagcagcctatcagtgcttctcttgacctatccccaacttcccaccaaagcaaacacccacactcccacacacacccacttggacagcttcctcatccctcacacatatgtatatggagacaccacctacaatggaaagatttctttccttttcttcacttttcttctctccttccttgatttctttcttccagagcaaagggagcttctgttgccttattaaaatgtttggaagtcattcatttaaggaataacttcatttcagtgaaaatggaaatatttataaatttgcattctgaggagaaaatatttcctaaaatggccgcttaaatgattttgtattccaactgactctgaaaggccagagatgagttgtttttttttcttctgtatttattttatgaaattctttggccacctccgcagtttagcaaagggtgttcttataggggtagaggggaagaaaacataaaactttgtataatatttactggggcctcagactatcatcaggtagaaactttgactattgcaagtggtgcttttatcaattaattgattgattgattgttattctttttggtgttgttgctttgctggtgttgtgtcctggaggccctgcctcaggtttcccagtttggctgtttcctgtctctctcagccatggcctactatggacaaagtgccccatctggcactttgggaaagagatgttctttgccctcagagggtttatttacattgcaagaaaaacctcagtaacaagaaatagggctttttttgttgatgtccgtgtcaatattactaagtaaatgtaagtttgatatgtattaaaatctccaaaaaacaaaatgaggaaatagctgcttctgtaaagaaagaaaaggtaatgatgctgatatttggcactgtgttccccataataaaacatttaattaaatctttaaactgtgtatagagcacaaaatatgcacatcagaataaaacacatcaggcataaccaaaactataattatatcagccctgttgcctgagcccaccttagttgctctgccaagaagcaatggtttaaaactttccatccatctgttttttttttttttttttaaagcctaaagtgtacctatacaaatctctttaaagctggggaatgctttggctactgatacaacagctgctggattacaggctgttgcttccagaagtaaaaatgaacagctgatgttctagggctttttctcacttttgttggaagtcttctcagtgcagagccctggggtaggtcctggagatactgagataaaaaaaggcattaaagagctgccctcaaagagttcactgtcttgtgggggaggcagatacagaaagagaaaataacaatgtagtaagcaccctgaggaaaggaggcaaggggcattgagggaacacacaggagaggtatctgtggtttgagattttgaaatagaagttaccccttacatgagcactcacggataaatactgtagtctctcaataccttcaaaggctaatgtagtctatgggaccatatttcagatattaaaatatttttgagtgctttttaaaaatatgtgtgtgttctctttttttgcatggatatcagttgtctcttcttcctaatctcactttgccaggattttagaaacactatctgctcacttctgtagtcctgaatctgatctgtcacccacacttgagacacgcaaacaaacagaaaaacttgtttgtgaaaaaaactggactcaaaatgagagttttcaccatctgtaacccatgggaacttaaatatatagactttgtttgatggtaatattttttcagttttatgttctgaataacaggccgctgaagatgtaggcttcaaataagtgaggtattactaattgggaatctatagaagccaaccctcccgacatgaggagacctttcagggctgtgtacaggcattgcttactcccgacattcaggacacctgcagacaccatccttcttccctggtgcacgctctccttccttctccatttctcgcatcctgatcgagagcctccatcatttcttgcctcaaccactgtaatagcctcttaacagttcttcctattcccattcctgcttctgcaatctcttctacacatagcagccagtgtgatctttgctttaaagtctgaaatcaaattatatcacctctttcttaattcccctcaaggattctctattgctttttaaataaatgtagaactccctactatcgcctagaacactctgtaagactctacgtagtaactcttgtctgccgtttcaatctccttctgtatatttctcccttctctctactttctagctttgttgatattctttttgttcctggaatagtcaacctccatcctacctcaggacccttgcacatgctgatccttctacttttaatgtacctctacctcttttcatgtcagactaagttttataattcaagttttggaaaaatgccaccttgtcaaaacagcctttgctgatcaacctatcaagataaccctacccttttcctccagttattctttgatatctttgtggttattttcttcattacatttgtatcttcatatgaaattattttgttcatttatgtgctgatatttactctctcactgccccagaagaacgtttctcttgctcactgctatatctatagcattcacaaggaattcaataaacattcattgaaaacataatcaaccttaagaaacaatgcaatttgttggagagagccttcatctcccaccatctgcatttatttgagtaatactacacctgcagtaattcctcaccagacatagtaaattctgttcctttctgctatgccatcactgtttgtttatggcgcagtgctccccaaatgaagtaaatttcaaagccaacatcagagtctttaactaagaaataacagtgttcagtggctcagagtctgacagatataacctggactctgtcacgggccctcgaggccaagtggctgccaacagccagagctcttggctttctgcctgtgcacgttactgccagccttattgcctctgcactgaattcatattttaatacaggatgccgacaatgcatttgtgtaataggagcactgaaaatggtttttctttagtagacacaagcttcatttttcctttcccaccttctattttaatctttttcttcttattcaaccccaatttccctcccctgacaaatatatcttctaattattttcttttttccttgttttaccatctacctctgtaaataggacttcttgctaacgttttctccaaggcatttaacttgagattatgagaggcaagaagcctgaataccagataatctaagaagaggtcgaattgtatttgtttaaggggttatatagcattaaatagcttctccaatggcctgtgtggggttctcattccttatgatttggccttccgttggttatcaccataaacatatacgtgaattcagtgggtttttgtcattgttcttcttttcttcttttttttagagacagggtctcactctatcatccaggctggaatgcagttgcaagatggtagctcactgtaatccttgagcccatgggctcaagtgatcctcctgcctcagcatcttggatagctagtactagagacacacaccaccatacctggctatttttaaattgttttgtagagatgcggtctccctaagttggccaagctgatctctaactgctgactgcaagcgatcctccttcctcgggctcccaaagtgctgggattacaggcatgagccactatgtcttttcttcttttattagatattagcaaccacagatttcccagggcaagccagaaatcactttataaaatgaaggaaacgagagagtgagactatattatatattatttatcaccataggcagagtgtttggaacatggttagtgtccccaaaacagctgataaatgaaggagcattttgagtatggtggaaaatgggccagttagatcactgagataaatagagtggccagtggcttttctagtggatggtggaggctgaatcctggagagtggtggtggagaggcatactaagaatgttattgacctataacatctcaatctaggagtgagagataaagctggcagtgagagataaagctggcagcgagatcaactggatctgtgcctcagaacacattgcagagtgatagagaagagggtgttggatttctggcagggctggcttcatgggctggtagtctgtgcagtccggctgatccctgagctcagaatggcctcacccttggttaaacaatcttttttcaccgtcttgaaattcataatactttttgaacaaagtatcctgcattttcattttgtactggatcctacgaattatttagccaatcttgtttcctggttttgctggcattttccccatggtgcacatcagtaaatgttcatgtaattatgagagatgatagaatagaaaccctctgtgcacactgaataattagattaaaactctcaactaaaacactatgaccacttgtatttttacccttacagttagttcccttcacatctaaggggagcaatgaaaaaaagacatgttgtaactttgggaaataaaagatctgttcctctattattctgttattcttgttttaacgcacttgttcattatctgatcaaacaattattgagtgtttaatgagtcctaggggctatgctggaccccgaagataaaaacaggaagacttggtacttgtcataggggacaatcaagcaaggactcacaaaaatcattattataatagctacaatttgtatagtgcctaccacaggccaagcattgttttaatggctttatatattaacttacttaatcttcacaataaacttatgaaaaagttactattagtatttccactttactaaggagaaatatgaggcacagataggttactgtgcaaggttccacagttagaaagtggcagaaccaggattcaatgccagatggtttagctccattgactgtgcccttagccactcactataacaaacattagagatgctatgggaaataagtaaaatttacatatggtagaatgctacccaaggcagggaatggacatctctatcttggatgggagctggagagaaaacacttcatcatggtaatgatacttgaaatgactgcagaacaagaggaagtggcccatccactgagcacaggatgtgcagggatgagtgggagagggcttctttaggtagagaacagcttgtgatcagagagtacagtgagagatgagcctggagctctaggtgggatccagatgtctccggagcttggagtatttctctaggtgataggatgtcattgagggatttaagtaaaggcttgacataatcagatgagcactgtagaatgttctttctgacaacagtataaatgatggaatccaaggatgataaaccacgatagggaataactagaagttcagtacaacttagtgtgtcagtgacaatgaaggccttacccaaggcaataactgtggggtagaaataaagaaataaagggtaagagatatctatttggcagcttcatagggtttgtggagtaattggttgttatggggtggcaagactgtggaaataatggaaacaaggatgactctaagatgtcttactgtccagtaccttcctccttgacctgatgtccttacttcccctaaccagccttgtctaatgtggtttcttcactggaactcaagaaggcaggatagggaagacagtgagttagaataataaaaaaataagttggaggaaagagaaagtgtcaaaattagaggagaaaaagggggaaaggcaccagaaaataaacagaagggcaggctggaatactgaacaaatttttaatcactcatatgccagataaaaggtaagttcttgaaaataaagacatctatatgaatttattttattgagtcatcttttaaaaatagaacttgggagagagataagtatgtcagaatgagacagagatagataacacagaagtggggctgggaaagaatcataactctgcagcttacccacggttggggtaagctcaaaattgagaagaaaaacatgcagagacaggaaatcataaactgtcaactggaaagaaagcaaaatcatttagttgtagtggaaattgctaaaaagaacaagcaggtgcataatctatgcagatttgtataaatgactagacaaatgaacataagttttcagaacactggtaagtcagaaaatgcatattgattgaattcaacgtgtatttccgagcatttactgtgtggcacacctcatgctaggtactgaattacaaatcaagtctgtacaaattagtgacacacagaagcatacaagtactgcacttgggtactcaaaatgtgatataaaggcagattacaaataatcaaatatgtacactacaagactagagaggtcattaaggaggaagaaatgttatagctcttcataaaaatgtaagaactcatgaagtttaggttgaatcagaaaggtatcttagaagaataatatttggaattaaccttgagtgatggatagactttcaacaggcagagatgtagggcttttgtctggtaaggggaaaggcattacagttggtaaagtcgggagacagtaagtgtgcagttgattagagcacataaaatattgaattgtgataaaatattgattgtggtaaaatatcagaaccctggagggtcaggatgaggcattttactatcaacaagtatgcattgatggtttttgggcaaggagctgtgataacaagagtggtttcagtaaagggtgggccgggaatgggaagagtagagaattaattacaggaaaggagactagatatggggtaatagcactgtagtttatatgaaaagtgactggcagtggaaataaaaagataacaaatttgagagacatttcaaagcagaaattagtagaattggaaagtgactgcatatgggggtggacagtgaacaaggaggccttggcaatgttgacaacagattggaaatgaaatggttgggaggaaggtgatgctgttaataaatcctatttccaaatctactctgaggatagattagcttgtgaaattttcagcaaaattgatcatgggaatgaatttaccattctttcctttattcttgtcaatataaaggtataaaaaagctatttatgcctttgtagtgtgttcaaataaaatattaacctcatcaattcaaagaaatgcactgaaaaatcctcctttcattttttaccaaagcagggagaaaagatgatacatcttacgcactaaaatttctctattactgtcatttctgagctgtgtatagctctagatttccaaaagagaaatgaatagggtacataatcctttctttttaaaggctacccactgccataggctgtctgagtataattttcaatgacaatccaagattgaggaatgtatacaaggccaattacagactcagcttgttttttgagcatttaactgttctcatctagtgctgtgtttatctgcatgggagtggaatggacccaaagaatttgaaagcagtgaaagccacatgtcttgctgtgagaagtacagatgggactggttaggctgtttcctgagactcatacacctagatcattaaaaccacataaacctcagagagaggctgagaatacagaatgtgggacatgaagtagaaaagtatctaaaaggaatggcaaggacatctggaaagatcagagcatgatagaatgcccaaattgctttccgatgctgacctgctggaagaagaagaaaaatagtcccggtaaaaagaggaggaaaaaaaaaaacccaaagcttattttaagattctaaaaaatgaacagaagtttccacttgtaagatgattatgctgatgccaggactgcatcggagaagtggttttatttcaccttaggtagtttaaaagggcagatattacacccatggcatttaacattgctgagaactattttttgttgcaaaaattaggaaagtaaatcaacagtttccacaatgtgattccaatagaataattatttattgtttgatatttccgaaagaacaaaattactaactgacccaattactaaacacaagttgccatacttcctgctcaataacaaatgtaggccttggggaagctgcacatagccttccagatcatttagcaaataaattcttcagaaatcgttaacagagcttctaaatgcattctataccctcaagggagtgttgagtcccagggaacttcagctgaatgaagaactaggctatgaaaccacaaagagccagcaccgtgttttttttcataatcattcgacagcaacatatagtatttagacccattctgcctctaaaatggcctctacataaacctcggtgaaggttaagtcattctcatgtattctgtccataaagccctttggcatgcaagtcaacaatactagttggatgcttatagcagtgggacccactgactgtgtcaaggagttcagtctgattggaaaagaagttaggacaggtgcatacatagtgtaaaaatggggaaatgtgattatttttgtgaaaaaaaaaaacagattgttggagagttaaaagggaggaggagtaatatctaattgtgaatgtgttttggatgaggttaaagtgaacaatcagaaaataatgagagttaagatagccttgaataatatagactttttgacaggtcactatggaaggagagaatgtgtaccaacaagagagaatagcatgggcaaagagaagcattgagatgggaaagaacaaggtttgtgaccatcacgtggctgcagttgagctggggaacaggtaataagtaccaggaaggaaagattgattgggacatattgtgaagggcgttgaatgccagtgtgaggattttaatttggtaggcaaaggggagctaccagatgtttgtgcgtaagagagtgacatgattaaaagtgttttaggaagattagtttggcagttgtctttggttagattgatgatacaagagactgggtcttgtgaaaaataggcttttgcatttgtgccatctgacaagaagttgatcaggaatttcaaaaatcttttaaatatttaaattatcttgccgtcccattgacatctatttaaaaggccccaaaagataggcaataaataactttattagccttttttcttttttcaaatacaaataggaatcctggaagaacatgtatagagttcaggagttgttctccatgaaaggggcagggccctctggctctaacaacaggtcagctgttgatagagttcttgacccaaggcttcctgttctggctctgtcattctgttgccgtgtatttgagcaagtcatttttatcgctttgggcctcagttttcacttgtgtgagatgaaggtttgggcttcatgaccttcagtgttgcaagatttctcattttcagattctttctaggaacaaagggaattgtaatagattacagggttaatatttgactgcactttctgcctacttcactgacttttcaagaattctagtaaggaggatgagtttcaagacttcacttcatgcatggatttaatgtagcatgagcttgtttcatttgttgcaacagtttaaatgccatctttaatgttttcttctcatgctactgctgctgttttccctgtttccaagaagcgaaacttttgcagatatgcctgctcccacctcctacaatgaattaaggatacattaaggagacaatttcttctttatatttaagaagatttagaatacaaatttaaataaattagctgtgatatgatattgtatatcttagttttatctgtcagggaataatttgaatcagctaactatactgtgtagtaaacaacatgaatgtgagacagctaccacatgcagtaagaatgagcagaaggtttctcaattaatttacttaattctaatagaaggtaaataatattaggaaaccaatggtagtattacccagactaatttatagctcataggttttaaataggaagatgacgatttataattgtttttttttttcctattttatccactctctctttatttatattttttttctggaggctttcagatagttcctaaaagacttgggatgatggtgagagtcttcttgaactttaacttagttgacagtgatttcatccatgtcagtctggtcagacagatgtggagaatgagtgagtgaaatattgttaactctgcccacttaccttttccctgattttaactagagagtcctcaattgtttctggatttactataatacatttaaacagtacttagctgagtttgagtcatcaaggaactggggataccactgtcagaagtcccactcttttttaattttgcagaaaaatgggcagataaagtagaatggtaaagaagtaaggaaagggactgacattttgtaatctagggaaatttttcatgatgtgtattttagacataagatgtgttttgagatgtgtgtgtaagtattttatgattgtacctaactatttcctgtcccctccccccagcacacgtaccaccactaccaccatcctggtacgtctgcttagattgcagctgaataaagaaatttaggtttgccagttgactgtactaaatttgtttaaatggtgacatgtgtacatttactcatgcttttgcacttttccaaataatttccaagggcatgtggaaaagtggagaaagtctctgtcttccccatttttctttgataagacaagaggctttcaatgtttgtaatgtttcaagttacaaatcattaactgtttattaaataacttttatgtactagttatagattaataataaattgatatattatttactgatgaaacattaagagatattaactgataaaataatgaggttaaggagtattcggttaacttggctaacctattcacctgaatctgcatagaaaatcttggaatgttaatgtaataagtctttatgtagtctatagatacaaatcaattgactttttatttaaaaccatatttccagtttgaagagctcagtataaaattgaaataaactttctgttggggtatggactttgttacactataaaagatgatagaaacagttttgaaatttagtgtgatttttcttgtaaaaataaatacagctttggtaattgagtttttattagcaactatatcataatacattcaaatgtataatgtcccttctctgtttataacctgtatattagtgctatccaatagagctttctgtggtcatagacatattctatatcttctctgaccaatacagtagcgtctagctccatgtagctatcaagcgcttgaaacatggctaatgtgactgagaaactaatttgatttaattttattaatataaattaaaatttaaatagctacctatgattaattgctaccattttgggcagtgcagctggaaatgaatattagtattaccaggagaaagagaaaaatcatcttggattttcaaatatgagtaaaatcttattctttacatttttatatttttgaatttacaagatagtggctagaaactgtcacaagaaggtacttgttcaaatagaatatgtgtggtttatttttacttttaggcattttgagaataggacaatgtaaaatttattttaactactttgaagtttttgctgaaattttgtcataaatgtttcaaaattaaagcaaaattcctttagaatagtctgttacatcaagggctattttatatatggcacttttgctaatattttttagaaatataaagtagatgagaattatgtttttgtttctggaactagtgtttactatattttttcccagtgatatagaccagtgtgggccacatacctaggctattctagaactggtccctgaaaaatgatgtcaccatttggaaatattttattagttgtttttatgactcttggtttacaaacttgtcacaccttttcttcgggagatttaaaatagattattataactggtgacttttcaaataatttcttcaagactgtattgatgattcataatctgttcctcattttggaaaaatagctgttgtaaaaactggcaaaactatcctagcaggaggaaaaggtagattttccttaaaaaaggaagtgactttcaagtcactccttgaaagtcactgactaggaaacaaaaacattttcataagactggctcataagtaaactacgtcctcaaaagtgatataatttttctttccctttgttctttactctgatctaccatgggttttttgtttgtttgttttttcggtattattgaggtataattgacaaacaaaatttgtatgcatttaaggtgtacaatgtttgtatcctttgaccatcttcccattcctcccactcctcagcccatggaaaccaccatttgactctgtgctttacaaatttgactttttaagattccacatatcaatgaggtcacacagtatttgtctttctgtgctttgcttatttaacttagtataacatactccaggttcatgtatgttgttggaaatgacggaatttccttcttttttttccattacacacacacacacatcactttctttatccatgtgtttctcaatgcacacttaggttcattactaccttggctattgtgaataatgctgtaatgaacgtgagagtgaagatctctcttcaagggagtgattttatttcccatggatatatctacccagaagtggtattgctagatcatatggtagttttatttttaattttttgaggaatctgccatagttttaagttgagcatattatatggaaacatctgaaatttgtaattttccagcatattatccctagagcccaaattctactcattacttgcatcatctctcctagttctgtgcttgtttgtagcaaatgaaagtaccttttttggcattttttttcttaaaaggacttatgctttaagttattcaagcagctgactgtatatttcattcagctgagactcttcattttaaaatgttggctgttcagaaaaaaaaaaagctattcctgaaaatctgtgtgtattatctgaattcttttgccatcttcccatgaggcttatattgattttatacctcattccagtatttgtccactgaacttctctcctttgtatttttatcttttgtgtgaatgtttggttctcttcctgtcaggtattgctctcttcttctgtcactgcatagctgggagtttaagcactgaaaatagtccgtactgactggggcctgtcccacctggataagcaagcttttcggagccctgtggttacccttaagggcttggagtcctcacctctaggatgaccttgctctgtaacatgttcttcttactggagactgttttctgttcttgtttataggtatgagaatgtcatttgatatcaactttaggttgagctcacttagctactgggtggtgggggctaaacaaccccaccttattcttcgtttactactgactttttctgcctgtaatgcatgtgaaaatgccttaggttttgccttttacagtagacattaataagcatccacatgtgcagaggtattgcactatgattcaataaaaataaagaagtcaatgtaaatatgcacataaaaagagaagttagagaatactacaaagtaaagttttacatatatattaaatcaatatgttaaacattgttagttactgtctaataaaactgggagtaattttagagatactttaggctacaccatcttttttttttaagtagaataacttacttggggtctgatgtagctttaaaattttgccctaggaagctggatgtaatattttattttatttatgttattattattattatttgaaatagagtcttgctttgttgcccaggctagagtgcggtggcgtgatctcagctcactgcaacctctgtctcctgggctcaagcgattctcctagctcagtctccctaacagctgggattagaggcgtgcaccaccatgcccagctaatttttgtatttttagtagagacagggtttcaccatgttggccaggctggtctcgaactcctgacatcaagtgatccacacacctcggcctcccaaagtgctgggattacacgctgaatataatatttttattacttatctcagtgagatcagagcactttctacattatgtagcattatacaaataaatagtattactgtaaaagtaattttaggatgcttatcatcctttccttttttttttttatttttcaatttaatcacaatggtgaagggatatacctgagttttagactatcttgttgcttctttctttggtcagtcttctagacaggaggatccaattatttctttgtgcatagatcatattcccaggctggagttgatttaatcttcattaggctggcaaacaccatctctaatttatcatttatttagtagagtgggggccttgctatgttgcccaggctggtattggaaactcgggctcaaacaatcctccattcttggcctcccaaagtgctgggattgcaggtgtgggccactgtgcccagcttccaatttcttaaaaattaaatattaagaatagcaaatgatcaatagacaattacctttattaattaacaatatttttaaattaaaaagacatattctttattcagagacttagctttaggtatgattagtaaaagaaaaattataagttatatttgaatgaagatctaggtaacaataggtcataaaatatccagtgaaaggttatttgacacttggaaatccttagacaaagggcttttagcaagttgtatatcaagtttctattagacaactcctttgaatcatgtatgcataactaatgcctttatctccagctccttgacaccttgtttaatattgctgttataaatgtatatctctccattgcttaaaaaaaagagacacgactgtgttaaaacattgaaaaaatcaatctccacttcagagtttatcagacttgtacaattttcattgaatatgcttctaaaattcaataaattccttttctaacctttatagaaacttttaaaaaagatagtgtatgccaaaaatagaggagaacttaaaaaatgctgaaggttaaagaggacaaggggttatttgagaagtattttctattttacagacaaaggaaaggagtgggaaaaatgcttgtctttagaataaactatgttcctaggttacatgtgagacgtgtctgggataatgaacaaaatcagagccagtaagtgtaattgggaaagtaagctattttagaagttattaccaagtctacacaacaaggagaaaagagcttaagtgtttgacattctttccaaggtatgaggaagaattccaagggacagaattaatatttccctctattgacatcctgaacagtgaacagtgatctatttatataatgaatgttaagttctagaatccctaactgtaatagtcacatacttatctgattttctttaatttgggaataagtctgctacatttaagaagacagaaaccaaaggacatttcaacataaagctcggtataagctaagaatttaaaaaaaaaaggaaaaagaaaagctttattaaaatatgcatggatggcagtgttctgcatttccctaaaaatcaagtggtctagtatttttttctaggtacatcttactgacctttaaaaatcagattcacttttttttcagtcatctatttttaacatcattctaatttaatagtatcatccttcaaaatttcttctcttccacagagagaaactcaatcctttgtgaggcctatttattatctcttcaatgacatctcttactaggtaccagtattctttaaaagtcccttccttaacatgttttcttaatacagaacaatattcttctgacatgccttacttacattttcttttacatgccataaacttcttgatttggtaccccaattaacagcgtatgcaaatattagagttattgaaatttggaaaaagagagactcttgggagagatgaaacttgagaggggcagtacaaaatcaaaagcatctagaggtgtggtctagtggaagctggtccagatggggagcttcaaagaaagtcccaagaagagagcgagaaggcaagttgccttctcagggcaatgaagttctgctgtgactgctccgccttctttgtgatctcttctgattggtaactgtgtgggtagtttcagatttaaatgaggaacaacaagttcactctgaaagtggttattttaaattaaatttgtggtttcactcattatcattatcaactctctatgaaatgactgctgagtaaggaatactctgctaagcaggcagagggaagattctaacaatgtggagaatacaaatttattgttttgcaaaagattgttaacactatttgtccatcctttctaagtgtagattatatatatctctttaagggttgactttccttcttttcccctttcttatttattcagagacttgacctgccttttactcccgaacagcaaaaaacaaccaaaagctttgcacttggtgtgtgtgtatctgtgtgtatgtgaatctgtgtatgttgaagggacggcaagtgtttgtatgaatttctgtgtatgtatcagaaagaaacagaggctaccaggagtaaggattttacttctctcttcgtacttcatgaagcaggtttttgccccggagttatttttaaagtataacatcatttggcaacttggtaaatatagatattcataattatctataaccatggttacgagagtaaatctagtccaacaaagtcaaatttactctagaatgatatagttatttgctcaaagttattttccaacatgcactcagaataggttaaaatagattttcatctcataaatttctggtcattatttttcatgcattatttattttactgaatgaaatttacttattaaaattaagttttgggtgaaaattattcaatcatatttagaatttcaagatgaaatttaaaatgttctttttttttgtaatgaactttaatatttttcttttttcttaagcctacaaaacatgatcctgtagcagattttttacagctgggttataaacccttggaaaattgtatttataatagaaatgctgccgtaactttaaatctagcaatactaggaggcagccttcaatcttcgtgagttgctgacaacatagaagtttgttttcagatacatctgcagtgtctatcttgagcattccagattgtagggaatgaagtgtcttcctctcttagaggaaaaaaaggaacatattcattttgctgagggcagcatcgttggaaatgggtttagtatgctgtacatatcactttgtgtttcttgaattttgttagatatttttgttgtgacatggggcttcccaaatggtggttgtgcaaacatttgttctgcttcattttcccccagagtatctgggaaaagtagctgagaaatttctaggaatcaagtgacgaagttcatcttgcttccctttcacaaattttggtgcatccaaatctgtggaagatgcctgtagtcactgggagtttattttatgtgaagcaatgcttgtgttgttggtcaacatacacatactcaaagaatgagcataaattaagtgcagcagaaaaaaatggccttggttcatttttagctctgtcatacctatgttcatgagaagttcagagaattcagtcaattcatcgttagatatttgaataccagctgggtgctcaaatatttgcatcacttgaaaatctcaaagggacaggatttcctgtagctgactggattcccaccttccaatccttcctttttgagatttagagccaaggaaagcagccagacatttatgtttccctaatattgtggattcattgtataaatagacaggattttagagaagtcctccttgagtagtgtttttttttttgttttttttttttttttttaatagttgtcttctcaaaaagggatgatatgggactgctttagtacttgctgcctgagagcagtatgagtgtaattgcttcaagcaaactatcttggtggccaaatgattgttgtttgctcttaaaatatttttctcttgtgataccatgaaatgtttgttgtgtaaaaaagattagtgggaattaaaatctgataaatgggggcctagatcatagaatgttttgtagggaactagaagtactttagcttttactttgtttgggacaaggagactttgtagagttctgagccaaggattgacacagctgacttatgttgacattttcacatcataattgagattatttcaccatctttctgaaccccataacaagtttgaaaccttctgtggtgttcaattgctcttcatgtaagatcctccatggcttggcctctgcaaacttttctagcattattcatgtccacacttggccttgatgcctggtctgcagtcatttgtcttgctttcagtgtttttaatgtacatttccctagggcagtttcacctgttgtgtgttcttagccaaatatagctgccattcctatcattgagctacaaggtaagtgtttacaactgatctttaagaaatagaagattttgtaagttcctggaaagaggaatttggtggcctagaagttcaccctatggaaagaacctcagaaatatctaattcaaacattttaccatagcattcaaaaatgaccctatgggttgacagcttcagtgacaggcaggggaagtgccatctgagaaggtaggccagccctttgggcttttctgagaaacagcttctctaagaaaataaattctggtgaagtctattgggtgaagaatattagacttctaagaccagtaaaaaaacaaaactccccgattctccttatcttctaattatcgtttagcagtacagtatttataggaaaagagaatatatcgaactggatctttttttccataaccctttctgatccccatagcttgttaaacctcttacatataatccacttatattagcttatactcacaacactgtaaggcattgttctgttgcccattttaatagaattctgagatgatgtgataaatgacaacttgcctaagtaattctctactagaataaaaacaatctactcaaggctgtatctgccaataaaggtaaccttgcctaaatccacatttttaattaaaaacattatgggattttaagtttttttaatttctaaagaaatacgtgttctttgttttgaaagaaaagcaaacaatacaatattggataaaataaataaaaaattcccactgacttcttcaaaatcactagacaatttgttaagagtacatatgataaaatgtggtttaaaaataaaaaaagaaaattatttaaaatgagtattacatcccctataaaagaaataagtaaataaaatcttctccaagatcccccaatctcatccaaaatatatggtcactatgaacaaatatgtatattactgtgcctcatgtaatatgtttttacttgcatatttcaaatacttatatgcattagtacataatttacttttttacaaaatgagatgacacaatacataccattaaacaatttcttcttttcaactagcaataaattatagacctctttccacatcagtaatgcatatcttttttgactaatttgtaatatatatgtggtaggaggaaagtgtcatgattcatttaatcattttcaccttgaaaatgtatttttaaatgcatagtattattttatttattgcatttataattgagtctatttactgttcttactaagaactatattttaggaggattgctcatccacttgaaggcaaaattggaactgagaagaagagtaaggtagtttcttccctgggtgatccacatctgagacagagagagctggaccaggataggactgaaggaggactgaggctgagagatgcagaaagcgctgtcagggaaggatcccttgagatggcaataggacctctaagtaggcgtgtaacagacaaggggagagcgcccttctccacaatgcagggattttatcattatgagacatggttaggttaactaaatttttaatctcttctaaaatataacacatgtagcacatgtaaaaaaaagttaataaaactctgctttatgttttgcaggtctgtgaacacttattttgtctaacaacattaatagttatattaataatatgaatgataacaaaatagctacagagtattttatgttcccacctgccctttgcttcttatatacacatcatctactccctacagtttcttaagagacaagtattatcatttctgctttatttttactcctgtgactcagagatattaagtaatttcagtttatagggagttattatctttggaacaataccactcctgcaaataaggacaagggagctcctgtttgctgcattaattctcattggttctcaaacaaatgcgaattactgtataatggcaatcacagttgagccgtatctctatttttgaaaaactattattcatctactctgttttgtattgaaggtctaggttcatttttctgtttgtcgaaagagaaaaacagtcacaaatatctatactgtcttaactgtatttccagaagaaacacgtaaaatttttctaaagaaaatgatttcaggaaacacgtttttggaaataaatgatcacccggccaggaactaacaaaaatctgaattctttctttgtttgggtgctttctatacttagaaatgatttacttctattatcttaattttctcattactgttattaattagaggcatattttatatcaatgaaaaccttgaagtatcattccttcttcctcaaaatgattaggaaatatgtctatggggacttaagttaattggataaaacatttctgaaaggagtgagttttatgttcagtaaaatgagactcacatttctattgaatttttttttactatggaatctattaataaatagatgtgaaagaagatagtgatcaagaacactcggcaggctccttatgtgcagttccacagcagaagagactgtagtatatttattggccttgctatcgagggtggcagtgttttatttcctgctttgaaattattttaatctgttatttggtaaattgcctatcgtttttacagttctatgaaaagtaagaaaagaacttaacgatggtatttatcaacttgttgtttagtagaatgtaattagttggcgaaagaggaaacatgccatatgtaaatgatgtctgtcattcctcctaccccaccgctgctgcatccctgcacagaactctccatttgcacactggttttttttgggtatgtccaccagagccaaaaaagaaaggaaaaaaaaaagcaatgtttttatcaacagacgttttcactgtataactaattaagcagtgaggtggttctattccttcaaggaaattataactattttacagattaggaaaccgaggtccacaagctgggcatcttcctcaaggtcatagtttgttgatgacatttctgtctctctttttttccctttgatttaatttaatttgttttgttttgttaatcagagcactccttattctactcttagcatatcgtttttttttgctcttcagactggaatattctttggtatgatataactaaaattttcccagccaagaaaattgagttcatggtttggaatttcaaaacatgattattttaaactttttgtccactcttgggactacctgggaaatagttgtatggggatttttaacttgaaacaacattaaggatagattatcttgtataaagatagattattttgtaaaatgactcatttctcttggacactaatggggtcattaacacctatactgtaaaatattgtaataatgaataaaattagaaattaaacataaagaattagaatgaaaatgttttgcagtgaaaagaggtcaagaaaagacaatggggtatctccttataagacagtgctatgcttaagctagtgtgaaaaataaatacagtctcagctgttaactttattgtgcaaagtgcaaagagaaataagataaattctgagaactttttgtctccttgtgttagtcttatagtgaataagataaattcttaaaaaaatagttactttgcctgaacagcaaacactcggtgatgtggaacattctttattcccaaacaaaaaacttggttgtatagggactcacctagcttcaaaatctgagggtcaatgaaaatcattaaagaggcctactatggaatgagtaggtaactgtatctagaaggcagtttatcataaaatatctttggaaatatgtggagtttaaaatattgagaataatttcgttgctccttgctttttcatctgtcctgctattatggtacttaaaaggaatagtggacagagtggtccattctttacatctgaataacatttaaactaaatgacccctattggtgtgaatcatatagagaataatttttaccactatttctttcatataagctttttatattctcttgttctagttactgtaaaatgctgaaaataatcttttaataaagtagtcaaatggcagcatgcttatttaaagcccacaatataatgagaatttgatttgtatgactcttaattgcttccacaggcattattttacagctaggatattgagatactatgatgttatgaggcatgtctatgtaggacagatatttgttctctgagaagcttccatgatactttacaacatagaattgagccttgggtgaaaagaccaatgggaagttgcatgggctaggtatactatcatgcagaaccatgaaaatggttccttttatgcctcagtcatcctagcgtgccataggttacataggatataaacttcaattagtattttcgtttctttgtatctgtgtttgggatttggtcttacacacccacataaaaatcaccagagacggcgtttcattcccttatctttcgacatttggaaaattgtgaaactttgatgataaaccattcactgcaattgaagatatatactaataggtgtgccagtagattttaatagagatatttacttttcctccatctcccagaaatctggaacttgagatacgatttttttttcacctatgatgaaactcctgttttacgccagttcacttttttttcagtatagttttgttttgttttttaaccaatgaataaataggggaatgcatttgttagattttttttttttatgtagccataaaggtgaaaaacttggctgtgactctgttttgatgttccaggctgaggaagtgtaattgtagctgtgaaatgaagtgggtgtaaaatgagtttgatggttcagtcaacttcaatagacagatgttgattttatcctttaatgggaaaaggttctgcaaaaatcattataaaatgaaaaaaaaaaacccaataaatttgcaggtgtgcaagccttattaaaagaggtatttaaattttaaaataaaatttaagatcatattcttgtaaatattttgtttttattttttaaataaaaacaaaggctccctttcatcacctgctgagcatgtgaggtcaggttgctcaatttctctggtatgtttatttgtcttttgtaaaatgtacgtaccacacaagaattaatgaccaatttgatgagatagtatacaagaattgtaactttaaggcccctttcacataatggattattttaatcagagatggaatctctatgaggggagttctctttattgaaatatcaattttaaaaatatggttcatagtctggttacacagtgtttttcctataagttcattgtgagatgtgtcacagtaattttggaggaaagaattcctttcatgtattaattttcatgtgctaattataggtattaattgtttctgaggtatagaatatcagcatgtagtataggaaggtagtgaataaataaaggagtagtatttatgaaaacagaaaaaaaagagttgaaacttcaagagaagtgattgttctgcctttgtattatgtctggccagttgtgtgctcaacaggaatgctgaaggactggtgagcataggggtgaggaagttgtactgttgggcatgaatctttgatataaaatgcttcacttgttagaattttatttcactatgtttgcttcctcaccctaaatgtgaatggaacaggccattaagaataaaatattcaagcaataaacaattttcctggcctgcatgttctttctggctcagttaaggctgcattctaggggaatgctgccaagcagcaatggaatgaggcagtcatttgggatgtctcagtcttggaggttcaacgagacaggtggctaatttgggtcaatcagtggactgaaggggacagaacttggtctggcagcaagcaagctgttgaggcatctctgaccgctgggagaactgggccagacctcagctgctgggtagcctttcagccttctctggtcttgtgaaaactgatagggataaggttggcatccagtcatagggaatagcactggacaggttcatggttagacatggaggactgttatggggatgtgtttattgaaaatgagatttaagtgcagaaatataattattagaccagttttaagatgatcagaacaagacttagcaattgttttggactagcaatgattctcctgaactactagactagaaatcctgagagtctcccagagaaaagccaagactgatgctggaatatggggcttaatgagttcacaactggaagcccaggatctggttaaggaaatggtttgtcctcagggaatgctgcacattttataatgttcactaagcaattgtctgtctgcctctttccttttcttgtttgtggagtcttcttccttcctttctttcttctcttttttcctccttctccttcctttcttgctctctctttcatctccttccctctctttctgtctcttttcttcttcccatttcttttcccttctttcctccttccatgtttagcttttattgaaagtctaaactgcaatattctaattcattattgaaaaaagcttttaaaatcacctatctacatgttgcttaatatgtcatctttcaaggacaacggggtgcataatataatgatgcataatgtaccaagtatgtaacatataaaggataaattgcaaattatttccaaaactatttctcagtaaaattattcagaggaacagtctgatgatcagatagactctaaagtcagtcatctgaagcctgtattttaatgagggaaattttacattttagaagaaaggtctatatttcttcaaaaatttaatttttggcattttagtattatattcttcttatagaagaataccataaacattctttatattcttcacctaagttcattaattgttagtatttttatacatatcatttatatttatctttttatctatctattgacaacgtttttgaatcattttaaactaacagatagcaggacacttcacaacaaaatacttcaatgcgtatctcttatgaataatgactttcaccgtaaggctattatcatatctaagaaaattaacatttatttaatacaataatctgataacatagagtccatatttaaatttacctaattgacccaagtagtgttttttataacttcggtgtttgaattttccatccaggagttaatcaaaattcatgaaccgtccatttactatgtcttaaattagttgccccacattctaattttttggttttttatgaccctgatgtctttttatggccaagtccaaacgttgcttacaataattcacattctgtatttgtttcattatcttgtcatagttagatcagattaaacactttggcaagaatattacttaggggttgttgcttacttttgttagaaagcaaatcatatcagggctttctattatttatgatactatatatttgaacacttggttaagacagtgcccatcatattttaccatttaaaaagtacatttttctcttcatgattaataatcaaactatggagtgatattttgaagtatttgagatattttaagatagtgtacctcttctgtttcctagtattcttgataatccttgagtgactaaatcattacactagaggatatgaagcaaatttgtaattttctaatccctttgtacttgttattctttctaaaacaccatttaattttgttatagtaaattaattcattattctttcttatactctaatatctaaagttggccccttcaagttccttcacttcagctacttttgatcccattaatatctgggtacttctttttattattattattattttttagatggaatctccttctgtcgcccaggctgcagtgaagtggcacgatctcggctcactgccaagctattctcctgcctcagcttctcaaatagctgggattacaggcgtgtgtgccaccacgcccagctaatttttgtatttttagtagagacagggtttcgccatgttggcccggctggtctcctgacctcaggtgatccacccacctaagcctcccaaagtgctggaattataggcatgagccactgtgcctggcccatatctgggtatttcttaccttgtctcaagctcactttgtactttgttgcctcaaactgaaattaaggcatttcctaagaaactctcatttctttaaatggagtataatattttgaaaacaagatgttaatactaggtttaatctttgttactggggtggcattgacctagattagaagtgggtaggctagagcctgtgaagcaaatccaatctacttcctggttttgtaaataatattttattggaacagctatgctctgttgtttacatattatgtatttctattttcacactacaatggcggagttgattatgtgcaacagagaccatatggctgcaaagtctaaaatatatactatcttaccctttacaagaaaaaaaaagtttgccagtattttatatagatgctttcagtggactgctctctctctctctctctctctctctttctccatatatatatatattttaatgtcatgattttacttctgttctggccaaaatggagtaacagagactggatctacctcttgcctaaagtaaccaaaacacaaaactaaactaaattaaataaattataggaaacaaggagttccaatacaatggatgtcagacaatgaagatgaaagagaacaaatcctgagaaacaaaaaaacaggcaaaatatgccatacaactctcccaatttattgccttgagagttttcagactacactataggaaagacaaacccagatggaatctagccgactctcaggactggggagatgcagtccagccgaccaaagtggctgtgggtggcaacgggggcattggggggtctcccttgagtattaagcaccatgattaaaacatgcatgtgaagaagccatcacagttcagggaaagaatttgccaaaaccattacattgaccaacgtatgatgtgtaaacaaaactagaactgatgcacactgctaaccagctaaactgacaaattaattcatgagacatggggtagtgtactcaggaagttcttgccttggtggaaagtaattaaccctagatctagtgctgccctgtacctacttaacacttcttaaagcaagattcaaaaggctttgcaaactgttgtaatataccttaacagaggctcagctcaaagctcaagaatgtttttagggctgcaaacatatccagcacccaataagataaatttcaaaatgtttggtatccaatcaaaggttgcaaagtatgcaaaaaaagtacttatgtatgaccctttataagtaaaatactaagtcaactgacactgtactagaactgaccaatacgttagaattagcagacaagacattaaaagtcataactgtattaaatatttttaagttaaatataaaatgtgtatatatatacacacatctgaagctaccttctaaacatgaaacctataatatgtaagatgaaaaatacattgaatgtgattagagcagattaacatcacagaagaaaagaagtgaatttgaagacacagcaatagaaactattcaggatgaaacggagaaaagaaaatttagaaaaatagagagagctttggcgacctatctgtggcacaactttaagagacctcatatgtgcataactgaattctctaaagcagagtagagagaaagggttacagaaaatatttgaagacacaattgttgagagaattctaaatgtgatgaaaactatacatctatagatcccagaagttctatgagccccaatcacaagaaacacaaaataaatgacaacatgcacatcataatgaaattgcttgaaaataatggtaataagagcatataaaaatcatctgagaaggaaaatacactaggcatacagaagaagataatagcagcagaattttaatcagaaacaatgtaagtgaaaataagggtgagcaaagtacttcaaagtacagtactttcaaaagcaaaaatcaaaaagctgtcagcagtttgtaccacatttgtacaatggaaacagatgctcattcctcattcactcgattgacatgtaagaatgttagtgtgaaagttactgagctttatttgggcatactggggaaaaaataatcctagtgacctctttatgtttgcaaccaggctaccagagttggggaaacaagactcttactcactgaaagagatagagtctggttatgctgcccaggctggttttgaactcctgggctcaagtgatcctgccacttcagcttcccaaataactgggagtgtgccatcatgtgcactggtacaggtgtgtgccaccacacttgactttctctctattttaattataaaaacatacatcagcggaaccagcaaacaggatgcccaaataaaaggcacacatggaagctgccagtccaccagctgcagatcacctgagccctggggctggtgcttacctactgagaatggcaccaaggaccagccaacaaaggttaacctgggacactcttggacagtgattctgatgtttgttctgagcagcgcgctcaacagtatgacaagagagaggggccaatgtccactgaactaccagttcttcctgctgcaagctttcccaggactgagatcccagggctaaacaaggagccagccccagtcagcaccttggcatctgcctggcctcagtggccctgtcctactggtacctgtatgacatccacggcttacttctgcgaggtgatgctcgctgtgggagtccatgatgaacttgaactggaagttccaggcaagcatgtgggccctcttcatttatgacacctccatccttgtcatgggacgcatgtacctgtgtctgcatggctgctacccactgctactgcgctgcctcatctacacgctttggctctggcctacttgtgagagttcgccccttgctgcatcctgcaccagttcaacacctgcctctggaagtactcccagttccattttgacttcatgggcctatcaccctggagtatgctgtgccctggttctgcgagtccctcatcatggaacaactccagcgcactctgcccctgcttcagtgacacccagcctgggaagcctagtggacccctggccctggccaacatccatgtcaagactgactgagagtagagagggatgagtgggtgttctggagatctcttatggaattcatggacaaagagaccaagctggtgtattgcgccttctgtgcagcacaagccctgccctggccaggcctcagccctgtagggcacacacagccccataccctccaaggtgggcaggtgttgagggggcatggtcaggtggtgggggacagggtgtcaaggcagcagaggaacatagggaaggatacatggattttggcccagctcagaggctggtggtgggaggctgtgggtaagcggtgattggactgtacagttgactttggaagcagcaggccatcctggctaagggacattgagaatggggccacaggtaggaggcaaggcctgacctccctccctctcatctggatttagttggactttggctggttccattaggcaactttcaggttcttgcttgcaaccagtaccttcacagaggtctgctgagctgtcgcttaagagatactgggcagccaggaggcttcttggcagtaatgttgatgtacaaaagctgggagactttcccttgtctcctctcccctccctcacagacatgcatagctcccttggcctttgggggcccccgtagtgctggattcccaccaacattgggcttttggaggtttcagtccccatgacagtgccctcccatctcttgcaggctttcctccactattcccactttatctcttttagcaccactattccttgtgctttgggaattcctgagttatgcttcccaactcttggtctagtgggctgtggcagtgtctcctctccacagtggcccagttgagaatgaatgatgcccttcaatgcacagtcaggccgagatgggccttgtggatccacaatggtaacctagaggaaaattagttccatggggaaaaatcagagttctcagtcacttaggctctaactggtttattttcaaactaattgagcaatctagcattccaggggatggaggaggaggtaatccagtattagagactcatggagaatgagggagaaaaaaagaggtgtccttcagccttggaaagctctttggaacaccctttgtcagaaaggatcggttctttctctgccataatcccagccctgtggcaaagcattctcatggttgccattctcctcggcccccacccagtgaggaagattctttgagcttgctccttaaacagtctgaaccctgccacactcatgggcattgttatcttggttctgccctcccccttttccttgtgacaggcccattgctggcagtggacaggtgaaatcctcactctagccgcttttggctctgccccctattccctgaggagaggggtctgtcagaaagtggtccatcccgtggtatgtggtctcttcttgaccacactcagacacttaggtagaaattagcctttcccttcttatagatcgtttttaaatgacaataataccccctccaaaaaaaaaattatcaatgtggaattctctatacccaacaaaatatattttaatagctacagtgaaattaagaccttttggaggctggaataattaatcaccagtagaaagtaggactaatcgtttcctgctactgaagcaagagcttcctaagtacactaccccatgcctcacgaattaagagttcaccactttctctggttaggaatgtgcattggttatagtcctgtgtgtgtgtcacacactgttcactttaattcttttgaataattttttcctggatgctagaagaaaagatttgaagtgtttccaacacaaaaaataataaatgcttgaggtaatatatatcccagttaatctgattgtatcattacacattgtgtgcaagtatcaaaatatctcatgtgccccataagtatgtacaattattacatatcaataaaaagatgtccactataaaccctaaatcaatgactaaaatatcaaaacaaagagttacacctaataagccaaaaaaggatacaaaatggaattataaaaatgttcaactaatccaaaggtaggcagaaaaatagataaaggggaataaacagatggaacatattgaaaacacataataaaatactgtcaaatttaaccatatcaataatcacattgaaggcaaatgttttaaacatttccatttaaaaggcagagattgtcaagattggataaaaaacaaaattaaaacatttttgctgtctaaaagaaatacattttaatataaaaacacaggttaaaagtaacagaatggaaaataaatgccaggttaacattactcaaaagaaagccagaatggctatgttaatatcagttataccaatttcagaacaaagaatattacttgaattatatgacaaagttcacttcaaaatgataaaggggttaatccatcaagaagacataacaagcctaaatgcttatgcttctaataatagagcttcaaaatacataaatcaaaacctgatcaaacttcaaggagaaacagacaaatacaaaattttaatcagaaattgaaatacccttttttctgtaattgatagaatcagtagacagaagatcaataagaatatagaagatttgagcaatactaataaccaatttgacataattgacatatatataaaacatcccacccaacaggagcaaaatactcattcttttcaagcatgcacagaacttttaccaagataagcaatattctggatcacaaaacaagttgcagtacatttaaatggatccaagtcatgcaaaatgtgttttctgatcttaatggaattgaaatggaaatcaataaaagaaagtctctggaaaattcccaaatatttgaaaaccaaataacacttggatcaaaaataaatcagaataaaaaaatggaaaatattttaaactgaatgaaaatacaatatatcataatttaggaacttcccctaagcagacataaggtaaaatttatatactaaacgcctatattagaaaagaaggaaggtcaaattaaaggcatcagcttcattttatgaaactattatagaagaataggagcaaattctgccaaagccaataacatgaaaatatgaaatacatagggatgaatatgacaaaagttgttaaaggcctgtattctgaaaatagaaaagtattgttgagataaatcaaagaagaccagaataaatggagatagaccttggtctttgaacaaaagaggcactattattaagatatcagttctctcccattaatctatggatttaatgttacaccaataaaaatataatcagccttttttcttaaaaggaaagaaattgacaatctgagtttcaaagtcatatggaagtgcaaagaacctagaatttttaaaacaacactgaaaaagaacaaagtagaattaacactacttgaattccagaaaaaaaaaatgataaactggacaccaccaaaatttaaatcaaatgacttcattaagaggatgaacagatatgctacaaattgagagaaaatattttcaaataatatatctgtaaaggatttatacccaaaatgtataacaaaatctctaaacacaataataagaaaccaaaatacaaaataaaaaccagtcaaaatatttaaacaatgcttcaccaaaggagataagagataagaaataagcacatgctgtgaaatgcaaatgacagcaaaaatgagataccactttacatgtagcaaaataagttaaaaagatgatcataccaagttagtggagggtgtgaggaattccaaactcttgtacacagatgggaatgtaaaatgatacaaccactttggaaaacaactgggtagattcttctttttcttttttctttctttcttttttttttagacaaagtctcactttattgcccaggctggagtgcaggggccctatctcagctcactgcaacctctgcctcctggattcaagccattcttgtgtctcaccttcctgagtagctgagattacaggcatgcaccaccacacccagctaatttttgtatttttagtagagatgggatttcaccacgttggtcaggctggtctcaaattcctgacctcaggtgatccacccaccttggcatcccaaagtgctgggattacaggcatgagccaccacgctcagccctactataagatccaaccatcccactcatcagtatttaaccaagaaaaaagaaagcatgtgtctattaaaaaatttgtgcatgaatgttcatagaacctttatttctattagtatgaaacccaaaacaacctaaatattcatcagcagatgaacagataaattgtgaaataagcataaaatggaatacaactcagtaataagaaggaattaactattgaatattaaaataattatgctgaatgaaagaagtcagattctctccttggcaagagtatatactggataattccattagtataaaactttagaaaatgcaaactatagtaacagaaagaatatgagtggttgctggatgggacactggggaagagagagagggattccaaagaatataagaacactgttgggagtgatagataaggatacaatcttgattgcagtaatagttacatagacatgtaactattacatgttacaagttacattttgtaactattacaagttacatgtctatgtaactattacatatacatgtcatacatatgtcaatacatatgtcaaaacatatcaaattacatattttaaatatgcgcaattttttatgtgtcaattatacctgaacaaagcagttaaaaaatgttgagtccacattgttattttaaattcaaatgaaatgccataagattctttttcaccttcacattccctcctagtgttctccttttctcaccgtgaaaactagttcctaataaagttaaaataggtacttatcgttctatctcacaacacacaggcaactataatcacacacagacctagagagaaagagagagaaagttggttttaggattgtatctatactattactaaaagaatatcataaaagtaaaaattaaaggtttcttgtagttcttttggtccatatgatataaaccattaaagtacacttaaagtgttcaataagaaaactgtgttcaaattacttgagttcttatttaaaaaatatagtttttcaaaataaaactatatgaaaatgtatactcaaatatttctcccataataatcttttcacttaccatttccatttacctcataaaaggatactatattcttaatttctttttgcaaaaaaacctaaatttatattttttatatttgcatatgtatatacgtgtatgtatgcatacttatttcttatttctcatttgttacacaaatagtggcatactgtgcaatatctttatcaactttcttacagtttgattttttttaacttaatacatcttagatgtaacacagaccatgaatatccacttcattcatcttcagctacatacttcctactcatcattattcactcaaattagcttcctatggatggcatcctatgacagttttcactattttgcctttccaaatgatggcacaatgaataaactcttgcatagatatagataaatatgaatgtagatatagatctggaatagatataggaagtttatttttaggggaaattcctagaaagggaactgtttctgttgtggaagataatacagatttcaccacaatggttattgtatagtttacacttgctccagaatctatacctgactcccgcctatgtatgtattgtcaaactttaaagtttgcaaatacaacaggttaggaatggtatcacattgtgcattaaatttgtatctttgtgataatgagtggtgtctatatggtttacttttttattcaccaaaattcttgtttcatttggaacttattgtggtgagtaatgttaggttgtgaaataagtattcagttgtctcaacataatttattacaaatatttatgttttcaacagtgaactgagatgctacctttactatacacgaagttttcatacattcttaagtagatttctggtaatctattttgttcattggagaaacctcatatgcttttaattatggtggttatagagtatgcttttatatttggcaggactgctactgcctcttgttatttttggagggattttctaactccttgcctgtttattttttttttttattatttgtataaatttaaggagtacaagtgcatttttgatacatggataaattgtgtagtgttgaagtctgggcttttaatgtaagcctcacttgaataatatacattgtatccattaagtaattattcatccctcacctgtctcccaccctcctacccctccaagtctccagtatccattattccactctgtatgttcatgtctacacgctgtttagctcccatttctaggtgggaatgggtagtgtttgacttgctgtttctgagttgtttcctcttaagataatgacctctagttctatccatgtatgatttcattctttatatggctgaatagtatcccatatatattcaatatttatgtgttatatatatgtatatataataagttgttatatatatattacttttttattcgctcatctgttgatggacagttaggttgattccatatctttgctattgtgaatagtgttgtgataaacataagagagcagatatttttgatataatgatttcttttccactgggtagatacccagtagtgggattgctggattgaatggtagttctattcttatttctttgagaagtcttcatactgttttccatagaggtcttactaatttacattccccgtagcagtgtatatgtatttctttttctctgcatcctcaccaacatttgttattttttgactttaataatagccattctgactggtataagatgatacctcattgtggttttagtttgcatatctctgatggttagtgatgttgagcatttttttttatgcttgttgaccatttgtatgtcttcttttgaaaaatgtctactcatgttctttgcccattttttttgttttgttttttgagacagagtctgtctgtcacccaggctggagtgcagtggcgtggtcttggctcactgcaacctccaactcctgggttcaagcgattctcctgcctcagcttcctgagtagttgggattacaggcacacaccaccatgcccagctaatttttgtgttttctagtagagatgggatttcaccatgttggccaggccggtttcaaactcctgacatcaagtaatctgcctgcctcagcctcccaatgtgctggcgttacaggtgtgagccaccatgcccggcccctttgcccactttttaattgggttatttggttgttattgttgagtttgagtttcttataaattttggatattagtccactgtcagatacatagtctgcaagtattttgtctgttacataggctgtctgttcactccgttgattatttcttttgctgtgcaggaacttttagtttctctgagtcccatttgtttatttttggttttgttgcttgtgcttttgagatcttagtcatgaatgccttgcctgggaaaatatccagaagaattttccttaggtttttgtctatcattttgatagtttcgggtcttacatttaagtctttattccatcttgagttgatttttgtgttgggtgtgagagaggggtccagtttcattattctacatatggcaattcccagcaccatttgaaaaggctgtcctttccctggtgtacgtttttgtcaatctgttggctatagatatgtagcttaacctctgggatctcaattctgttccgttgatctatttgtctgtttgtataccagtactatgctgttatagttactatagtcttgtagtacaatttgaggtcaggtaatgtgttgcttccagctttgtcctttttgcttagggttgctttggctattcgagctcttttttggttccgtatacattttaggatgttttctctaattctttgaaacatgacattgatattttggttagaaattgcattgaatctgtagattgctttaggcactatggtcattttaacaatattgattcttccaattcatgaatgtgggatatttttgcatttgttggtgtcctctatgatttctttcctcagacttttgtagcttcccttgtagagatctttcacctcttgtttaaatatgctgctaggtattttttaggtagctattataaatgggattaccttcttgattttgttctcggtttcattgttgttagtgtataaaaatgctactgatttttgtatatctattttgtattctgaaacttcactgaatttatttatcaaatctaagaggttcttttgcaaagtcgttagggttttatagatataacatcatatcatcagtaaacagagataatacaacttcctcttttccgatttggatgccttttatttatttctctttcctgattgctctggctaggacttccagtactgtgttgcataggactggtgtaattgtaaaatccttgtcttgttctagttttaaaaggaatgctttcaactatttttattaagtatgacattggctgtgggttagcatatttggcctatattattttgaggtgtatttcttctttgcctagtttgttaagggtcttcatcatgaaggaatgctgaattctattaaatgctttttctgaatttattgagatgatcatatgctttctgtccttaactttgtttatatgatgaattacatttattgacaaaaatgttagccccaactttttagtttaagaaaatgaaaacttcgcatttttataaacattatgttcaatttatatattgatatagttgattacaagatagctataaattatttgctatttatgtattgagacatggaatctgatttcccctccctggagtctgagctggccattatgatttgcttgtctattggagtgtagaagtgacattctgagacttagaggcttgggcagaaaaagcctcacagacactttctaggtctaggaacctcagttttaggaactgaggaagttcctttctagcaacctcttaggacccagacaccatgctgttaggaagtccaagcagctccctgtacaagccacatgaacaggagccaattatccttgtcagcaaccttggctgagtcaatagccactaccaaccggatagccacatgagtgagtcttcttagaggtggatcctctagccctaatagaatcacccagctgatgccatatggaactgagttgagtcatcctcaataagccctactcaaatttcagatttgtttgacaaaaactgaataattattaaagattactgttgttataagccagaaaaattatcttagggagaattaaaactggatggataatttttaaactttccgctttgcactaagttgtcatcaaatactctttataccttcatttttctaccctattctattaaaaataacgtttagaggattgtaatacagtctatttaaataagcattttaccttaaacaccttaataatactagtaatatcttataaaacattaatcctgaatagcataacattatacttgtttagtaaaatgaatagtttctaataattaaaataaattgttactcttatcctgtatacttcaaataagagttcaaggcagttaaaaatctacctatgcatcaggtccctattataagtaaatagaaggagaaacctataaaaagtagggattacattattacattgttttcttggttctaagtttcatccttttaaactaatatttctcaacttggatgcttcttgtgattgatatatatgtttaatgtagtgactctcctaccgtccaaaagctattgctaagtcaaataatatgttaggattgaagaattatgtatacattttgaagcattttccttttttttctaaaataaaatcagcatctatagatagatatctgagaactgcaagaggattcttcaggcaatttgattgaaatggccaatgtagttagacagatatccagtttgcataggaggaaaagaattaatggatggatgatgtatttttctctgcttagcattgcgtttttcagtcatatatgtaagcatagagccagtagtgtatacagtgtggtcacagatactgaagccagactccttggtttcagatctcagctcttccatggtagccatatgaccttgggaaatttttgcttccattatagttttctatgagtattcaataagttaatactcataaagcacaaaggaaagtaatagcatatagtttgcaccttgcagaagtttgttaaataaaattaaaatgcagggaggacctcagaaggggaaaagctaaataagtattttaacggaaagaaaaaaggaaaaaatagagcaggcaacactgtaataggatttatttaagcagctgctgtttctttacataaactcttattcacttatataaagcacctctgtagaaagtatgaaaggtgcttcagagaagttttcgagcctttagaaagttccaaagcctaaatatatatatgaacctttttgtattgcagcaagtcattctgttatgtacacattttagtacagatggctattttgagagagtgtacgtaaaactggttataacaaatgaattttctattcccaagatttgtttttctctcagtatgttatcattttgagctacatttttggaagcatatatgacaggtgtacttaccaactgtgcctgaaagaatgatgttttgaaaaaaaaaatctaccacttcaaacctctagttctctgttctttcttcacgttgaaattatttctggatgaatttgtttatttcttatttctcaggtgtatttatttatactttgtaccctacctacatctcaaatgattttaagatagcttttaaaaattcatgtataataagacagttaaaattaaaaaaaaaaaaatctgacactacatgtatatgactgtatgagagcgtgaggttctcaatggaaaagtgcatatgttaccagtggatggtgtccaggttcttggcaacttgaacaaagaattggacaaaatgcacagacaaagcaaggaaagaatgaagcaacaaaagcagagattcattgaaaatgaaagtacactccacagagtggcagtgggcccaagcataggggctcaagagccctgttaaagaattttttgggggtttaaatatcctcaagaggtttccattggttacttgatgtacaccctatgtaaatgaagaggatgaaggaaagttacaaagtcatttactcggtgtttgtcctatgtaaatggagaggatatttcctgtcatagctgaagtgtttccctttgatttagttttaggaagtccttaggtttcctgcatccagaccccattctcctgcttcacatatgcctaaaactttgtaatatcaaattttgttttgagcttgctggtaggcaagacaaaaaggagcactgattaaaagtattctaagttaattagagctcataactattttcttttccttgtcctgaattctgaaaagcatccattgggtggttcctacctacacagaaataatactctctacagagcttttgcaaaacatacagagatgtctctcatatcccacccacttttgatgaaagtcataggtgtactacgcaaatgtcacttagtgaaaatgtaagttggtgtttggttttggattattttattcatttgtttgttcatttgctgttggtgagacccagctaacgtggtccagatgtgttgccttctcctctggtgacaattagaattcttaatgaagttgttttcagaagatgacccccaccactatctgaattaaaatcacatgaataatttgttaaaatgtacattccaggtcctcagctcagtcttacccaatgagaattttggggactgggttattttttaaaagcttctcaaaggattgttatgaacaccaaagagggcaaattactttcttagacaagtagacctgtaggaaagggatcaaagggcaatctaagctacaagaaagtgaaggtttgaagactttgcatactactctgcaggattttacaactgacaagttgacagcttcttcctcatctcaaagacgaggaaatcattttgtcttacctaccagaaaggattgctgtaaagattacattagacaataaatgtaaaaatgctttgtaaaccattatataaaaaagaagacacagttttcattattatcaagaaaaacatgtagtttttaaaatctaactcttataaggaggttgttaggcatagaactttgggatctcatggtgtgtttaactcccgaatttcactcactacggtatctaaaataaaagccttaaattctgggtctcagggaatctggagatcctctgcttcctaaatagaatttcaagctccttctatctttagatttgccttccccattcttccaactccatgtgctgccaattcctggggcatttggggttctatagtgcaaattgaattggtttttgaccttctttactgctaacctaggaatcaactttcttagctaaggatttgcttcttgtctttctgcagtctagcttctaaaatagtgccattttctctgtccctcctgccccctttgttttgttattgtgagattttttcctctttcagaaattatttgcagtcattttaaggggcactgggcagtggggggaaagctaacccaagatttttgctttgaagttgttcttttaaaatgtgaatgctttctccttaaaatcattagttgcaaacttggttcacactcttgttttatgatgttttaaaatgtgatgcatatattttgccctcagctaaaaaaaataggaatcatcccacccactccaaagccccagatctggttactttattctcagtagcaggatggaagaaagaaggaagagggaaggaaggtaggaaggaagccaaaattaatggatattaattttgaagagtattggtgatgatccttgtcagcaatgtattaatacttcctagattttcttatgactctcctttttttcatataaaatctgatgaatgtgacaagtttatgcctgattgtactggtagagtaataaacttaagtttgtaagtgcatggtgactttcagcaatatccagtaaagggacttgggaaaaaaataggttttaggaaccctatcaataaaacataggtaattaaagaactaaaaatggtgtaactttcgtatggtagttagagaaatttaacaggcatggtgacagtctacattattagtagatgctgtggctatacatatttatactataagtccaaggcaccccatataaaactatgaacaatcaaagagatatcgggtctttgcagatagatgtcctaactacttctcattttccataggtctgttgctaccaggtatgtgattaggaagctgtcataacctaaattactcctttgttgagtctctgttgggtgtaattccattaattgctttacaggagagagaaatagcttgggatagacaagttttgaagagaattaagaacagcagttgtgcttcagagtagaatccaggctagtgacatacaagagcaataatccgaatttgttccattctcaggtagtcctacttctaatctttatattgaagttttatgactactgtaaaattaatttggaaatagcatagaactatccttctccttcagatgacttctgatgagtccattcttagttgtacagtcttacagaaccgggaaaaatgattcagtgaaggcatcacagccttcttgctactttgctttggttcattcaaagcttgctgcttctaaactaagacttccttgggattacccttgctagtctctcccagggtcctgtttcaagggtatgtaggcatggtgttgattccagtgctagagtactgctctacgaagaggccccaaatgatccactgggccaaaatatctttgcatgttctataatgtactttataatctattcatacagcactacatttgtatggtttatacacatgcatggaatggaggttcatcctcaaaatgtttgtaaaactatcccataaaataagaaaattattcgaagagtacagttaaccttatctgatgcttctgtgaagataagcacacaattgttttggtcttctctttaacagagaagtgtaactccagaagcttgaagccttgcattatctcattaggcaggtgagtcccctaacttctattgccactactcatttttaccaaaaaattttgtcttaccattagcattattgagagcaataaccagtgcgagtaataataaaatatccagtgaaaataaaacctaaatgtagaagaattttagagtttaggaaggtgtcaaatttagaggtatgcattctcattcttacattatactcaatggtgatgtataagctattaaaaacaaaccatattaaagaaagggcatttgttttgtaacttttttcaaatgaacaaattggtgatacctaagaccattttatttgctgtctcctctatttgctgaagtgtccaactctttgtgacagctgaaatgacaatcactgcatgacataaccatttacctagtgtgtacagggatatttcagaaatattaaccatgtgggagtcatttaaaaggcaagtaagtatgaccagagtcatttagcacttagaaacttccagagcagcagtttaaaaaatagccttgggccacagagtcttctttgccagctaacatattgggtttattatatatatatgtatattaaaaaaaccattgtgatgccttgatctctgattcacaaatttagagcactgctagcttcaaatcatggtgtgtaccttatggtttcttatttatgattctctgggcttctgtgtgcgtgtgtatgtgtgtgtgtatgtgtgtttagaagggggtggtggtttcttcactgctttcatcatttgcatgcttgtgtttggttttaacgaggaggtgtatgtttttggttctatgttttgttgaaattccttatcacaaaagtccactaccttaataaccatcttgcaggctaaatgtgactcctgaaagtcataggtgttttattctgaatttacatacttgtccttaactggcagatatgcaagtttcctccttctatactttgttgatttgtataggtctcctattctgaggacatagtgagagaaaatgtggtacatgttctagtaaaatgagtggttattcttgctattcgtagagacagcggaggcaggtgaattatgttccactgtgtcagccccaagctaaatagagctttatcttttccacacagtgaaagcatctagagggaatgcaaagtagtttccattgtgcaatgaatcactcattaaagtcaattgacatccaaggaacacttgtttcagttatcacagctattggtagggggaagctggttatcaaagaaagacagaataccacaatggaccaatcatctccttattttattttttttttcaaataaaaaacatacttagaagtcaattcattacattttctaggttcatgcattgaaattcaggttccccaacttccaaattctatgttaaaagtttctgaatatatatacattattttcacctctagaaagttattgaaactattaaattgcttggatggctgaagatcaaaagcattacagtcaattaaggggagaatgccatactaagtgatctttggaatataatactttaaatactaattcagctttacaacctgaaggtaaaaaccaaacaattacatgggacaaaaactgctttaatgtattacttcttatctaaacactgttaaaatgctcaaattctactactagtataaaatgaaaaaaatgagcaccaaaatatatcatgttctccactgtcaagtccttttgactggtgagaaaatactggttcatattttatctaagtgttcccaacccatcctcttcacattatacttggatgcaccatggtgtgctgaaaagaagtttggcttaatttcagactcaaacattacctcttcatgtagtctcaagttaatgaacttccctgggcctgagtttcctcatttataaacaaagggagtgtgagagcactcataaaatattatctgaaaagactgaaaagcaaacgtgaatgagtagtgtccagtgaagggtgtgtgccagtaatccacttgagattgttcatgcctttcattctgtgtgttagcggcagagatggagggaaatgaactaatgaaagaaatatgtagatggataggatcaaaggaattcaaagtagagtagtgagcgagctgaaaaattttgtatagtttctctaggattctaagaaagaaactcatttgatgactgatatttataatgcttcaagtttattaatggcttactgcaatgtgtctcaataaaaggtgactgatgttatccacgtttttcagatggataagttgaggtcaaagaagataaatacctttcctaacattccatggctcataggtgggagcatttggatttgactgtacatctgtctgacttcaaagtccaggttctcagcactgggtgaagaagcctcccaaattgtggtaaaggtacctagttattattacaccacatagtggtaagcgagattatagagcaggaataattccccttaggatactgagtttaccttccaccatttgaaaaaagaatttcttctttgattaggtatttggcctgtgtcttgctaaagctgtttcatcagacataagtttatgttgtgattagagaaatgtgtactattccttatcttaagctatctcttaataaagttacaattcataactataaacaatatggaatcattagtaaatagcataatctggcattttgggccacttagcgaaagtcgttagaataccatttcattgattaaaagataagtttacccatatcgttaatataaatagccatctgtttataccatgagcatggtaacaggcaaatcagagcaggaagcagggtgcatgcaatagcatttggaaccttggcgaatcagaccacagcaggactttattaattaaattgctgtaggctgattgctgaaggcattggtctgttctgttagaactcaaatgacaagagtcacgcaactgtttgtacctagtaaattccttaatcatttgactctccgtgtatggcttataattctcttccccttccactgaaggataaacaagttatctttcactttatccatggctgctgaatacctctttcagctcacaagcattgatgacaaagaacattatcttaagaagaaaagtatgagtgcccaattccattgccaaataggcccttacagagctatttatggaatcctaaagttaatacatacggcagtaataatgaactgagactaaaataatttgcttctagacatagttctgctacatttaaaaagtatgtcagccttgaccaaatcactttatcttagttttctcacctaagaaatgaggaggttgtacaatttaaggtgtctatcagtcatgaaatctcaatatctgttcatctatgtttaatttcatgaagtatattaaaaattattggaataatttgtgcagcttaaagtttattcataatttatccatttgaagtatctgtgtatttcaagatggctctgttgttttctattcttactccttttgaaataatagatgtttgattttctgtgaatctttggaaggattccagatgttttcattcgggtctttcttagccattagcatatgatttcatcaatttcctttaactcatatcagtggttctcaacttaagacattttggcattctcaaaataagacatttttggttgtcacaaattgggagatgctactggtatctctattacataaagactaggaatgctgttttaaatctcacaattcacaaggtaactccataaccccaacacaaaattttcctgcccaaaatgtcaacagtatacttttccataggtatttggagaaatcctaaactaactatgcacattaaagtacagaggaactagcctgggagtcttatttttataccaagtataaagcacactgcagggaagttgtaagtcagtttattatgcattttaaaagcatcatttgatacttaactataaataattattttccatttcaaaattcagtgggatagatggtaaatgcatggactttggagtaggtgaacttgggttcatatcctgactttatcatttaatagttatatgacttcagacaacttctttctcatttctgagtctcagtgctctcatctgaaaaagtgtttagttgtatcttcctttcattgttgtaagacttaaaatggaacattaagtgcttataaggaaaagctgtttaagacagacacataacaatgattatgttaacaatgatagctgatttgctaaaaaaattccatgaatcaaaattttctttgcacaaagttgtttaacttattaaggttttacagcagaaaaggaatactgataaatgcttctgttgaaacaaggaaaaaacaggacaaaaacaacttttcaaaaactttatttaaaaatatatatgggaaaacacattttatgctgtaaaaaagaaagttcttgcatatatagaagctagtgccaaaataataaatagcattggaaaggtattgtaaagaaccgtgctgaacaagagaagctcctaaagatattaaaaccacccacaaatgaatcagaaaaaagctgcagttgagagatgactagaaatgtattggtagctgagctgggaacagttttcaacatgctttatttctaaacattccatcttttctgcactagtatgtccagtaaggtcaatgactatagaaaatgctcaagtatagacagaggattcacagatatctgaaagtcacgcttcttgaagattatcagtttaaaatctgtgaatcactgctacttttttttttttttccattatgagcagtctttttcccaaaggaatcctgcctgatgagtaggagtacattgtttgaaagaactacagaagtacttcttaggtgtttttcccctttagcaaaatgttgggaagatggaggagtattcagcatgaggtatgctgtcattatatttattctgggcctttcagcactgtaatttatttctgtgccaaaacaatatgaattgttaaaaaatgtgcttctccaaaatatgaaacagttggactggatccctattgaattatgcacatatcttagctaaaagaatggtattttctgaataataaaaatcatacttttttgcagaaacaaaaaactcaaaatatttatcagtacattttaagggctattctcccaattggacctaaaatgaactttaaaaaaattcaaatggttctcagaaagcccacaacatttatttagaacagattgtatctaccatctcttatctttttactgagatgattcttcctagtaatgaagaatcctaaatggaattggcatctaaattttagaaatacaaaatcactttattgtgcatgaagatacttctagaataaatatagtcacatcatctgtttatgataaggaaattggtagcttgagtgagggaacaattaaaagtgttaaaaaaatgagcactggacagtgttaacaatttcctgtgctgtgattattgcgcgaagggaaaggaagtttccattcattgaacaccctctgtgggtaaagtactcttctgatgctttcatacatgttctcatggaatcctcagagccacatgcaaagtgtggaaactgtattatgccttatgtgttattatgtatcatgtcagagatgagattactgagtcgcagagaagttaagatcattcaattagtgagtagaagctctgagtttgaatccagatgtaaagtctcaagttcggtgctcttttctctaaatcacactgcttacattatttattattattttatatgtgtttgtatttaaacactccccaaaatgctctgaatttccactgctaggtgagttctttaatgtcaggggtaatgatttgaatgtttctgagctcataatatattccgtattagtgactggcatatggttggtccttataaatatttgttaaatagattccaatattgacaacatacaagaaatacatcttgcttcatttgtcaaaaaaaggtggttgatatggtctggctctgtgtccccaaccaaaatctcatcttgaattgtaattagaattataatccccatgtgttggggaagggacctcatgggaggtaattagattgtgagtgtggttcctccaagttgctctcatgacagtgagttagttctcatgagatctgttggttttataggggacttttctcccctgtgttctgcacttctccttcctgccgccatgtgaagaaggacgtagttgcttccccttccttcatgattataagtttcctgaggcctcccagccatgctgaactgtgagttaattaaacctcttccctttataaattactcagtctcgggtatgtctttattagcagcttgagaatgcactagtacagtggcagaatggcacaactgtcgagccatttagacattttgaagataaatgttatataaatacatcattatatttctgcggaaatgacaaggtttacataattgacattgaggaatctcgcatgtgtaaacagtgctaatcttctgtctactttaaatcttgttatcaaaaaaattctattgggtatgtattcagaaatagttgctaggacaacataaaaaagttaaaaagatatgtatttcaatgggaaacatttaaattttacctatgtggttttatgcatttcttaatgtgcagagaaaagaaataaactgttgttgaaagatctaaaatagtagtgaccaaattctcttggtacattgtttccctaatatgaagtttgtcataattattcatgtttttttggatttgtaattggtattaatttcggccttccattggcattataacttagtgcttccaaaatgcattttctttatatgcctgacacttttcctgaacacatgaaggacagaaaatggctattcatccttgtgtccctgcaggcatctaatgggtgaattcatactttaccatactgttgtatgtgattgaggatataaattgtgatatacttggagaaagcatcatgcctgtcatgaaagctctgaccttacatcttctcttatatgtcaattgactttgagttcctgataagtgatatcataatgttgtagtaaatatatatatatataattttgagttcctgataaaatcactatgacactatcagcttttcccacctctgaccattgatgtagataaatataagcctaagtatcctcctttagaaaatgaaatgtcctattgataggatacaatcgatgtaattctggaccaaaccattagctcagatgtattttccccaaaatgtatgtcattttatatgcaatttatacagtcagagttaaaagctacactatgaagggagttgaaaaaatgcctaatgtattggtgttaaaacaagttattgtttttgaagggaaattgtgttgttagaaattgtgttgatacagtcttgttttaatcagaggatgtcagagtttaaggatgtctccttatagaaatctgattaatggatcaaccattccctaacagggactctcttggtgatgctccttctttgaagatgatcccagttatttttggatgtgttgtacattcattgctgtcctgaaggtgaaaactctgctccagtgaaaagttttttaaaagttcatttgcatgaatactaactaaaatgtcaataaagatgagaagctttattcataatagttttttaatggcactcagcattaagacatcttaaattctaaaaacaacatagtttttaattgcattattagaactacagaaaacacagatcaacaaacagaacactcattatcctaactcacataaaaagaaaatgttaacattttattgtatattgttcaagatcagttcctttgcacatattcagagataggaacttcttggacataaaatataaaaagtaaaaaagaataaacataatcacattgtactttacatatatttcattctgctttttaacatgataatggattacaacaacccatgtatgccaataattctaaagaaatatgataattttcatggcagaatatagctttgtgtgatgtaacattatttgttggatttgttgggcatttaggttatttccattttaatttttcaaacattgccataatgaaacacacgcatatgcacacacacacacacacacacacacacacgtacagcactgtgggatgttctgattattcccttaggatacattttaacagataaaattgtgggaacagtagatatgtatacttcttttttaaaacattttttaaaaaaactaattttggacttgaagaaaaatggtgaaaataagacagagatttacccaacacaccccacccagattccctgaaggtaacatctagcataaccatgttacagtgatgaaaaccaaataattacattggtatgatactattatctaaattgcagactttaattgaatttcaccaattttattctgtaacatctttttctgtaccaggattctatatagattttcacagtttatttggttgctattttttctgaaattcccttttttttgagttcaagtctcactctgttgcccaggccggagtacagtggcttgatcttggctcactgcaacctccgcctcctgggttcaagtgattctcctgcctcagcctcccgattagctgggactacaggtgtgcaccaccacgcctggctcacttttgtatgttttttagtagagtcggggtttcaccatatcggacaggctggtctcgaactcctgacctcatgatccgcttgtcttggtttcccaaagtgctgggattacaagcgtgagccaccatgccagaccccatttttttataatagcaaaacctggaaacatatataacttcttaatttaataatgtattatgtctcattcattcatgcgtgtaattcacaaacatttatttatcttcaattgaaggcacaagggatacaatgtgatttccttaagaagcttacagtctagtaggaagaaacggacctgtgaataatatgatcatttaaatactataattggcatttgtccagattattatgagttcagaaaataggcagtgatcaaaatttccttagggagaatctaactagacttcacagaagaagagacagtcgccaagtcttaaatatgtgaaagtagttatcagtttagttgggtttttaaggcagaagaagaaaatattgccagcagaagtaatgagcagaaaaataccaggctcaactaaaagactcacaaaccaaaatgcgtgcattttagggtaatatagtggtgtagaggctggctagtgaaaaacgaagaaatgatattgaagtacaacacaagtagaagccatatctggaagggatttggaattattgctattttcatgggatagctatctgtgtatgtctttgaggaagacaaccctgtgtgaaaggcttggccattcttcagtgttgtggccatggacaattcactttctcactaagtcttagtttctttttacttttcttttcttttttttttttttttttaagacagagtctcactccgtcacccaggctggatggagtgcagtggcatgatctcagctcactgcaacctctgcctcatgggtcccagcaatgctcatgcctcagcctcctgagtagctgggattacaggcatgagccaccgtgcccagctaatttttgtatttttagtagagacggggtttcaccatgttggtcaggctggtcttgaactcctgacctcaagtgatccgcccgcctcggcctcccaaagtgctgggattacaggcgtgagccactgcaccaggccagtttctttatctttaatatgggaatactaatactttgttcaagggtattctgtgaagatgtaatagatatggcaaacccccatgcatagtccatagtggattatcataagtgtaaagctataatatgattgttatgtttgcatgcagtgtttatttttttcctgtagacactgggaagtcattgccgggttttaatcctatgagtatgttcttactttaagaaaaaacaatgtggtgacaataggtagaatgacttgaagagacagtgagacttgttaggaaggtgttacatttattgggtgtgtagagggcaatgtaatacaatcttgttttatattgtttctattagtttcccagggctattgtaacaaagtaccacaaactgggtggcttagaacaacagaaaattttgtcccttcaggccagaagtctgaagttaaggtgtttggcagggccatgctccctttgaatgcactaagaaaagatctgttcccgtctctccgctaccttctggtagatccttagtttgtggcagcaaaactctaatcctcacataacactctccctgtgtgcatgactgtctctccacttggctttctttttatatggatgtcagtcatattggattagggaccaccctatttcactaagtcctcatcttaattcaactagttacacccacagcaaccttatttccaaataggttgcattctgaagtactggggatcaagacttcaataggtgaatttgtggggacacaatttaccttacaatattgttttttctaacttcagcattaaatggtcctttttgggtgcttcctagtatttttgttataatacaagttttttaacagaactagctaccactgaccattggtgccaatcaaaaaccaaccccaccattcaaatactgggcaaatgtgggatggtgtatagaacttctgtttacctatgcatacattgttagataaagcagtttaaaactattatgtgatgtaaggttttaaaaaataaaaacacaaaatcttgtttacagcataattaaaactttgtaaggaatatgcatgtctgaaatttaatatactaaaaaaagtgttagttttactgtagtggtaatatttttatttcaaaattatctttaagctgattttttcctataaatagggagaaagcagataaactgaaagtgttgaattctagatcttaattttcatggaatttgaaaattgtcatcattatcctgagaacataggtgcctggtgccttgttgtgattattaatatcacatctcaaatgtggcatgaagaaaggatagagcattggactatgttactgcattctttccatttttattttaactattggcccattgcttgatgccaagagagttaactttaacctcacttagtcaccttttaacttatagtaaggacaaaaacagtgatgtgtcattcatttgtttacaggaggattatgaagtatcatgtcaggttttgttctagaaaaacatttttggactcaaaaatgctatgcttttgagtgtgatgagatgagaaatagaagtgtgccatttgctaattataagttattggtggttttttttcagaagttctataagtagctctgtttaaaaatttcaaaatggacaaagggcatgaagctattttgggaacaaaatgtcagtactgaaggtatactttttcatatattgaactaatgcgtggttcagaaagttctttgctaatttatcaaaatgtcatcttcaggtactgggttggaaaattagtaactgctagagtgtgtgaccattgaaaggtgcaggagcctatcaatttttagcttctagcataaaacgatgtttatcattagtgttgagatttaaaatgtcagaagttcttaaagttcttagcataaaaaataaaggctaaaagttaagcatctattatactataaatccagatatacaaaaggaaaacacagtactcaaaaagcattaaatgtactcaaataaattacctaaaaagtgcataggtaacaacttttaaccgtgtaatggcaaatgtcttaattttatccttataaaaatgattcctgttggcttttaattactctaaattgaggaatggtgtattattagtacactcttcacatatatactattcactcttaaatacttatgtggccaatcatatgttgggcaaataatactttttgcttccctggcaaaactctgagcaattagaagaagtagcataaaacctatagcgaaataatatcagaattgaatcccttgcccaggcatggtggctgaggcctgtaatccagcactttgtgaggcccaggaccatggattgcgtgagcccaggagttcgagaccagtctgggcaaaatggcgaaaccccgcctctacatgaaatataaaaaattagtctgtagtcccagctactggggaggctgaggtgggagaatcacctgagcccaggaagttgaggcaacagtgaactgtgattgcgccactgcactccagactgtctcaaacagaagaagaagaaaaaagaattgaatcattttaccttaacatggttaaccacattggaagacagaggatcttgatatgaaataacttcacaattgactatacttttacttgcaacaatacttctcctgccactttacgtttggcactttggtcaatctcccaacacttttgcatataccttactctttttctccacccattatgcaaacaagctagataggaaatcacatttgacaggtgagaaaatggaggcactgatatttcaagtatctgacccaatggcaaacacaaggtaaaacacctggtactacaatttaggctttctagagatcagtgctccaatgagaagctttgtagttaaaatgttatttttaatgcagaatgagtacttcgtgctcataagaattcaaataagaaaggaatagttggccgggcgtggtggctcacacctctaatcccagcactttgggaggccgaggtgggtggatcacgaggtcaggagatcgagaccatcctggctaatatggtgaaaccccgtctctactaaaaatacaaaaaattagccgggcgtggtggcagatgcctgtagtcccagctactcagaaggctgaggcaggagaatggtgtgatcccaggagatagagcttgcagtgagtcaagatcgcgccactgcactccagcctgggcgacagagcgagactccgtctcaaaaataattagaataaaataaaataaaataaagaaaggaatagtttacctgtagtcgtgaagctatacttctcttcaaggtttttgcagagtaacctttgggatttatgtgctatcttgcttccaaagagaatacagaaaatttttcagatgtttttgatccatacctgtgaggcagtagatggttgctatcagggtgaataaagactgggtgaaatgcttacgagatttgcataaggttattgtttacaacagagtctgttctgacacctgatgatatagaaattcctggataggtgaagattaaatcttggatgtattcttaatggctttggacaagttattggtcctctgagagcttttgtgtcttatcagtacaatggggatgctggtgacacctcttggatagagctgacaaaaacttgaatgggagagccatgtagattgcctacaagaaggctgacaccttcaaggagatagtcttcctctttcttctctcctgaccatgtaagacgcttcttcattgtttcaacttaggttacctcattcaagccttaatatcattatgtataacattttataattttattctcaagttgaagtacctataacaatgtaactctttcaactatatttttttcccacttgctgaaaaatagaggtcaatgtcactttacaacagcagaagtggttatacattactcaaaaattagggaatatttcagcagatagacctttaaggagtcactgtaggtttttgctggtttaagccttgtcaataaacaattgctctctcagagtaaagggatttagaatgatggttatatttttaataattgtgatggcatgacaaggagactggtttgtgattaaaggttgatgcttttaagtactaaatggagactttttaggaaattatattggtaaatcaaagatttacattatcagcatcaatttttttccctcatgaaaaatctgataaccatatatgatcagaatggtattttcttgatgctatgaaatgtacccctgggtaaagtagtaaaatactaaaatcatgtgagcataatttatgttaagtcattcctttagcaataagtagctactagtgctagttaatccctgatacaactcttaatatgtaacgatatggttatgtcattcacaaagaagaaaataatgcctttctatttgccatggtagactacttgtgcatttattctgaaatcagtatcagaacattagagtatacattaaaaggagaggcattaaaatatagcctattttactatttttgaaacactggtctggtttgcaaggtctagtttgcttaccatgatttttgtagtaatagaaaatgcaatttttgcaggaatgttgcgggagtatcaagcatggtgcatttagttcctaaaataatgctgtgagctcagtggtattatcccattttgtgcatgaggaaactggggcatagagaagataaatatcttgttaatgttatacaactaaacatcacaatgcaacctccatctaaccacaaagccatgtactttttttgtttttttaagtacatatgttaatggtagaaaggtgtccaggttcttggcatcttgaacaaagaattggacaaaacgcacaaacaaagcaaggaaggaatgaagggatttattgaaaatgaaagtacactccacaatgtgtgagtgggcccaagcataggggctcaaaggctccattacaaattttgggggagttaaatacccttagaggattccattggttacttggagtacgccctgtgtaaatgaagagggtgaagtaaatttacaaagtcatttacttggcctacactctatggagaggatatttcctgtcatagctgaagtgtgaatcggccgtatgttccctgcctccagaccctattttcctgcctcatatatagtcatccaataatcattcatgtctagagatccatattaaggacataaattttgtttaattttctgaagtaatgagaggtaaatgaaaaatacacaaaattgtagacttttgacagatttatgtaaaacatgaaagtaaatatatgaacaatcaatagtaaaatggccttgtctaaaattttgttattttatatgtgcattagccattgtaccaaggatatttattgtgcccttattgtgtacaaagcactatgcattcatgtcattatcccaactttacagatgaggagactgaggcttagggagtttaaatagcttgtccaaaaaaaaaatttagccaacatctgggtgacttcaaaatttgtgcccttgatcagtatgctatatcttgggctgaagtgaaagccctataggaaaaaagaattgtaatgttacgaatatgttatttaaagttacaggaacattttttaaaggaatagaaagctgtcctttccgaaattagattcctctttatacctgtataaagaaatcattactgaggaattaattacatcaatagtatattaaggattgaaggctattaattattacggtagcttttaaaattttgagtggagagacatttcttaaagctgcttattcccacaaattctaagttaaataaaacatggtgagagagcttagagagtcccagttgggatgagacataggtttataaacttggagaaaataattcagcctacactaagttttctatcccccaggattctgtaactgtagtaatagggatttgggatatatttttatcattataaaaaaattatatttttttcatgtttctgtatgataagattattttgactaactaaatttttttttactcaaattatgtcaatcagtgtggtagcattatttttcgtatgttggccggaagttttgattgacagctgtatgcttttaatttataaaacatattaattattaataaattgtgttaatctctaagagcatgaaattttggacatagcataaaggaagagagaagcagcagaaaggaaaaaaatctttgttgattgaatatttggaattgattgcactgatgtctatgtggatcttccttaatgaaatgtttttatttaacatggatgaacatcaataacatattctttttttcccactttttggtcttcagagtagttttcaaaatgccagaatcccatattcatttcattgcgcatatatctctcaattgaccagccagctcaatcttcaaaattcatcattttaatgcatctaggagcttcaggtagcagaagtaaattgaacaatttattaaaacaaacaaacaaagaaagctctgagaagtctttacgtaaaataattcatctgattatcaaaccataggtaaataaggaaaaagtgcttgctaataggaagagatagcacttcactcaaaaattttagccaattattttattcttggtagctgataatattatattaactatcagttatcgatgccaggaaaccatgtaagataattttgtggttgctagaggtgttgggggagtgagtgtgggttgggaagaaaggaggtggatgtggttatagaaatgcaaaacaaggatctttattggtgatggaactgttttgtatcttgactcttgcggtggacacatgagcctgactatgtgataaaagtgcatagaactgctctctttctctgtctctgtctctctctctttctctctctctttgtctctctctctctctctctcacacacacacacacacacacacacacacacacactagagtataagtaaaactgggaaaatcttaataggattagtggattgtattaatgttaatatgctggttatgatattttactatagctttgcaatatgttactattgtaggaaatgggtaaagtgtgcaaaggatctctctgtaatatttcttacaactacatgtgaatatacaagtaatgtcagaataaaaaagttaataataataatagtagtaataataataagatatagcaaaaggaaactagaaagaaaatgcttcattgagctttgaggcatgctgctcttccttgttttctaaacagccagagagctgaggtagtgatgcctttgacagactatagaatcttagcagtctggcaggcagatcaacgggactggaggtcaacagggccagatggaaattggaacaaacaaagccctagtagtggaaccagagctctgctatattccaaatcagttcaagtaccatatgaagaattttagccagtctgcccttttggttccctgacagtggctattcagtatccagaaattgctaatataaagaatatacatgctatgtgtttcagataatataaagtttttgtttgtttttttctctataaaggtaatatggtaaatgaataaaatatttttatgtatatacctttgatgtactttttgtataaattcataaattggaaaatacattttattcacatttaaatttattttaaatatattgtattctaatttttattgggaacatgtagttgctgcacactggaaatattaagtaaatatctatctttagtctgaaaaatgcctaaacttccactgtacatctcagcatacctcaaacaaagcaaaatttcatattttcttacaattatttgtcttcatatgtctcttctgataagacattgagtccttggactgtagaacaattctccttattttgtttgtgtctctcttcttactttgatcaccatccttttactcccggccctgatgtctagcataacaccctgcaaatgtagatgattaattaatatttgttgaattaatttaaaagtgaactgtgggaaaataggttcggtgatagagcatgtataaattcccagagcatattaaatttccagagaaggagaatagagtcagaaatgaaagacctgagacttagggaaagactatttgtgtagccatcagaaaagtgcttcaacaaggaccagggtaagctatacagataccttggcagctgtagagtgaaggttggctattatctggctagaagggtgatctgaagaccaagatttacacccaggaatacaaatcagaactcgattatatgaatcctgtctctcaccagacccaaaggtagtaccgtcttgcacctgcttggaactatgtgctagaatatctttcagacatccaggctagtacagaaaaatttataatatgttagcctttcttgcatgtaactccatcaatcaatcattcctttgtctgcttccattgcttggtttttatttactttaatttttaataaatttgtcatttaaaaccttcaagttgcctataaattattgaggagagaaatagattttaattccttaataataatctatttaaaccaaggcagtttcttcacagatgagcagaaatattgttgtgcaaagactaccatatagatttgataagtttataacctattatctatgaggcttatgcattctaaacatacatttaaaaaacattgtaaatgcagatagatatagatacatacatatttagctccatgggccaaaagaactaccataaataaactgtctataaccaactagtcactgtggctaaggactcacataatttccataacaatccttcctgaattctgtattaatgtctacattaggtaggtacagcaatcaaatcttggaaacattaaattgttgattgaaagtcttacagccaaactaaagatgggattaaactttggggctaacagcagagtcctattcattctttgacaccatgacgtagtgtcatataatttaattttcagttatctatagtttctggtgcaattttcttcagtcctgtccagttctgtgtgtggcattgtgtatgtgcagtttcctcagtttgtcccttatcttgctgtatatggaagcatttatgggatccacttttgaaacagcctctgaattgaaatacaatgtatctagtcaacctgagcgtccacaggcctttaatgtgacaagggcagtttattctcacagtctctaatatagtcatttgacaaatgtatattcagtgcttgctgtttatctggatttgttctatgtactaggaagactaagatgaatatggcatggttcctgcttttaagaaacatacagactgttaagagggctacgttagaaataattactacacagattaaggacatgccgcagtagagggaagagaaaaggccattggatgtacaaaaaagggagagtttaattttgcctagttattataaagccataggaaaactagggcaggcttcacaaaggatgtgattttggatctatgtattgaaggaatcgtaggaattaacaggtggaaagaggatggggttcattccaaacagaaagatccacatcatggaggttgcaagggtgctgcaaatggttcgttatggctatagcgactataaagtaaagaagttgaagaagcagctgaagacaagagatcctctgaggtctgattttaaaggaccttataccctaggggttagtatttttaaattaggagagtgatgtggtcagatatgaatttcaaaatgattaccctgccaacaacatggaaaatagattttaaaaactgaaaacagaatactagttaagaggccacagatctaatctaggtgagaaacattgagagcttccactaagtaagtgatatagaaattgaaaagatggacctattttatagacatttaggagaattccttgctttacaaggtgtttgaattgaagtatctgtaataattggttggttccattaagtgagagaaaaagtatggtaaatggagcagagtttagttgggaattagatgagtttggtttaggtatgttattgagtttgaggacactcaggaaatcacaaattaatactgaaccagtctgtcagtgcaaagatttttcattcatctgtattttgcagccccgatgtgaaaaaaaaaaaaagtaaaaaagtacagggagattttagaaatgatttagagttgatgaacagcaaatagattagttgactgagatttttgataaaagaaaaatgtaaatgattcactagggctagtaaaaaatgaaaaaaaaagatgaagaactgatagatggacagaaaatgcgcagttcaagaaattagaggttccaggatttcagaaaagataaaggaatgaaggagctgaaatagcgtaaagattttacaggcagcactaattctgagtcatgtggtagtctacagattcgggttatatgaatgggttgctgaagtgatttggggataaatgttctacaggggaggggataaaaaagactgagaagctagaaaattggataggttatctccatgtgttggaattgctgaataccatttcatgagttaggttggagaagtagactatacgccaagagctaattttctctatgaatgtaaaatgacctggaggtcagttgaagaaatgatgaaaggatggagtagagggtgttacagcaaaataatattggtctcaggaaggaaagactttttcaagagtgagttaattctattttgaactttgaagtaagatgccaggaacatacctggagtctgatcttagtaatccctgcatctgattttggtaattgttaaccatgataaacctactgtatgtgcttatgactagacaatggccatcaatgaatgagacgtggaaaccccctctatgtcctacagaatatggcatgttttatgataaaagttctttgaaaagttcatgccaaggaaacaattaattatgactgtgaaaagaaatcaggaaatcttctacagaagagaaaatattggaccagtacttgaaaagtgcatatgattttggctggagaaaaagaaataaatgaatggagaaatatgttctggaaaagtgaatatgttaaggctaaagagaaaagaagatgagggtagaaatattttattctgtaaaaaataaaatgaggttttgaaagtttattttgttttgtttcttagcggggtagtggtatggatagtggaaggcattttagttaaaactcatgagatgctgagctttgtgctaatttatgttaatatactgcagccttattaagtatttcacttacttatttttcttgataatgtaatttgtgcaaaggtaacagtaataatttgaagaaggaggtgccatttttaggaatgatcagaaatgtacttttaaattatctatatgcctataaatcaccactgccaagttctagaaaattctaaggtaaaagcaaagactggaagataaaaatgcaattttgaattaatttgaagtgtagccagtcatcagtttttaaaacaatattctctttgttatcaaggtgacaagtttttaaaattctgaaaaaacgaaattcagtttaaattttaattctctgggtgtcaagtagcaagatggaacaaggttatgattcttgtgtttgctcattaataccattttatgacaatgatgatatttctgcatacatttgaaatgtgttaatgacatgtagttaaaggagaggacattggttgacaagttgaacctcagtcactagggaccatggatggaaactgaagtaactttgggaggtatatacaatatttatttgtttcagttcttggtgcagaacagaacgttctgaacaaagaactaatgcaaatgtaccctttctggctccaactgaagcaatgtgatgccttgcaattggaattttgagacatggaaaactgggtcagattttctttctgcttcaggctacattttttttaaaaccctataataattaattttaaagatttcccatttgcttcatgttaaaactatgtccttcaacacgtttaacagtgaattttagctacataattttatttgaaattttttaggctatcaaatgcatgatgattggactgactgttaactttgtatagattgagtctactctcttcaaaagaaatgcagcattttctgaccagtgagataagataagcagaagttgttttatattcagagtactatttttttaatatggtaaagaaatagaaacatgaaatgttttttccaagctaaggtaacaaaatgaccttacggtcagtgtttggatgtgaaagaggaatagaagattgatgttttgatggataataattgactgttagctgttctcactcttctaaaggcaaggatgaatttgcactgatgcttccttgctgtcactctaaataatatatctctgtggctcaagctgttatcagtaattgtaagtaggtatttttgtgacagtcagtcctctggagcctacatgatgaatccatccttggcctctccaaacctccctggctgatgtgcttgaggtttgcaattgtgtactccctacccctcagggagaaatctgcacatcttcctggtactgtttttatggggaactctcagagtaagacatatttttggccctgattaagcacttgggctctagactcagactgctagtaactacttactaggtatacaattgggcaggttacttaagctctctgcaccgtgttccttcactgaccataagaatactgaacagacagtaacccccctcacagggatattatcaaattgaatgtgtagtcatatgatgccatcaatacagtgctaataaatgctcaataatttcttcttattgtacttctgttgatggtttggggaattcatttaactaccctagtcaacctccttatttctaaaacacttaaacataatatttttaaaggattctgagatttgtgaaactaacttactaagaattgacagtgtgagctttatttagtaggaaaataggctgtgaaatgtgttagaactgattcgatcatgagtatgccatttactagtgtttttctgtgggtaatttgtctttactcccttgtcttttttctcatttttaagaaaaggtgagaataatagtagtgcccacatcattgagttttgaaagaattatatgaaagagtttatgtacaacacttcatttagtgactaaattcaagaaataataactattgttattattttcaaatttttcatacaaatattgcctttatgaagttgtctttgcccatctataaagacaataggtggctgggcacggtggctcacgcctgtaatcccagcactttggaaggctgaagagggtggatcacgaggtcaagagatcgagaccatcctggctaacatggtgaaaccccatctgtactaaaaatacaaaaaattagccgggtatggtggcacatgcctgtagtcccaactactcaggaggctgaggcaggagaatcgcttgaacccaggaggtggaggttgcaatgagccgagattgcaccactgcactccagcctgggtgacagagtgagacactgtctcaaaaaaaaaaaaaaaaaaaaaaaaaggtattactacataagccatgattttccatacctaagaacttaaataattgggttaacccattatgcctgaggttggaattttgtgaatttttgcaatcagaccttggcgatgaccttgagcagtaggatataaataactcccacatgcttagtgttccaataatggaacaccaggcataaatgggtcaagtcttttaaattgttacctgaggtgtcaatgaattatatactagcaaatcatggatgttgaaacctgaggttcatatcaaatttagatatctctttagttgaagaaagccaccaaagctattgtaatgtaaggagtttactccagcatgagagactatttagagatttttattaaattgtcatgtaagttgctggttttgcaactgttaaaagttattaaaaccgtgcttttcatcataggacattctgtatacagcgtgcatttttgtggttagttttaaaaaataaatttaaatatttctttctcccatttagtattaaaatgcagctggcatgtatttataaatgatgtataagaatctattttttgctccttataaaatacagagatctaatttgatttgctttgctttcatttttatcccgttgttgtctcagtggaagaaactatcattcctacacatttcaagtcctccttccttcctcttcctcttccccccatggcataaatactgcttcatgcactgtgtgtttgaaaacactgcttttagtgagtgctggtattatctttctgggaaatagagttgaaattcccccagatcccactaagctctcctcagcctgtcactactgaggatatggaactgactacatattgggggatctccaagtgacagaacaacaactattgctgagatgtgtaaattagagaaaagactggatttgaggtagtaactcaaaatatggtttttttaccctctttctctcattccctattcccatggtaatcaaaaacatctaattacttaatttcaagttaagcatttactgtgagaaaattatttattcttactttacttcagaacccatccacataattaaaacacaagtaattcctttcacttagttgatacgatcaaataagataatgtatatgaaacagatgataaactgtgaagtgtggaagggtgggtcaggtatagtgcttcgtgctttgcatatgttttcaaatgtaaacatcatttcaacccaaacagatgcatattgtcaccattttgcagataaaaaaacagagggtgaggccaagtcacatgctgggaaatggctgttggacttgattttagcacagatccagctgattccaaagccaaagctatctttaatcacagtaaacaaatcatatatcattatatgattatgatttacatagtaaacaatttacacagtaaactgtgtaaacagttcacagtaaacaaaagtatattgttattattacttaattgtatataacaagtgtaccttattttatttagtatattgaaattcaaacatgccaaaacagaaaataatttgaagtgattattaacttttcaaaaaaaatcatttgcttttgaagacacagtaagtttttttaaatagaaccctttttttaaattctagtgtcattaaagatatgacttgatttttaaagacttcacttctatatacctttccagcagcatgtgttttaaacagactgatttgcctctacagtgcctttttactttgagctccataaatagatgaaacacatttgtcaaggataaatatgaagtttaaaagtcagaacttaagtagtgtgcatatctttatgatactatgaggctgaagtgtacctgggtaatagacgtaaaagatgtccattgctctaatttacttataggccattagctttctacatatctgggctttgaaaaactagaccaaaggaaaacatgcttgtgatgttcaaagaacccaatttttaaaatgtgttgaagtggtcccactacatctctaagctcatgtgacgtccaatttacatcatattggaaatgtcagtcactgaatcaggttattgttcactttttttgtttgtgttcaaattacatattgagaatttacatgaagtgtttcatgatgaaaatatttgaagcttgaaagttgtactttagttgaattaactgtatattcatcccaatttaatattttcctgaccttagcagttaaaattataactaagctattttaaaaattaatacataacagtggagtgttattacaaaagcctttaaaggtaaataatccttgctctacttctgataattcataaattattgtttttaatagagttcttttgcatgtagataatatattatttcgtactgatagattttaatgtgtgccaccagttgaatcctctatgcccggtatggcaccagatgattcttagcattatgttaagccctccttattagaccatttaatggcctttgtctttaataatggaaactcatttaataatgcatggtttgtgttacgttaacaataattacaggatgccgagtagttgctccagttgaaaatcaatttaaataagttgctcccaatattacaatagacacaaaatgaaacttattggtcattagtaattatgagacaaaatcattagaagccctgtggacaagaaaagaacagattcaaatcattctttatgtatggttaagacatattcccaggttttatgagctatgagggttgaggttactagtatcttatgaaaattaagagctaaacgtgttttaaatgcatcaataatttgaactgtcctaaacactgttataaaaatgctcccatgattcctacttaaacaatattgctgggtgattttcgaggccttaagttaatagttaccactgttgtacctcagcccctgcatagaacaagggctgccaggcagtcatcaaatcccaggaaaagaggttattaaagttcagttatcagagataggctggaagtcaatgatttaagatggtgagctctaagttgttagggcggaaagatagctatgtcatgtaaggactcaaatccaggaagtttggtaaatgatcccaagagtaccaagattgggtgatccagtgtgactctgaagcatgtgctggggctttttgtatgtgctgtgtcaaaaaggtaagcacaatgagagggttgaatgtgaatatggagatatcatttactattcttcaacatcagatgtcctcttacaattaaaataaaattaatacttctttcacttgattgagaagattaaaacctgaatttatgatgtgggagtacgtggactatatcaagctacaagaagggtaaagggaagagggagaagaaaaggcatggcagagtctagcaatcattaaccatgctcatttgggaaggtggctaacaactatttttaaattttaaaacattttaaaggaaatacattgagttaaaacccaaggcaagaacttgttattttggtcacagtacacaattgatttttcatagcataatctcagcaatattgagataactgtgaaagtggagacattttagcttattcttcagttgttgaattcagagttctcttaatattgtactaagatgagaaagcaaacgcaaagcgcttgactaaaaaaaaaaaaaatcaaaacagaaacaaaataaaattaccccaactgtttaataagtaaaaatttcttttacttcctctctttttttcattttcaaaagggggttttaacttcattttgattttattatacttctccttaaattagaattactgtatcaaagtttttgaattctgggactgactctaatgggaagaaaataagggaaatgatgtttcctggtgatctaatcaaactttgctctctgaggatttttaagggtggttaattttattgtcattactatgtaaatgtttcccagcttctaatcataggcatgctattgcttatccatgcttcccccagccatatagacaagatccataacctactccaacatcctgtgtataaatagacactcatggctgggtgcagtggctcacacctataatcccagcactttgggaggccgaggcaggcagatcacgaggttaggagttcaagaccagcctggccaacatggtgaaaccccatctctactaaaaatacaaaaattagcggggtgtggtggcaggcgcctgtaattccagctactcaggaggctgaggcaggagaattgcttgaacccggcaggtggagattgcagtgagccgagatcacgccattgcactccagcccaggtgacagagcaagactccgtcccaaagacaaaaaaaaaaaagatacttgtgaacctcttttgaaatctgaattgtgtgtggtatgggaacaagtatccaggaggagtggttactgtgggttggaaagtgtgtagcactgggacagtagtagtctgcatgttgggttttgctgtgcttgtaaagaaactccaaatggaatccacgatcaggttgtttaccttaaattctggacttaaccctatgtttgtagaaccgagttggattctcctgtaacagtggttctcaataaaatagactcagtaactcctttgtgtaaaatcttttataatgcacattttactaaaatgaagctaatggataatattctctacccacacatgtgatttttaaaagtaattttaaaatgatatagaccttattatgtacatgcgtgggtatggcttcactagaagatggataaaatagtcagatgcttatgcctatacatagaatcactaaatagctaaaaggcagacagatacaggtgtgctttgttggggactcaaatagtaggagcagccctgctgtcagtcacctgattttcctaaatggtaacttactcttgatacaattgtgaaaaataaaataaaaatgtctctggacttataaaacagttgtattttgggagaatttatatttatactaaaaagtgagaaaaataaaatgtttaaatattgatatgtgaaaaggagttgtcgatgtcatcagctcagataactatacatatttatttcacttatatatgtatgtccagcaaggtctttgaaagttgtgtcagatgtaggataattcttcactctacaggaatgtttcttgaatgcagaacagctagcaagtatttccagacaatcaatgaaagagcctcccaaattaaaaagtgaacaaaagacattctaaggaacacagccactgtaggcaagaactgttgctctgtactagaataccacgttttaaaatctcagttaatttcaggaaatactagttctctaagaaaggtctaaaattaaacagaatggtcagaaggtaataataaggcatactagtgtttcaaatgcctgatataatggacattctgcagttcatacacaaaattgtatgtattcagttgagttgtagacctagactatgtctgatgatgagatactgctggtcatgtgccttttcaaaggcattttttcaaatatttaatgctactgcatgttcttcctacttgtgagtcgtatgacatggtgtatgtgaacatgctttgtaaaccgttaagccaattgtgagtgttatcaattctattatggagattttcttaaatagtgacacaaggatttgctaatggctcctgaggatgcaatggaatcctcttatttcatttgctgtcctaagggaagtaagtttcagtaagcttacacaaagttaatgagtcattaggctttgagttttggcctcctaaaacaatgctgtttttcttaggactttgtattcctctgagtgctgtgtgcttgggcagtggagagcgactaaaaaggtcattcacattttctttttaatcatagcaatacactggaatcaaataatatagccattgagagagccctgttactgtctcagtcattaaaataaagctgtttatcaaacactaaacacatggcagacactacgttattaaagataccacaggcaagtcacgtggtctcttacttcaactggatgtataagaaaactaatcttgctttctcctattggataaaaattaactgagcatcccaatatgttttcaagcttaggtataatatgataaaatagttcttgtagtcagcattcaaaattagtcttcaaaatgtcatggacaaaattgctaatttctaaaaaaatacctcctccaattttcttttctttcattaaaatggtgccaaggagtattggggaagggagttacatatgagactgtcaaaaagttgggtttttctgttttggcatcctgttgtcacatttagtgtctgcatttagtcaccttccatttgggtgtactaataatttatggctaacatctgccgctaatgtcatttatgtcctactctggtagacccagatctgctcttactggctgccttggtcccatttggctccataaaagtcagaccttcctttatgtcctgagtcacctccagcctctaaagtattcctctagattatgctggtggactgtactactgccctgcttgttctcaactcaatatcctggacatgtgggactgtgcttgcagcatggcgaaatcaaacccaacatcaccccctctgactacttttgcttctaagggtatgagattgctcttgtcacaagactgtgtgaggtatcttgtaaggaggcttcccctgggaagttacagagacttgggtaatggaggaggcagccccaatctgcttgtagagttcctctgacttccctaatgcccctccctatctgctggacaaatctgaacacacccctgctgaaatggctcttcaacttttctttccacctcccaaaattctctgagatcagaaagagaaaatggcatttgaccccacagtcttttcctgtaggcactattaaatctgacctttgttaccctaaagaaggagccaaaggaattttgacaagattcctcaagataatggcctggtttgcaaggctcccatgcgctgcaaaatcatattttgtgtattacaagctgaattttatcttgaattatttttcattctatctgtaacgaatccagatcctcccactctaccttgccccattcaattaggtaccttggatgaactacaataaaaatcctgttctcaaaaatgcaaagaaggaaagcacttcagtaattttcaaaataaactagaaataggggatgcaatagtggagaggatagacatgatcccttacttctatggagcccatgttctattcatgaggaatgggggtcagataaataaaaaaataagtgggggattagtgttatgaaaaaagtaaacataacattaaggtaacgaatatagggaagtttgaagagattgagtgattctagtcttttgtttatatttgaagaaactgagacttagaattttccgaatattaatcatttacttactgacagtcaaaagtggtagcaggactccagaatccttactgagtgagcccattttataggcgacacttaaaaaagaaaatgaactaatggtcttggcgtggattcaggttagaacggcttgtattaaatattgtgctaaaacattttttaaaagtctctactcaagtgaagaggactgctgaccacaacatcatgacttacatattctatacctttaaactttttgtttctcattcctaggatgccatttactctcacttctaggcattataatttttattcctgcctagacacctccttatttatgattccaactataatgaccacatctagaaataagctgtcagctcttgctattaccttctgtggcatttttcacatactgcctgaattactgtttggtttctcactaagttgaaatctttttgtggggcaaataatatatactataaatatgtatagtgctttgctcacagttatcagtaaatatttggtgaacaaatacatgaattatgtaatgaaagtccatgatgtcagattccgtagaagctcttagtgtatgaatgattcatggaccttggtaatctgtaatcaagttaatgaagaacatagtttctgcttccgtttacagcagcactgactgcatataagaataaatgcacaacgaggcatagattttttaaaaagataaaaagtgcaagatacatagatatgtgactaattatagtttgtatggagagatcagagccaagtgtggttagggaaagaagccaaaggcagaaagacttgagtttaaaccgtttttggagtacaggatgaacaggttgtggtgccttacggaaagtgccttaggagaagctgtaaaaattgcagaagttgtagaagggtgaacacagttctaggtagaatatattaagttgatatacctgacgaaatattaactggggattccgggagatggaggagtggaagctttgaagcttgtgattaggagtctgaattatattcaaggaatgattggtagtcattgttggcttctaagagggggaacttgaaataacatttagggaatactcctactcctgtcctttgctcatgctgttttcccatctggaagatttccttttctccaaacccctctttagcccatttcttcaaggcttaattcatatccctctgtctctgaagcttttccaatgattcaagccaatgcgttctctctctctttctgtctctctgtttctccatcctctgcatttattgcttttactacaaaattaatatccttctgaattctctcttcttaatttataataggctctttaaaagattttctaaaatacagttttgttcagtagctgcagattcttatttacatcataaggaaaataaaatctttgaagccagcgactttatattatgtttttgtgtactccatttagcattcatctaggttcatgtgtgtttaatacgtgtcttaaagtgggataacttataacccaaatatcaactcagagataacgtttaagagttaggagagaccttagaggtcctgcctagagcttgtgttgagatcatatatgaagtcagtaccaagggcttgcatcacgtttttttctgtcagtggtgttatctagttggattctatatgatactgactgtacttgcttctaaatgttactgaacagcttccaaaaccaaagaaaatgaaacaacggcaacaaatattttctttaagtgaaatgtttttactactaaagatttttggaaaaaaaatattggcttatgggtggtgactgagaatacacattaaattcccatctgtggaaggactttagtcatttgaaagctaaaaattgactgcacaatgcatctctttataaaagaatacaaaattaattttattgcactaaggtacacgtggtatcttgaatgttgtggatttaataggtcagaaaataatagaagatttatttttcacgtagcagttaccaggaaataaaattcaatatactaattaaatcaaaatatagcatcattataattctcttttcatttacttgttagacataaggcattctcaactggaaatcaatattttgttaagcccactagtgtttaaaaaggaaattgctctgttattaattattctgctggtagatgttatgacatcgcttacttatgtagtcaccgtctcctcagatataaaagcagtaaactttaaaccttgtttggcagttatcacttttctgtgtgaagaagtttttattcaattaaaaagtcagtgatctattcacatttgtggcatgaggattaactgataagtgtctctatagccctaaatgttatgtgaccgcgatataataaagcaaataatcagttatgtctttgaacatagaaaatactatataaatgcaaaatatgactttttcaactacatttttctaaagtacagaggtaagattggacttatctaatacctgcagtgggtgatgaaaatccttggtaacatactactttagtgtttatattgagtattttagaaatgtgtttgatagctacaatttggaagtacgcagaaggctacagaaccctgaaggcaaaggtgagctgcttgaattaatatgaactaaaatgataatacgttatacttaaaagctaacttttttgcaatatacttagaagtctttagctgcattacctctaatcctcagaatacatcatgagaatagtctctgtgaacagggttaaatgcattggaaagaacactgatggaaataaggaggggtcactttcccattaacaggtactatatagagtcaaaagcgcatgcctgatgtcagatagagctgagcacacaaaccatttctccaccagtgagacgtttcaatcataccaagtatccttgctattttgcatggttcaaattggtggcctaaagagatttgttacttgattacctcaagagtacactacaagtgaaggtaaaaactagagttataataagttggttaaggaatctttgtaaggtaattttgtggaaaaataacagagcaagtgattctgacatctcaaagcagaataagataaaatgctggggatcttctggtattgaaggaagtgttttgatgtgcaccttctataaagttagtccttcatgtatttcggaacaccagaatttttttttaattgtgaagttaaaggagggactgaaataaaatttacttaccaactatggaaagcaaatactattattgcaaattccttcatgaatagggaggtagcataaatatgtaacatgtgagagtagaaaacaatggagaataatggagcatgtgtgaaaaagctaaaactttaccaataccttcaaacataagaagttacttaaagtattaatagagtatttataaattaaaattatctattcattgaagagaattttctttactaagtatcacacttgacaacctgcttatattcttcttgtattagaattttaacttatattggcattcactctcctaaatttagtagcatgaattagagatgtttttattctaatattggctatacagcagactaacaaatagataatgtttgggagaatggtgcagaaaataatgaacaaaaaaacaggaaatggtgttcagaagaatgaaaaataaaaaagaaggttaattttctttaaaaggtaacaatgtaagttttttgtgttattttgggtcgctgaagtatccagaactaacatttttggagaaagttgaggatagtgaattggaaaataatattaaggtgtttataaactattaatacacagatattagtttaattcatgctacaaattaaaattttagggaaagtataaaataacacatttaaggacaatacactgctgagaataggaagaaataaaaggaaagtataagaaaataataggaagaaaacagtccttaaaaagtatgagaacccagaggaaactgaatcccaaagtatcaacaaagagagagcaatgagaccgaccagctctgttagtgattttgtatgatttatattgcttgttgctggtcaaagttgtgaaactctgtttttttctctctctctttgtcttctgaaataaataaggtcaattttgaattatatttcttctgtatgtttaagtcagtgatgcactctgagcagtctggaacaagatatgacaagatgagcacaaataaaacattatgtaatgtagaggtgcaaaactaactgaaaattgtttggacacttgagggccaagtgcggtgttgaaagcttgtgaacaatgataaaggcccatttaatgtttcattatgtttggttcattgggacctactgacgtgtacattatctaggatttcaaatatattgaggtacaaactgattcaacagaacacatttttctctcatattgccttgtgtgataaaaagaagcaaaactgaataagattttgtttgtttgtcagaatgtacagtagggtaaatgaaacatgtttttgtgcatagctcctcatatccagaatgaaaacttgtcattttttcataggtaccattgaaaatattacttacctggtagattccagccttcattgtaaattgaaatatgagattataagcctagggcttacagcacttctatgcaatggtcctgattggaatattactcacatgtgcaattttgtgttgccttttattgactgtgacaagacacatgacatgcagcatgtgcacaaccacagcaaacaatattagcagaaaatgaatttcaaagagggagaagaaaaatatggcccactaccagccctccactgaagtgtggacacatagttgaggtgtgagtaactttcagatttcattaataaattctgcatttatctttatttgctttgacttttccagtaattgtattgagactttcagtatctgaggcttttccagagacttttagctatatatgttgagcctgacagtcaaaggcttccagctgggtgttaaaattagtcatttttttaaaaatcccatattttatggcctaaataaagttgctaataaatacttcatttaaaaaaaatactttttcaagagaaaaagagaagaatagctaccttcagtgtccagaagtactttgaagacatgattctgtactgttaaatattctaacaaccaaacattattaatacagtcagtccccatgtttcaaagtagttgtcttctaaaatccatttgttaataggtagcttgaaaataaaaaacaaaacatttttatgtaggaaaagataattaggtttccagactgatccacaaaattctcctcaaagaatagtgcatccacaaggatatatatgttcatacttaggatttttttttcaatccatttattctgagtcattaataaaattttatttataaaactagaccatatattcaaattttttatcttactatttttcagtgcctcttacactatactagcatgctaactattaaatattttgtttctattttgtttttgtttttaaacatcttatactttaaaaatcttatactgtggacttataaaagtccacagctttttgccaaaccagtaatgtaagaagcatatccacaagcataactcaaccttattacgatcacttcttgaaataaaactttgcacaatttagtttttctatctataaagtgtgaagaataatactcatatcatggaatgtctgtgaacattagagaaagtttgtgaagtgcctggcactgtgcccagcatatattggtgctatcatggctcactgcagcctcgacctcctgggcttaagcagatcctccaatgtcagcctcctgagtagctgagactacaggtgtgagccaccatgtctggctaatttttgtattttttgtagagacagggtttcaccatgtttccccggcttgtctttaactcctgagctcaagcaactctcccacctttgcctctcaaagtgtgaagattacaagtgtgaaccactgagcctggccttatttataattctttatggtacctgtgaagaaactaagttccaactaagttgactaaaaatggaaatctattagaatatacaattcaagaaaagagtgaacaatataaatgtgtgacaggaggattttgccctccgaaggtttaaatactgacaacattctcttttgatttttatttctgcttgtcttggcttcttgactccaatgtctaccttagcactctaacttctccttgtagcatagtgggaaaatggctatgttttagatccctagttttatgttttataggtatagctaccaagagacttttttttctcagctccagttttctaaaccttgaaaagggactatgagtggccctcttgttgaatcaagagatccagcccattgctgagccaatcatctgtggcccaataatgaaatcattctgaacattgaagagttatatggtaagcatcgttgaggaaggagtagactaaaatttctagaaaatggaagagagcactgggaagacaactctgtttacttcatacttcttttctctccttcaccttccttttctttcttttctctaagaagaatatggtcattgacaattgaaagaacattagtcgggcttgtttttgtttgtttcttatgagttttaaccacataaaaatgttgccctacatatacaagaaagtgtaaatttctatgaactagccacactttttcataattacatcacagtcttttgtattcacctacaaggtgttctgcagacattatggagtaaacacctaaacagagtagtatgtttcatagaagtatattgctacagtagattcagatttttatgaagaaaaaatttatgactcttctgaaaatgggcagtctgatagagccatagagcaagccagagagtaataatagctattacctattattaacaatgctatccttctcatcattttaaaaatatgatcagaagtagtattgccacattagctttgatcctagtgaaagttaaatgtttctttccagtttttatgctgccttctactcactaacatatagatacatgttttaattacaggcacattgcatagatactcataaaacaacctgatgagttaatatgacagcatgtcagaaggatatgcttgggagtgtgtcaaagcaggactcaagtttatttatttatttatttattttttacatattttccaagctgtgtttccttaggcaatctgccctacctttacctttctaagtctcagtttctacatctgtttataaagaaaatggatacaataagcacattagtggccagttttatttttcattgtctgattttgtgaaaggatttttaaaaacattaagagagggacatacaaatttctatattgtttgctagagtgacagggacagagagaaagattttcttttttttttagactgagtttcgctcttgttgcccaggctggagtgcaatggtgcgatctcagctcaccgcaacctctgcctcccgggttcaagtgattctcctgcctcagcctcctgagtagctgggattacaagcatgcaccaccaagcccggctaattttgtattgttttttgtagagatggggtgtctctgtgttggtcaggctggtctcgaactcctgacctcaggtgatccacccgcctcggcctcccaaagtactgggattacaggcgtgagccactgcatctggccgagagaaagattttcaatctaatattatttttattactattcccctttataggtcagaccctctctgtgattagagggtaaatgtgcactttttagtaatacattaatttttttagattattggggccattttgtaaatgttttttccattgcagtggatggtaaccagtggcctaaacgcataaggacaaagcttaaaaaatgaaaaaaaaaaaaaacaaacttatttatatatgctttatttcaagatagcttaaaaactttttcccatgttctagttcattaggatcataaatccttaggaaaatcactgttctgttgcagaagatgttgttcactgatttgtgaaggtttgtagtttatttattctgcaactattagacactcaataaatgaatttgatgataatgcttatggtattttttccaagaattagaaatccaggaaagaagggcatcacgttgcaatactgaattatcaaatcgaagattttttttatgccatatgaaaacagaatcagcactcaggtagtcttctttcaaatacccattctttcactgatgagagataacagaccacctaaaccatttcattaaatggcttctggtcgtctgatgcatttatgcgccttctactagtggaacaaccgtattcccttttgatgcataagactttacccactagtggcaaaatgctttaaaatgatagagtacattggccatcatatttgttcagttctcagtatataccttgctctatattatgccccgtggaatatacaaaaaaattggttttcaaagagcaacatgtttgctacataattttttttctattttatggaaaaaaattctgttgtccatacatacacaagagaagctttcccaaatgaataaatgattaatttcaaaaagcctttattttgttttcttttgacattatctgcctatttggagctaagagaatgccagtgatgaaatggtgagaaatgttgtgtattgtgcaattagaaaacaggaattttttttgttgtttgtttgtttgtttgagatggagtttccctcttgttgccgaggctggagtacaatggcgtgatctcagctcaccccaacctccacctcccaggttcaagcgattctcctgcctcagcctcccgagtagctgggattacacgcatgcgccaccttgcccagctaattttgtaattttagtagagacgcgttatctccaggttgttcaggctggtctcaaattcccgaccacaggtgatccatccacctaggcctcccaaaatgctgggattacaagcgtgagccaccgcacctggctcaagaagttttaaaaaacaaaaatctaggacctcatctacccctcaatcatggcaaaaccagttatttcaaaacccaaattttaatatggtttaccaagcctgaacataaaataaaagaacacaaactaaatgttaccaatacaggttaacaatgcacatccatacaatttagggcaaatccaaaatcaacttgacgttaaatatgttagcctattcttgacgttaaatatgtcaagctcttctctcttggtttgttttgacctaaatttctaacctgatattcttattcaaatgtgtcatgagggcagccaaatggcctgatttttccaggacagcagtaaaaactgttctgctttgtcatggattctttgaaataagttgttcttgcagtgaatacaaatgtaagcttcctgtctcagtgaactaagcaacagaatgggagttttaaaagtcacagatccaaatccctctctccagtactgagtcaccatgtagcctttgtggccttgagttcctggttttcactattgaaaatgggaattataaaatccagagagtattttatgttttaaggtttagggggaaggatgtagaaaggtataggagaagcagcaggtaattttttgaggactggtgaatagacacactgtaaaatacctcacaaataatgagctttcccctcccaccagtggggagaaaattgcccaccagtgggaggtaggaggaagatagaaaaagaaaaagaaaagagaacttttctggtcacagaggtactatttagtgcactggagcataatttattaagtggaactttggctgaaaagagctaattcacctaccaaactgagcagatttacattcttcccatcacaaggacaaaactccacatagttagttatttatcttttgggaagtaactggataagatacgggcaatggagtaaatcagcagaatgaaaactattccccaaatgccaaaaaccacaggctcctgggaaatatactaaaatattattgttaattgtatatctacaaaaattattgtaaatgcgttcatattaatcactactgcagaaatgctccattttcttactttttataccattctgtttcttggaaaaatataagataattttgaaagcaatcaaaagagccagattagttcattttaattaaatcttacagaaactgccttgttatctgtgtgaactttggttactaactttctcaaggtgagaaaagatgtattcaggtctctgtattactgtaatgtactttgtactctacaggcagaaacaaataaattccatcattaagactgtatgaagaaagctgaacagtagtggtttatgttttcataatgagttccttgtattgaatgtggaacttctgttacattttcatggagtctgcgtagaatctacacataattaaatgcctgttttctgctctctgatgcatcatctttaggcagaaacctgcatttgtgtttctcatgtccagctattacttgaatctaatttctgtcatattttattttttaatgtgaaacttcttctatcagtgttataactgatatatggtagggcaagacaattatgtagaagccagagtacaatgctaatgtgtatgtttgagagaggctaataggactcttaagctctagacctcataaaagtgccagaaaggccgggcacggtggctcaagcctgtaatcccagcactttgggaggccgaggcgggcggatcacaaggtcaggagatcgagaccatcctggctaacacggtgaaaccctgtctctactaaaaatacaaaaaattagctgggcgtggtggcgggcgcctgtagtcccagctactcgggaggctgaggcaggagaatggcgtgaacccaggaggtggagcttgcagtaagctgagatctcgccacccactgcactccagcctgggtgacacagcgagactccgtcttgaaaaaaaagtgccggaaaatgctgttgaagttggtctaaagtttttctgaagcatacaggcagaataatgttcccctcaccatccaaaaatatccatattctgtgaacatattagcctgcattgcaaaaggaactttacagatgttatagcgtatcttcaagtgggaacattatcctggattatctgggtgcctcagtgtagtcacaggaatccttgtaagagggaggcaagaggttcagaatcagagaaggaaatgtgatgagggaagcaaaactcagagtaatgaggccacaagccaaggcatgtaagcagcatctagatgccacaaatgataagaaactcattcttatagagcctccagaaataatgtagccctgcaatactttgattttaacccaatgaagctgattttggacttctcacatccaggactgtgtgataatacatttctggtattttgaacaactaaatttgtggtgatttgttaacaggaaactaatacacagttattaatctgacttttcaattttaaatacaaaactctgaggtttgaattagaacagagtgattcagacacagccttaagcttatgccttttctaataacagagctagaatataaataatacaagcccattgcccttaagtaactaatgccagtggagataaatgacttgcttaaggtagtacagctagttagtgatagagatgagatgaattgggctacacaaggctctgagaccactgatatttaatttctactgtgctgcctttgtttcatggtataaaaacatttgcatacaaaagtcatgtttaagaagagttttcggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagctgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaagaagagttttcaagtgtaataagaaatggggtaaaagtgggtgtgcggatgaagggatagagaaagggaagagttacttcacgacaagaatttatgtatgtcctgctaagttacagactaggcgatctgtagtgaatcaatgagacatggcccttgctcatggtgcctgttgggaagacaaacataaacaaatgtaattataattaattaatagaataccttaaaggagcaaagttctgtaaagactttatcatgtgcaaggacttttcctcttaatctgtattgtctttgaataagatgatgatcaaaaagaattttattctattaaaagaacatcatatgattttgagctgttactcttattctgcaaagatataataatcgccttttattatggggaagaatgtatacatgtatttttcaatgtctttggaaacatacttgtgtatattttagaagcccaggtttgtggatgacacttcactgcgatgccatcagtttctatggagacactaactattgtgcagttaggaggaaaaaaagactcctccgcttccctgtagctttaaactgtttttactcatctttctattccacacattcagaaataaaattaaaatggttttctttttgagcaatattacttgaatgccaatagtattatcttttatttcacaaagactataaaacatttatgaattaaatatagtccaacagaaaatgagatcttccctagccatcccatgctaatggcaaagatagtgtttcctctgtgtggtttataaatctagaatttttgttggtattatgttactagagttttttttttttttaaacttatacattaaacactaccaataacttcaaccttggtctttcacacagctgtggtgtagagataacttccatttatattaaccgaagttacatttgcatgctagcaggaaagtaccctttatagaaccaaattagtacaaagctatgtgaaagaacaaatcttttctacttaaaagaggcatggcaattcagtttaataaagaaattctacatcagtgtttgtttcctagatcctgatgggttcattttgtcttcttttgcatcattaattttaaataatttttaaaaattggtaatcaacagataatgctgcctgatttgaacttcctttttacactggctttatttactgctgggaactttttatttattttaacttcttcttaaaataagaatctctgttttactaacgtttgtgtttttaagtcctataaatgctggattacataagtatcagtaaatattacagttggcaaaagcttaaaattgcttccaaaaataattttaagaaacaaaaaataattaaaatgtcactcctgaattcatacattcaagtgtattttaatatcaaagttaaatgttaagtgttaaccgtgaatccatggagatagtgtcatactttgcagtctaagtacttttaagtagcacaaggtctttcaacataattagcacagaatattgaaccacgccagaaatatgggattcgtcattaaatttagaggcttctttatctctctgagtctaatcatgtgtgcagaagactaattgttaatggcatggtctttattgctcatagctttcttttattttaaatggaatggtctgctttgtgagaaataattaggttttataggcctacctgcatggagccttttgttgaatgtcttatggttttgccaattcagatcctgagagcaattagaggctgtggcggaactgttccttaaatcacacacatattgtgttattgcctgccttttattttttttacctgcagtagcagatgcagaagcttcagttacttgcaagtacacagactaattgttagccagtgcaaaaactacttggtttgggaggcataaactgggaagacaaagttgttataagtgtggcacatagaagtgtgtcctaatgtctgacactgtccccaaaataattatgttctcaattatagaacaagtctgtaacgattctcttaagtgacatggtagtttcgttgtttaaaatgatggtcaaaattggtggccaagctgtagtctttcagtatgtatggattttttttcaaccagaataatttatttgcttcccacagtcagttgggaattattgttgctcagtgaggtaaataatagagacacttttcaaaagtgctcataacagttataaaaatcaatgtttcatttctgaaagagttcaattggtatgattagtcagagacccaactggtgagatctgatagaagtattgtctaaaatgtggcaagtttcaatatcattttgagagaactgcatattatagtagaaaaaattggctggattattttggtcactctgcctacttgccttcttcatgacacagaaaagctcagtgagattattcttaatcagttaatgatgataaaaatgattgtcatttatatgttagtacactttcataaattgcattcccttggagctgtttgtcaaattgtggttaggggttggcgttcacttttccaaccttctcacatgaagttacagtaaatcctatttgtctactgttctgtttgacataaatttaacagtgttttatcctctctgtgtcatcaacatgttagccaggtaccattttctgaggcaactatactcctgctaccatgtaatcaataacacagtactttcaatcttgacaattttctttagtggaaaattactttgcataggctttttgccattccagttgataagccatcttcattcagatctacaatgtcaaatattatcactcccaaaaaggcactgacagccttaaacatatgcatgtacaaatcaatatttttttcaactgatctcctttggaaacattttttttttaactgaaatactagaaggtagatgaatttgtgacctacatcctgtggcaaacctgaagatatgtttgaaaaaaatgtcatatgaacttgcaggatccacagagaaatttacttatgggtagtacatcatttttgatataaagaaataggtcattgtaaaacattttcataggaaccaatggtactgagatgtttattttctgagtttctgtctttattttgctaaattcctcctctaaataagggagggccaagaaaacacctttttgttacctggcagattgccttctgggtaatagatgttagacaggtaaaaatacacattgctgctttgaaacacacctgagatttttgaaatcctaagaagcgtttacagttgtgtaagaaattggctaattaaaatgttgttgaaagattatttgagggactattcctttttatggaaaagagatgaggaaaatagaaaatctaagaataaccttagcaggtcgaaagttttgttttaaataatttaacttttttgtcataaaaatgaatggaatacttattcggtcgtcatggagaaagcctagcctacccatccttttttttttcttcctaatatgtggagagcctgatcctttacatttgcttatgctgctttgaacattttggtcacaatttttattttttatattcaaagtatgtagaccttgtgacagtcagttgtagcaataactcttcttgtggtctttgaaagatcaaatacaaaccaggaaaaaattctaaataaggttgagagtatttgaataattttccccttaaatttagtggggtttgggaagaattgtgtgttatgagtttatgacaactaaataataattaaacttcaaatgattaaactttaaataagtaaaagagaaataattttcgtgctccttgcaataagtcaatagtgttagtgttaaatagagcatgagagttccttgtagacctatttatagagacaaaattgtttatgatttggtatatacctttccatacttttcatgctcatgtaagtatattttatctatttaaatggagacatgctgtatttactgttctatcattcccctcttcacttaacaatatggggaggacttatttacacatttaaagctaccactttttagaaatagatgtaattttaaaaataattatgcatgattaagatttagacttttcaaattattttagtataaacactatcataacaaatattcttactcatatgtctttgcgtacttgttcaattatctcattagtatgggttcctagaactagatttgctggcttaaaggtgcttaggtagatattttatacttcatgaaaattttggtttccacatcccacagtagcattgtccttaaccatcttttatgttctgtgtttctctaagtataaaactctaattgattttaaaatctgcaccctttggttattaacaggttggtggtcttttcagccatcagactgagcaggcattaccaagcctatagcatagggtatttacgtacagatatcgatctacagatatgaatatagatcatatagatatagttatcaatatggttacagacatggttatacacatagatatagatttggacaaagacacacatacgcacacacacgcccacgcgtgcacgcacgcacacacacacatcttttcccaaaagcaagttgttgtttatgctgtttcatcaacctagaaaattttatttttcgatattcaactttattcatcctgagaagctgagctctgatttcactctccctaccaagtcacagccattttttattgctcctgtcagaaatctcatattcctttatagaacttatatggtgccttatacactcctataacatttatcctgctctgtctttaatttgacttaggcgtatgtcagcttcaggattcatagataaggtccttggttgcaggaaccacgtctgacctattttttaaatccacagatacttcatgatttgccaatatatgttgatttggtgtaggtactaagccagtgttgtgtacatatggatttccattgttgtctgccacaaaaggagtaattttgagaaatgcagtgttttggaaaagaatatgagacatgcagtcagagaatttgccacttaatttctgtgtggctttaaagatgttcctcatcttctgtgaacctcagtttaattcatctgtgaaactaagggaataacaatatacttcaaaagtagtaagtgtatcgcaagtagtaatgaagaataaacaagatactggcttgacagtgctttgcaaatgttatataaacataaatataataattatatattattacaaataagatttctgaattcttacctcggtagaaagtaaataagaagactgagtctctgtctcccaacgtgtacccaatgatatgaatcttaagtaatcggatggatgacaggattccagatgtaaattttgtgaccatatgcatccatcagaaattatttagtgaaaacagaaagaaaaataagctcacaaatggggttgcactctctttcctgtatgatagaatggttaaattaatggctaaatctaattaagaaactgaaaaattatagcttgcctgctgccaatattaatcccaatggactgtgagatagggatatggtagcactcaaaaattacctcaccattgttgaatattaaggcaattttgctacctatccttagaaataaaacagcccttgcaattaaattttgtaatttgttattggttcaaaaattaatgccttttactatcataaatgtatcaccacaggtgacaaagcacaattttaattaacagtgacaggtaaagctccttacagtcagattgaatttatattagcaattatataaaaattatattttgatcatcacagttttgcattgaggccaagagttctaatcatatatagtcctgcccctaacgttttgtggggcatgggccaatataaaaattataaaatagctacaaactgccaaatatgtccttctaccttgataaataaatatacttttataatgacccagaagcccaggtttgaatttggaatcctctgacccttggactcctgcatccgaccttggctgaagagcagaaggcccctcccttgttgcctgatcagtttccttttcatccccagctcagtgctgcaccacggggaatcctgtgctccacctctaggtagtcatacttctaagccctgtcatcaccacctctcagccccaaaagtctgtgtctgagccaacctgctggtctagggacgcacactagtaatgcatttgactttcagaggaaaagaccaggagagaggcctgcatagactttggactggactcaggaccattagggcaagatatctcagagtttttgatacgtaaggaatagcctagaaaaggtattgtaaactgcgggtgaacacatccactgggccccctagaatccttgtcccctgaggagaaatacaggatggcagagagctatagtgaggctttctgacgtacaggacccaggggcccaccttgcctagatgtaggggtggtaatgatcatacattaagcatttgatgatatttcagagatgtcaattaaataatggctgaaatatatcagtgatactaataagtttaatacattgattttcaattatatatgctttaggaaaaagtaaagctgtattttaaaccaatgcgttattcggtatattaattttgttttaaaagtgaggttctcaaaacgttatttccgtgtgttgtggtattatttccttcttgacatatttatagggaatttagttattgagaaatgtaggttatgtatgtgaaagacacaaagcataccaaataatttagacacagacgtaagtatagccatgagtgtctgtgttagtcaggaaagtctaggttttgttatggcagcaatcacactaatttagtgatttaaaaataccgaggtttatttctcatttgcgctgtatctatcatgagtcagcccagggctctgttctgcaacatggtccttctaacactggagttcagccagacctagcagtcacccttttgttcttagaagttgtagtaaagagggaaaagagaacaatggcaaatcttgcattacccattatgtgctcagtccagaagaaatacttgctcctctgaccataactcattgacaaaaaacagtcaaaacgatcctgtgttctagagggagatagaaccagaatatttgttgatcaaaactaatgattaatcttgtacagtatacacatgtatgtatctaggaaagcataagaaacatcaagaaccagccgggcacagtggctcacgcctgtaatcccagcacttggggaggttgagacaggtggatcacttgaggtcaggagttcgagaccagcctgtccaaaatgatgaaaccccatccctactaaaaatacaaaaaattagccgggcatggtggtgagtgcctgtaatcccagctactcgagaggctgaggcaggagaatcacttgaatctgggaggcggaggttgcagtgagccgagattgtaccattgaattacagcctgggcaacgagagcgaaactctatctcaaaaaaaaaaaaaaaaaaaaaaaatcaagaaccatatgcgccaaattgttcatacagtttccttaagggtggagtgcaggttacagctacattttaaaaacttggtgtatgcttttcagtacttttgtaatatttgttaaattaaggctataaaatagtctttaaaggtataaatactaatgcaatacccatatattgaaaattaaaacctactgttcatctaatattagttgtactttcatatatgacaaaatggtgatggacatatctttaattaagtttgagattcagtagacacaattacttatggatttttcaaaaattcaatgagtgaatatttatatattcagatactgtaagaaaattaaaataagcataccaaaagatacagtagatgatattagacttatatacaatggaaaaggaccagtaaggtattcagtttgtccttccttaattctatgggacattttagattccggaaattcactactgccgtgtttaacatttcatttagtattctattgtaagctgtatttccactcacatttaaaaaaaaatctttacatagatttcccaggatttatgcatttctttataacttgactgtcttgcatagtctaatttttcagcatttaaatatctaaaataagttttaaatgcaacgtttctgaattattttctattgttacgtactaaaagcaagtcatattgtttagaagtaatttaatttcctaggacttggtttatgaatacttggtaagtctatgcctgcaacaaccactgaatgccccacagcacacgagtgcaatgtctttgatagcatgggttttgttaaattaatgaaaccttaataattaaatttttaattgcatcgggaaatttttcattaactgagaatcttttaacaataaagttcctttttacctggcacactttggaggcaatgcatacttttggaggtatctaattcaggctgaggagtctcaaagcataagaagacccagtcaagtaccatgcgagagtaaactgggtaagaaagaagggaaacagtccataagaaaacagatttctgtggtgacctgggagtgcatgcttctcttaaaggtattccagttagaacaattttaaagcattattccagtgaaactaaatactctcattggcaagatttgagtgtctgtctatgagtttgagactctagaactcagattcttgtttattacacatatttatttattattcaatattagtctacacaggcaagaagatccataattggtcatattctaaattgtgcaaacagaaaagacataaaatcaagagatgcaaaattcctaggagaaaaatagtattaattttgtgatgggtacatagttttgttaacctcattttggtcatcttttgggtttaaacaattcacaataatatttcacagatatctcactttagatgctttatggctaaaaaccaacagtgggcttggtaatttgtttctggtgagagtgagagaaaaatcagtgtgtaagttgttttcagttcagggagaagtaggacaataaaccaagtcaaaacatgaagaaacagaagtcaccaatgaaacacagactattaaagctaccacctgttgcaaacttgtttccttaaatccaactaggatttagggtttaaattataatattaaattggttttaatgatggtttataacagtgtcttttgaaaacactcattttttgttgttttgctaatgcataaaagcatcaaagctcattagtttcatattgcttggctccagtcagccaaggggttaaaagaaaaatagaagctgaaaggacttcttttgcccgggaaccttatcatcattcttatctcttacctgttcttatgaggtaagatatgcactgagcatattggctgcttatgcttgttactggaatcgatctactatggtgataatgagtcatcatgaaatagcagcccagttactgaaggaggtaaggttagagaccagaacctgactggcaacaaggctgtctggatgcctcccgacacactcagcaacagctctttacgctttcccagagtacggacagtagtgttccaagtctggagtggcagaggccaaggctgatcactaagtgggtcacaatgagcaataggaaactgagggcatagagcaatacttgtaattttacttttgaacctgatgtttgttaaaatctacagagtattgggtttctgttttcaggaagctttaaaaagcaaactaaatacagatcaggaaattcatggacatacttctatgactgcttcataataatgtatggggtatgtaatatgtgctaaccactgtgttgagtgtttttattctgcagtttttttgttttgcttttagttagttcatgtaattattacactaactcagtgaggtaagtattgtacttggatttccagataaggataccaaaactttgggaaggtaatatgcttgcttaagagcatatagctatgaagtaatagaaaggggatttaaatccatgtctgtttaacttccaaccctaaggtagccagtctttgttagctatggttaagctaattatactcaagattcttaactactaagcttgtctagatatttagctcagtggttaagatttaggatctagtcaaggctgcctggactcagattctggctctgccactgactacctgtgtgctccctaacaagttattctacctttttgaagcttatgtttcttactgtaaaatgaggataatagtagaatttaatttctaggggcctcattaatattaaatgagttaatacacgggaagtgcccagaacaagtagtgcctaggagacattattcctgtcattatcatttctattattagttattgaaaaccaacaattctacaaatgaagattaaacaaaatccttatatataagtgcaactagttgtgtttttttcttgaaacttgaggcgttaaaatttgattttttaaagataaaaaaatatacagtctgctagataacaaattaattgtaaaacttcagaacaggttggttggggtacagaaaaatataaaagagcaagaaaaaattaataaggagaaaggtaggcatggaggaagagacaatgagagatatgtgtagtagcagcaaggtcggaaacaatgatatacttaaagacaaagggacaaatagacattctaagagattatattcatcaagcaatacagttaactcatgatttcaaataaactattactttaaacaaggttgcatttttataattctgggcagacataaaaatatcctctctttgtatttactcagatggaagctgaaattgttttccaaaaaatggctctcacggcatcattggtcaacttgactgtgataatgtgaagtaagaataaagaaaaggagttaggtcccaagtgagcaaaaactaaaaacaaatgagtagtttttcagtgttttctttatgcaatgaaatatttgtattatttgggtttacaaattacaaagatacatggcttcataactcgttcttttgtcttttaaattatcttcatttttttctttatctttgggagcaaagtgctgatgagttagtgtgatgtaagaatagaagagttaagagaaggagaagaatggcaccaaacactagctttatgttctcaaatttggtgcttaggccactgataattgctattcttttgaaaatatatatgtaaattattttcattttttaaattataataagcctatgttctgtacagatattttctagcttatttcactgtttactatatgattgactttggacaattatttaaactttgtatattcttcatttttaagttgaaattaatgatagtacagggtccttgtgggaattaagtaggctaagatatgcaaaatgtttagaatacagccttatacccatctgtactcaacaaaggttaattataagcatagctgttacatgtatgattacattccttagcttactttctataaaacaaatcacatatgtaccctatattgtagggtgcattgttatgcctggaagatatttaaagtgatatatggctttattgctaaagagttatgctttttatggctggttacatcctaacaaagtagagatagctcaaggatactaagaaaaaggagaaagatgaagggaaaagtagattaagaaagaggaaaaataaatgtttgaatgcaaagtgtaatagaaatacatttgcaactagaatttgaggtttaaattataacattaaattggttgtcatgatggtatataacagcgtcttttgaaaacatttattttttattgttgttatattgtcacctcagctgagaaagtcttggaattggaaatgggctctgaaatacatttggtgttcaaaatgtatttccatcattggtagctacgattctggttaacctctctgcttcttgattttctcatctaaagttggggccactactatgtctactgcaaaagtctttggagggttaattgggtaatgcagataaagggcttagaactgtgcttgacaccatatttgccttccttaagtgtaactattattatattggattaattcttaggctaggagaaatggtgatgaaaaaggcactgttcttggtctcatgcagatcagaagtcaattgaagaagacctaaagagtgaacaggctcttatgatacagcttgaaaattgtcctgaagctgctagaggtacatacaggttgctgctagagcagcaagttaaggggaacccatttattttagagaatgaactatgcctttctggagcaagtgatctctaaactggatcctaggagaatgagatttaacttgaaaagggagtggggaagagtacatcaaagcttgagggaactgcaggtgcccagaatgttttgggaaaattcaagtactctatagtattacaggagaaaaatgtatgggtcagatgaagagactgaagcaactggtagaagaaaaggaggtaaatgagcagggtaaaatgagaagggttttgtcctgagtgttagggaggttagactttcagggattcttcagagtaatcgcaggagaataaacacaagagcttagatctttagaagagttctcttctctgccttttgatataacataaagagcagatggaaggaggcaaagtttccaggaaggcaaccgctttggaggtacgtactgaaattgttagaaagtggttgtagcccctcaaaaaaggcatgaaaggtgggggagagagagaagtggatggactctattgtattttggtggaatcagtaagacaatgttttttcacttcttaaaatgggattacaggtcttggcttaaatgattatttcatagtcttttcacttgttttcctgagtaaagatctgaacactgtgccttgtttttgtccagtaagaatatatgttactcatgttccatggcctttaaacactttcatgtccaattctacaattatcatgtggaatatttccacttgaaatgcattgttaagtctgtggcttcaatagtaagagaatagtaagcaacataaatatgccacttcttttttccttgttccataagtgatgggtgattttcttggcgtgattcttctctcttattaagagctttaatgtttaggattcttgttttgcactattacagaatcaaggtagcgaaaagggactagtgagctatttctatgtatcaggaggaaggttctgtatcccttttattacaaacacgtttttcttttattttctcttcattttctgtccattgaatggtgtatagaacttattatgctagctgatatcacaatgctgggaaaattaatttacttaaataaatagcatcaatttttaagctattttccagatagcatcctgtctggtttcgcagatagttcattagttggcaagtataaacagtcacaaactgctttagttgatagtttaaatttaaaaataaaatccttgtcctgtttatactgttttttgtgtcacaacattatgaaaacaggatttcagagttttgaaaaaaaaaatttcattatttagattttgattaatgtatttcaattcttgctgaacaaaaatatttaaataagatagaagagttgtattttaaattatttggatgatattaaaaatacctaatacataaatatgcttacaataaccagaaatattcataagacaattctaccattcatacaaaaaactttgaattatttcacgaaataaaattgagcaaatctgccactttattgctttcctgtcaaagctggctgtatgtaagagctggtagagacagtgaatttgcacgttcaggaaagcgatttgaaggaattaatctttacaagcatttctaatctgtgaatttaaactatttctctatttttggaaagatgggtcacagattttgtagatatattcattttacttagacaaatgagtgcttgtcaatagggtagtgtttgtgtgtgtgtatatatacacataaaatataccacctatacattgtgttagaatttcaatttgaaacaccatgtatataatctttaagaatgtaactctcttaaacttcagtcccttttatagcagactaagtgctgctaatatacaggaagcaagaggcagcagggtcttcacctcaaaaagaccttcggattgcacccctttggagctcatcagagcccattcaggtttatcctgaggggtcagttgatgcactgcctgatactacttcttcccgggggctgaatgcacagcttcagcgagacacccaactcctgctgacttgagaaaagtgttattttaatgatgattataatgagttttagtgttgctgggagccaaatgtatccttaagtctaaaagagaaagctgcataatgtagcttagattattatttgatatgttggccttttaattaggatttttcccttcttgatattcatttattgcctattgttccaaggtgaatatttgtcgtgtatcttgatgaagatatcgtagcaactgaaacacgttgaatgcactgaaggggtggggggtctgcctcataccgtttatcctgacacattaatcaatgaaactatagctttgatcctagcacctgaattcatttctagcatttgatttcctctccagcagtcattacaagttactttttattaagtgactctagctttagaagatggcttttagccacttttaagcccatccttgcactgcattgtcatgagaagttgattaaggaaacatctaataaaagaagcttcagccaatttggtatggtgatgccatagcaatccttagagtcagtggactttgagagtgaacttttttgtctttagtaaaagttgatgtgatctgttctaaaatggttgtgttttatttattctgttgccagattttaatatgattgaaaattttttgaaaaaatgttagtttttatttttaagctgttaagatctcttcaggaaggtacattgacttggtgcatgtccattttttacaaaagaaatgtatatcaaaccagttaatattgggagtgcataaaaggttggaaactaaaggtgttgatccagcttgattgtaacagttcttcagcaatgggagtcaaactgttttagccatgatccatggctaataacctatgttacctgtgcttgtaggttaaaagtagagcaaaaatttcacaaaatgataacctcagtacaggcaatgaattgtattttcttttttattataattgatgacaatttattgaatatctactgtgtatggaatatatataatcttagatgctagcaagataagagtgagtaatgctttcaatctgtatgtggcaatttacagttatgtgagtcctgcaagcatcaggagccacaaagtggtttaagaagtggtttataaactctggccctcaggagacaattaaagatatcaaaatatctcacgtaccccataaatatataaacctactatgtacccccaaaaattaaaaataaaatgaaaataaaatgtgcatgatgtaggtacaagggtaagggtgcttattagtgatgtaggtacaagggtaagagtgttacaaattagaacattttcaaacatttgagaatgttagaacttcactctacatattttttagtgttttttattgacattaaacaactatacatatatacggggcacatgtcatattctgatacttaaatactatgtgtagcgatcaaattagggtatttcgtatatccatcacctcaaacgtttgttatttccttgtgttgggaacattttgcctcttctcttctagctattttgaaatatacaataaattattgttaactataatgactctattgtgttatcaaacactagaacttccttcttctctctaactatatgtttgtacccattaaccaacctttcttcatccactgcccccaacctacccttctggtaaccatcattctactccctacctccatgaaatatcaatctttttagttcccaaatatgagtgagaacatacaacatttttctttttgtttctggcttatttcacttaacataatgacctccagttccatccatgttgctgaaaaaaatgccagtcacaaattagtaaatcgattttataatccataaatgagtttcagtttgtaaaacactgctcacagccacaaattataatccttagaaggtaggtaggcacactataaattttgaaaagtttcactcaactgtaaaaatctatgactgactaaaaaatgcaacagattatgattcttaagtgtcatatgacaaattctggttatgaatatcctgagttaggccaatagatgcatcatctacttgtgtgatcctattcaatatatggctttatctgatgcaaattgtttcaaaataagtggtaacatgtaataactttttaaagaacatttaaaaataattaccaaaaatgtttataaacataccagaaactttcctgtttttaaacaataatgtgtaggttttatgattggtgaactgaatgtgaaaaattttcttgaatcactaaataaaatagtttcttatattgctgagctatagttgaaaggaactaacataatgaaatccacttttcataccactgccattttccttgcccccaaagtaaatcagactgacatggaggctttctgaggacaggcaccattcatgttgttcagccatattgatccattgtttcctcaaagcaaagcactattccaggcccagtcccttgccacttgttagatatgttattgattctatgaatataaatgaatggatggatggatcaatcagttagtgttagtaagacttgctctaggtaactgaaaaatggcaaaaatttattttgatctctgattttcctctctttttgtctttcctggacttagtttccttagtcagtaaatgtgcatagtctgatacttattttccttaaactcctttttgtgagtaccttctttcctgccctaagctctagaccttccttttgtcaattttttttaaacaaaagtgaccgtcccagtatctggtcctcagacatcatttagttacgcacaaactaatctgtgtaaaggaatgaagaaatctctttaatggcttatagtgtaactgcttccaaggggacttacatcacaattagagcctactgggagaaggcgtcgtgttgcatagtggaattaagggcactgttaaaaagatttgggaaatctattggtagatattttgtcagtgtcccacaaaaaacctcgtatagttgatgtttgaacttttctcagaaaatactgacactatgctggagacagaagttattaaggaatcctgaaaatgtcaaagtgtttatgtgtatagtatacatatttttctttctacagtctaggatagggtgttctcaaactggctgtagattttgaggtgtgcctaaaagtgctgatttctgggccagacacagtggctcacgcctgtaatcccagtacttggggagccagaggtggaaggattgcttgaggccaggagtttcagaccagcctggacaacacagtgggacctcgtctctacaaaaatttaaaaattagtcaggcatggtggcacacgtctatagtcccagctactttgaatgttgaggtgggaggatcacttgaatgcaggagtttaaggctgcagtgagctatgatcatgccactgcattccagcctaggcgacagagagagactgtgtctctaaaaaaataaaaaaaagaaaaagaattttttaaaaaatgctgatttctgagtcacgatccaggcctgctaaatcaggatgcctgaatgtggtaaacaaaatctttatttttaaaataaacactcttgagagagtcccaaattttaaatattttgaggcggggggtgccggcggggtgagaattgtctgtgataacttagttgtttgaaacttgtttaaaaataagtttcatttttcccttattcaagtgaccggaaggtcagttattttttgtcctgtattataaatggttattgatactgtgtgacatgaaaacaaagtttaaccaatagaaccttatagagaattctaggcagagcaacttccagtatatcacacattatttgcttaggaaggacaaaatatattaaatgagaaggtgggagtggatatttcaattctgtttcagctctagaaacaacatatctttcattataccataccttattagtaagtgaattccactgaggagaaaacacaacaaaactaaacattttatttgtattgctatgtgaatacattttatatattccagatcttaactctccatttgaatctccctactagcagaagtaaatgagagtttaatatattctttagaccaatattattggatgcctatgaaggcatagtgcaaagatctggggatgaagtaatgaaacaagaacgtgatacctgcacttgcgtgtctgctgataatttttaaggataaacttatttgtaaaattaatttttaaggtatctacgtagagctatgatgaggagaagtaaagagtatggagaggaagactaccgtggtcttgaagaatgaataagaggtagctgatcaggcaaaaagtcaggtagaagcttttaggcagaaagatcagcacaaatgaaggctctgctttttattatttaaagactgcgttttgagtgctcatatgcacacaacgctatgatcctagcctgttttaaaaattattttccttttgaaagaagctgcaagcctcaacaatgaagccattattatgtttacaagttacttaggagaaagaaaaatgatagcaatttaacattttacattatggctccagtcaccaggtgaaaatgagcttggtgttgactgtcctcaccgaggtgaccttgtgtccaatcaaaaagtacatcacaaaatttggcatcacttgtaatttctaatatgcaaaaagatagccaggccaatctgaatgttttttggtatattgactaaggctcatttaagtgtattttctaagtaaacaagtaaacgctatagattttgttgcacatagcacttctttgctttttgctttcaaatttctcaggtttggtcaccacactctaaggtaaaatgtaaacatacgatcatttataataatagtaacactaattataataatgtcttcagagtgcttactctgtactaggtatttatgaattatcactttattttacaacaacccattgggtttttcaaagacaaaatacactatacacattttatgtaattatttatggagattgttaaagaaggactggagatagtagggagttttaaaagaaagaaattttgtttattgctgcttagaaagctataaaataatttttaccatctttgccgcatagtacagccactagcacatgacttattcttcactatgcagaaccatttaatcattttaatgaattgggaaagtggcccccatttggccaggaaaaagaaccaagtatgctttgatgctgagaaggaagttggtgtgacatgatgggcaacatgaatatctgctcgtaaaaaaaaaaagggaccccagtggaacggagttacgtattcaattataagggttttcaagtacttctctatttcatgtgtctgctacaaaattgtaagtgccttagaatggagaaacaccttacatgatgacacctctgaggaattagtaaaataacagaattgattgtaaaagagctccaaagttggtgtccacacaatgggttgatagcctttgctgtctcagtaacaagttcttcagtagccttgtgtaagtcattaacttgtatcacatatttttcttttcttttcttcttcttcttttttttttttttttttttttaacagagtcttgctctgttgctcaggctggagtgcaatggcgtgatcttggctcactgcaacctctgcctcccaggctcaagcgattctccttctcagtctccagagtagctgggattacaagcacctgccaccacgcccgactaatttttgtatttttggtagagacagggtttcaccatgttggccagctggtctcgaactcctcacctcgtgatgtgcccgccttggcttcccagagtactgggattacaggtgtgagccaccgcagctggccaacttttttttctttatcttcataagtgacttcaaatctgcactcatctattaagacatgagaaacaataagggaaggttcattgtgcaggcactgcagccacatcaaatccagagtctgtcacacataatacctgcatgaccatgacaaaattacttaatctcccttttcctcacatttttcatcaatgtttaatggcaatgataatattaccatcattaatgataatgttaatatcataaggttgttgtgaagatccatttattcatttacttattcatcaaaattttaagagcatctactatgtgccaggcactatgatgcatttcaatgaaagacagaaagacaataaatgaaagaaaaataaaaatataaaacgtggaaaaattaatttgagatgggcaagaatattttaataagataggcagagaagatctccttgataaaatgacggttaaacagagacctgaatgaggtaagtgagataagtcctgaagctacaaggggacggggacatatcacatagaatgaactgcagaggcaaaggctgtgtgacacaagggttcatggcattttcaaagcgatacttgaaggccattgcggctagagctatgtgagcaaaggggagaattttcagaaataaatttagaaagatgtcaagagggcaagagaatatatgggccctgtggaacattataaggattggcttttactgcatgttatcaaatttaaaacatttttcattgttagcttcatcattattttatgtgtaactaaggaacaaaaactgccctgaaaatgatggcacaatactttctaatcacatagatttttattttgtatttatctaaaaagtttatttagtcttatttagacaaaaattcttttatatgctatgctggtctgcctctgtttctttttacatacacaataacttctcatttcaatgttgaatcatagtggaaacttactgaagatattaaattcaaatgtgtagtcccaatagtgcctataattcaactgaagtgatgaccaagtttgttcatatacaagcaatgatcactatgttataactgccacctggttcacggtgaatataagacactttttaattttctatataaaaataagtgtgtattatagtcatctaaatgtggaatgtaaatgagatagaaagtcagagaagggtgttgagagaagaagtcatgatttacttaaagaattacttttactgccatgaaaagaatagactgactgaaatgcacaaaggtgcaagcagagagctgcccaggagatttatttgattaatgatgattcagatagatggtagtggtttggctcagaacagtatcttaagaggtgtcatgaaatggtcagattctgatgtcttttgaagatagaaatgacaagattattgataattggatgaaagggataggagaaagaagtcagaataactctcaagtttttagcttgagattgggaagactgcgcacagatgggtagggatccatgggggtcaggagtctgctattggacatgatacatgtgaacttcactattcgacattcaagtggaaatgtggagtaggtgactagaaaatgagtctaaagttcacagaagtagaatctggagataaaactttaacttaaaataactccttccctgtatagatgctgtttaatattatgaaacaggatgacatcacctacaattgtgtttctccatttttcactactattcacactttttttgagacggagtctcgctctgttgcccagactggagtacagtggcgcaatcttagctcactgcaaccaccgcctcctgggttcaagtgattctcctgcctcagcctcctgagtagctgagattacaggcatgcaccaccatgcccagctaatttccatatttgtagtagagacgaggtttcaccatgttacgcaggctggtctggaactcctgaccataggtgatctgcccacctcagcgtccaaaagcgctgggattcaggcatgagccaccatgcccggctactatttgcacttaaaataactagttcaaccattgtggaagacagtgtggtgattcctcaaggatctagagctagaaataccatttgacccagccatcccattattgggcatatacccaaaggattataaatcatgctactataaagacacatgcacacatatgtttattgcggcactattcataacagcaaagacttggaaccaacccaaatgtccatcaatgatagactggattaagaaaatgtggcacatatacaccatggaatactatgcagccataaaaatgcatgagttcatgtcctttgtagggacatggacgaagctgaaaccatcattctcagcaaactatcgcaaggacagaaaaccaaacactgcatgttctcactcataggtgggaattgaacaatgagaacacttggaaacaggaaggggaacatcacatccaggggcctattgtggggtgggggagggatagcattaggagatatacctaatgaatgtaaatgaccagttaatgggtgcagcacaccaacacggcacatggatacatatgtaacaaacctgtacattgtgcacatgtaccctagaacttaaagtataataataaaaaaagaaaaaaataatattttatatcaccatatcactaggtagcatacaaacatacactggaaaaaatatgtattatttaatgtaactttattttataggtatgatacattctgtttttcttgtctcatcttttctctgttcaaaagccaaaagttactacatgttcctaagattaaaaaacactaaaccagaatgggaatgagaatagggaagagattagttccaagaactgagccctgcttcatgcagtatgtccaaagatctgcagcaatgcctagcacatattaaatgctcaacaaatgttagtttgtattattaaagggggatcccttccccccaaaatattactgatttgtttttatcaacttcatagttagagggctcacactacagcatacagaaaaagaaacaggtattgcattagttttctatgctgtatagctaatcactacaagcgtggcttcttaaaaccacatacatttattatgtcagtttctgtgagtcagagctctgggtatagtttagctgggttctctttctcaggattccaccagatgttggcaagggctgcagactcatcagaggcttgacgggggaaagatccacttcaaactgcctcaggttgttggcagcattcatctccttatagttttagagttgagttctccactgtcttactggctgttggctggaagtcactcttacctcctagatgctgccgctgttccttgccatgtgaccctctctataggcagttcagtgcatgctcacctacttcttcaaggacagcagaagaatctcttaagctccagtatgcccagctggagtcttatgtaacataaattataatagggatgacaacccaccacctttgtcatagaacataacttaatcaagggagtaaagtcgccttttccttactctgttggaagtgagtcatttgttatgcccctactcagaaggaaaggattccataaggaccttacttactgggggtcatcttagggcatgttcttctgcttgtctccttcttatccaaggtattcttcctggaacttgtaggaaggagtaaaattttggtcttcatcttggttatgaaataagaaatcatagaacaggggtaagaagacatgagcactattcttaatactttctgttttatcatgggaatacggcaaggtaattaatctatcattacctcagttttcccatctttaaaatggctgtaccagtatctttccatcatcttttctcacaggattctcaagaaaatggtataaaatattttatgaaaaatcaaattttgagctataaagtgttataaaacatgacaataccctttattattattatgctctggttctccaacttttcaccagctgtctagaaggacaaagcaatgttataaatggcttgtggcctgtcacctttctctaaaccttgtcaacagcaagctttcaaatatttattgaaggaataacacatgtttttcttcatttggtttatatctacttttgttcatcaagggagccataaatagttttacctttctttataaagtgtgtttgatttttaaaacagacaacaagtgttgtacagtttgtattaaaggactactttattgcttttttattacctgaaaaatgcaacaaaagtttaaaattaataacagtcagtagtaacagggagtagagataataaaagttatgttctttgcctcagaagcaacttgcgattcactttccatttccttaccaaaaaaaaaaaaagaagaagaagaagaagaaaaaataatcaagaacttctctggtgtttgtttaatcaaagcaggaacagaaaaggagagagaaagaaagaaaaagaaaaacttttaaacataaggcagcgtctatcaattgagaagagagtcagggatttgcttgatttggatagtccctctatcaacagaagtttcatagccactgttgggaggaaaaagcaacagtgaaacatcagagggggaaacagatttactggggcatagcaaatcctagtagggtttaagtatttcatgggatcagttaattagtaagtggcaagcttaaatgaccgttcccagaaatcttacctaacatacagagctgacttcccaggagagaaacatattttcctttggagaccaatatctagttttcaattattaaaaagtagaaaaatatttataaagcacatctttcaatgctactcttgtaaaataatagattcttgcaaatatctttcattatgcctgccactgacgtgctagagttgtatgcccttctagcaccttaaactatctcctggaaataatactgacacaaaacctagacttggctctcaccatttgctgggcatttccaaatgaacattcttttggttggaattcactctagcaaaagccaatttttaacctttcagctcttgcccaacccacacaccttgcaagggctgtagggtcccagtccacaagtatatatatatacaaattctttatcctttattcatggaaggaaacattctggctcctttacaaatcctttatagctcagaatttcggtttaaagtgacttttgaaatgaaggcagaattattctctgtattttttgatgctgctaagaaggaatttcctcttgcaatcaaaaagaagtacaggaaggcaatggagacaataaaccaggattactggagatggtgtttcccactgagttgcagaaggaagtatttgggggtaagtgaatggatcagatcataaaagtctatgcagctgatctgaagaacgtagattctactctaaataaatggtgaatcattgatggcttggggaatatgaactgatatgaaaaaaatatagggaattaatctctcagcagtttgccctatggtgggaaagtctagaggcaagggttagtttgaaggtggttatactcatgttagtgtgaggcactaaggttgggtagaattcgaagtgagagagaagaatggatgtgagagatgtgtagtagagaaaaatgactagacttagtgacaagatgtaagtgacaaatgaataagacgtggcaagactatgaaagtcctaagaaacataaaaacaaactggtagaagatatcttacaggcaaattttggcatatggaaaaataatgtgttcacactaccagtctaggtggactttgcatgtatgtatgggaggacaatatataacagaggtgactacctcctttatactccattgtgttctgacctttcccttgttttggttaaagccacgtgagctttagaatgggctaaatatctatagtgggttgaatagtgccccccctccaacaattcatgtcaaccccacacctcaaaatgtgaccttatttgaaaattgggtcttttaagatgtacttagttcagatgagtcatgcttgattagagtgggccctaaatccaaagactggtatctttgtaagagtagaggtgaaccagatggatgcatacgtatagggaagaacaacatgtgaaaaacagaagcagacatttaaatgaggcagctataagtcaagcaatgctaaggattgctggaagcccccagaagctaggaagacgcaaagaaggatttttttccctagagtcttcagagggagtatggccctgctggcaggttgatttcagacttcaagcatccagaactgtgagaggataaatttctctcattttaagccaccgagtttgtggtaatttgttcctgtagccctaggaaattaataacatatctgaactacagcaaataataaacattgaaccatcagtatgtgctagacattgtactgaatactttattcagattacctgatggaatcttattttgctgagatgattgtcatatacttttaaaatgaaaacactaagactttgaggggttttataaacccaggtcatactggtagtaatttttgaaaccaggattcttaaaatatcagttggacttaagagccaccaagcaagttatctctcagtcattccatccactgctgagcaattcccagaaaatgtattttcagctttaaaattctcgaaaaacaaaacaaaacactttttgttgagttcagattcatcaatggatcaaggattcctaacccagataatacttcttgttcctatgtttagactccttggtcttctgtgagcctctgagtctttgggcattacaataacttcattttgtttccatctatcctaattctttaggctttggtatctaaagatttttgtaatctctaaaattattttacccagggacataagttgcgtggatggtttaaaatacacacacttacacagatttgaagtcttggtgaagcaatatgcaaaattgtaagcttttctaatgattcttcttaatttattataatgcctttgatggaatgcaaatctgcaacgtggaatttctgctgcttgtaaaagaataacattgctaagtttaatttttacggagaaatattgacagcattgataaaagcttaaaaatagctttattgttatagttgtatatattaaaggtgaatgcattgtcaaatgtccaggtcactcacaatataaatgtgtatgtggtgggacccatacattggtggttctgtaatccaatcatagaaaatttttactgattaccaatttccatattctgtcaaatgcttcaaaaattccattttacatttgcatatctatttgtttcagatatttcacctatgggacttaaagtttctgaataggtcagtgaggcagaatttcctctttttgccctctatctctgacttgtgtttggtgctagaaaaatgcattaattcgaaatacagaaaaaaaaactatttattgagtgcctactattgaccaggtattattttagatattgaaaatataacattggaaggagttcagtgcatatatgcttatatattattatatatcaatatacatgattatatataaatttatcaattatattggaaataccaggatacaagagaaagagtaaaacaaaattgtagtaggaaatatcttgtagataatatcagtgatttcagatctaaactttcatgcctcatgttttgaggtctaacacactactgccccaccgctcccccccccccgcaaaaatagaatgaaagctacaaatttgcaccacatatgtaattttaaaattttttagtagccacactaaaagaaaagaaataggtaaaataggtaaatggccatattttatttccaaaatattatcatttcaacaagcgatcattgtgaaaatgagatttttacacctttttcattctaagcattgaaatttcagtggtattttacactcatttcagactaaccacatttcaggttgctcaatagctgcttcaagtagctagtggtcactgtactggacagcacttatctaatgccttgattgtttgccttgtcttttccatatgaaatgagagtattaagtaattcatatctttttttcctcacacgctgcaaataaaaaaatgaggaaataggcaaattgttttctcaactattccaatataaaaacaaaatatagttatttattaaaaggtctttcttttaaatagaacaaaatgtttaaagcttacttacggaacatcagatttgagcacctgtagaagataataaaatctctgatatattctctttgaaaataattgaggaaataatattttctaacttcagaattttaaagagaaagcaaacgtatcaatctgggcaaggcttcaaagaggccatgatatgtgccttgagaaatcccttggccatcaccaaggggctattctgtctcttggagcggctctgcagaataattttaccgtataatctgtgactgttttcattccgatatcattcacatagagtcttagatgacaatttctctttttctagggaaaaatttagtactattttatgcataatgtaagttgtgttattaccagatttttaaaggaaataggtttttgaaacccttagtttcattttattcttgagttctgataagttgtatacatttgttaattaaacatgaccatgaaacatagcaataaaatctgaagaatggaaagaaagatggagttactttataattttgtttctaatattttgtaaaatcatttaaatataagatggactgtattcaatttcaagtttttattttggaaatgcacaaatcgtataaaatattaggactttggatccaggtcccactaatattgtgagtttcctcattatgaaatgggaaatactaccttttctgcagaactattgagaggatgagatgaaataaatatgtgataaatagtattgtgtagctattacagcaggctctcagtaaaggttagttatcctttcttctctaccacaattactgcttccttttgttttaaaaaattcaggttccttcttcaatctgaaaaacagcatgagaaacatttttcattattgcataaggaaaccaaaaaaagaaaaatacaaattctgtttaaaaaataattcacctagaacaatattctgtacctataatttacatagaaatataaatatataaaggagatgtgcaaaatgagatggatttaggttcttgtattatgactgagttcaggaagtggtcaaaaaattaaaaagacattttttgtaaagaacaatactgctctttgctaacagagtaatgaaaagataaactcactgaggaataaaatcataatcattatggtgttaaaatagatgatgtatatttttattaagaaaagtacaaactaaattgttgtttacaattattttcaaacatacctctaatataccagtggttaggatagtattttaaggtagttaagataaaatattatctctcatttaaattgcttaaacccccttcactaggaccttaaatgccccagtaggacatcttagcataactagatgttttccatcttttaattactatgactaattttttacagctgagttacaaaaccttgaaaataatgaatatggtgacacattcttaattataatggtgcaaacagcaccactctgatacagtgtgaggcttacattgaaaaggaatttccctggaattgaagctcctctgattgctttccacatcacgttttaaacaaacactgtgatgctttagccatgacttggttgcctaggatacacagttaatgtagccctaagatgctgctactagttaggctttgaggccgtgtctgtaagtgctgcacatagctgcttttaatacattagaaacatttatgtaacagggacactttgcggctgggttcggggtgggtagttgcagtttcattcatgagataaccagctgtatatttcagtagttacagtgaaaatagttatttttattttagtttaggttagtttttctgtgaaagaggcaaaaagtgacggttttttaaacaaatgcaaaattgattcagtgacctaattctaagacacattctcaaagaattaaattttcattgttgaagaactggaaaaggtaactagctaaattacagtgagtcatttctacaagcctcttcatttgatagtgacttttattagtagatgtttatttagtctgtgtggtaaaacatatcagtttatttttattaagatatttgaaagtttcatgtattataaaattattatgataataaaaataaacattagcaagataatgtttgtaacagtagttaatgagagtattggtgatgaaccacagaaatatatacaaatatggtatgtacagattataccttttatatcaaaaattatctttcaatttttataacagtacatttttaatgtttttggtttaaatacgagatggaaatataaagctggttatacattttagcaaaacaacttaaatctggttttaaaaatcagtagtcttcttgcttcattcctatgaaaacttgaattgtcttcttggctgattggagttgttgagtgagtgggaagatccaatttgaaccagcaggtggtgcttgagttataaatgcatttagaatagatatttttttgaaaatcttgcaaaactttcaggaatggttgttcttattttctattttataggggtaattacattttagaaggaaaatctcatttagagcttctgaattatcactggaattgataagcttaatgccttttcattccttctctctttccctttcccttttctctaatcattgttcccttttctgcagtagctttcagcagctgtactgtcagggaggaaggatacactcttttctccacaacagagggcctgggtggtgaaagtggaagatactgttccaggagagcttcaggcatattgcctgcaagtgtaccactttttctcctgggtaagattcaaggaggttcctaacttcaccttgaaatcttggtgcatgtttatgacaccacttttcaagttcactcttctgtatataaaccatttttgctgtgtattagaatgcagctctcttaatagtgactaatttattcagtcttcaaaaatgcatatggtcccaaaggtaataaaattatggcctttgacatttgtcacgggggaggaacactgtttgtgtaaaaattcctgcaaaaaagcattgtccataccaccaaattcaacaagaaaataaaaacattgtttgatggatagtgcattttcagtttagatgtactaaatctagtgaatgagcataaaacctaaatgactaggttttatgtcatttgacatatcaaatgacaaaagatataatattaccggttatctagtgttacttctttctgtgagcacatcaagtagactttgcggttatattttaattattaaatactaaagctaatgaaagtcctggatgtctgctattcctgcagaaataatcagaaagcatcttataattacattttttcattttaggaaattcctttattggttttgttaataacatttggttttataatattgatggctttagaattatgatcatgttaaggccttagagcctaatttatttggctgatcacatttctgacattttagttcaagataataaacactgtatattcctaaagtgacatgcatgttgtgttttcagtctattgagaattatatcagataattagattctgtggataattctattttttttttttttttttttttttttttttttagaaacagggtttcaccctgtggcccaggctgaagtgcagtggctcaatcatagctcattgtagcctcaaacccctgggctcaagtcgttctcctgcctcagtctctcaagtggctgggactacaggagtgtgccaccacagccacctaattttttattttttattttttgtagagatgaggtttcactatgttgtctaggctagtcttgaactcctggcctcaagcaaatcctcctgcttctgccttccaaagtgctaggattatgggcatgagtcactgcacctggccttattaattcactagtaacaagcaatctgaataaatcacatttttccccttaagaaactctttttcttctatttttcctcagtaggaattttccctgacaaagttaatatcttcaacaaattattgcaattgcttttttctgaactctgactcaaagtgatcaggacaattggtattagcaacggcagaataaagagcatggaataatggatcttttcttagattatgtacaggtctccatctttatgactaatgtggcacaacattcttctctgcaaaggtttttctttttcctttaagaattaaacttaatgcagtatttgtcagttataaatccagctatgcaaataagggtccactaggactctgaagaagggaatgaacttcagttgcccttatgagctctattaatttgcatgtccatagtaatattccagtttccaggttcctgtaactatgtatgggcataagatacaaaaagtaagatgattcactcaaattccaactactgttttaaaaagtaacaaccaaaatgcaaagttctagcaatatttagtccaaaaagtgaatattttgttgttttaatacgtgggagtttattttcattccttttctcccttgcacatggaactactgaaacacttttattttttcccagtacatctttggccacttgaatttatagagaagagaagagcaatgtaaaatactaatgaagcaattctttctcacatttcagactgctgcaaatcaaactcaaaggattaggaaaaagacccttcttacaagtttataagactaaaatttcttactggttcatgaaatacatttaacttctcattcttctgcaacatagaaagctgttgtcagctggctgatttcttgcataccaggccaactcttctgtctcaaatctgcatagagataagtttggagaggagcagagtccctttggggatgaaatttgcttttgctatttttgttattcctttttcacaggaggctgtgtaataattttctgcctagggtcttgaaataacattaaagattgacaatttggttagacttgtcactcttagggccaaagttgactcatattgcacaagggactggtgacattcacataatttttttaaaataccttttgcatataaatattatttttccaattacaggtggcattttgaaatgcttttttgtgttgtgagtcattcaaacatgttataaaaatatatattttatctttgtatcttcatgctttccttgagggtgattttggtttttggagtagctcttagaaacctctttctcaggcagacaccaagcagatggaagcacagaaaagttggaagacttcatgtttgggaggtaggcacagactgaaggaagtggatgccctaggttagagacaagataacagcattgtgagaatagagtaaaaatgaattcagcttgattcgtttctagctttatgttggctacttaatacagtatatagaagtgagaatgctttctacctaccttcttttctttctcctttcttcctttctccacttcttactcacagaagtgaaattgctgattgatttctgtgcgtaagaaaggaggaaatttttcccgtcccccactctccttccaccagtcctacaaatgtgatcactaagtttaggaaaaacatatgcacagtttgtgtgtaatgttctgggaagcatgaagtccaggggaatatgctttacagatggctatgcagaaccaatatcaaaaaaaatggaggggaaatataaacatagaaggggaccagaacatagttgtaagatgagattcagccttctgacttgttttttatttctgaacaaaaattgttcctttgtgacttctgatgaagtcctccatctttttagaagggaggcttggagagggttgcagtatgagaaaagagccattgcagataaaaaaaaaataattttgtcttggaaattcaagtacctacaaaatattaaaggtgctagtaaaccattaaagtgtaaaataaccttaaaatctaaacccaattcacttacaatatgattatgacttcaaagtagaaatatatatttatatttttcatatacctacccactaatgttggccaaaattgatcattattgataaattaaaactatatacatttgcataatacctctgtttaattatgagcaatattggtgcagatagtttcaaaatgtagctgagattttaatggtggcagtaaatcagagatgttctacttattatttcattttacctactctaaaatggctgataatttttacaaagaatctttctaattatagtaatattactaaacagaacccattttatttagtagatcacatgataaatgcaaaagcaaaaatccactggtagtttatttgtaatttaggtcttaactacctagagaaatagagtgaacatgtgtcacttgagtttccacactagacaacgaaagacaacttcctgtatgattgctaatataaagcctcctcactaagaaaaaaaaaaaagttttattgagatttaatttgcttaccagacaatccacctatttaaggtgtatgattcagtggttttaactatattcacagagttgtgcaaccatcaccacaatacattttgaaaccatcaccacaattttcattactcctaaatgaaaccccatacctataagcagtcactacccatttcctctcaacccctcacctctagacaaccattaatctgtgtctctatagattgcctcttcaagacttttcttgtaaacagaatcatatgatatgcaaccttttggcttattgtgttagtgtaatgtttttaagattaactcacatcatagcatgtatcagtacataattcctttttattgcacaataatattacattgtagggatatactacattgtatttatcagtgtcagctgatggactttgagttttttctactttttggttagtataactcatgctcctacgaacattcatgtacaagaatttgcatggacatgtttttatttctctcagattgtctacttagaagtaaaagtgctgcaccatatgataacccaatatttaacactttgaggtaccaacagactattttccaaagtggatgcatcattttacattctcaccagcagtgtatgaggattccaacttctctgcatcctcaccaacacttgcttatctgtctgttttattatgggcacttaatgaatgtgaaatcatatctcattgggttttgatttgtatttccctgaaggctaatgatgttgagaatcttttgtgtgcttgttggccatttctatatcttctttggagcaaagcctatttggattctttgcccatttaaaatttttttttaaatttttattattgaattgtaagaaaactttatgtattctagacacaagtcttttatgagatacatgatttgcaaatattttctttcattttatgtgtagtcttttcattttctttgttgtaatcattgtaatacaaaatttttaaatttttatgaagtccagtttatcatttttttcttgttatttgtgcttttggtgtcatgtttaaaaatgcgttgtctagaccaaggttgtgaaattttactatgttttcttctaagaattttatatgttttgtcttctcatttaggttcataatctatttggagttaattttgtgcatggtgtgaggaaggagtccaaattcatttttttacatgttgatatccagttgactcaggaccatttgttaaacaactattctttccccaatgcattttcttggaacccttgacaaaaatcatttactataaatgtgaaaaggtatttctagtttcttgattctattccattgatttatatgtctacccttcttccaataccacacaatcatgattactgtaactttggggtaagttttgaaatgggaaattgtaattcctccaactctgtttatttttgagatcgttttggcaattttgggtcccttgaatgtccatatgaattttaggatcagattgtcaatttatgcaaagagagtatctggaattttgattaaaatgtgttgaatctgtagatcaatttggagagtactgccatcttaacattcaactgcaagaggcaaaaacatttgatattagaacatggaaaactataatttgaggtagcttaagataagtgacataaaagatgtacagtgaaacccccttgcagattaaaaggagaaggttttatccatggagaaagaaaaagactattcatggaggaggctgttcaagaagtatgacataaaccttgagttgtctaggatttcatcaggctgtattggaagagaggggcattggtgagaatattcaagatggcacaaacaaaagctccccaagcaggaactcatgagtcgtactcatggaacatcaaacagttcagtttagctagagaatgggacgtgtgaaggaaagtggtcaaatattccgctcgaataaaggagaccacattgtgggggccagaaaagccagcttaaggggtttagcatttacttggtaggcattgcagaacctccacaatattttgattgagaatatactgtaatactagcttgtaaaatctgttagatgaaaagcacatgtatctgtaaatattttaacccgaacaaaaggctaccaatgaaaggtccaggctgtgacaactaacctagtagatcctcttctggaaaacaaaaggaaacattgcttatcttgtcaacggaaggggtttgcttatattaattcaggatttaatagcaagctaagccatagggagctgctgtcataatgaaaaactccactagagtcctcctggaaaaggtacttctgatgtaaaagacctcagggaaaggtttctagagaatccataattaaatgtcacatcatggcaagggcagaggaaaaaaaatgactctatttggaaaatggcaaaatataaatgtctggtcaaaatattttcgtgccttatttaaaataaggctgacgttcttcctagtactctagagtttcagttaaccatcctcagtaaataaaccatttgttaacaaaacaaaggttgtaaatgcgcttctactttgcatggcaagataatgcccatggaaattcctaatttctgggtggaattctttcattctgagttgatggactggaaaaagcttaacagattgctgcactactgattcatttcctaacagacagtttaaactatattggggatgagatcattgtaactgttttcccattttccctaatttaggttatttatttaaaaaagaaagagtataggggagaggaaacaaaccttagtttaaattttggttgtgtagcctcagaagagactattaagattcaaaaatagataatccttccagatgggtccaactcattgcaataagaacataaaacataaaggacagtaaattagcacacagtacttatccctggagtctgccatatgagctaaccaatggaaattactggtatatatggaacgagacagttagttagaaggaactcagtgattttgtgctatattaagtcaaatcatacattagggataatagaaaaattatgaattctctgttatttaacactggattcctacattcatcacctgtttaagcaaattaaacagtaaaagaatggaccatattttgcacatagcacattgtaggatagtattttgcacagaaaaaataaggctcttttgatcaagtccagacctgccaatataaaacccatatcttggccaaagttctccctcatgccctcccatacccctgttccaaagaagtactgattagaaagagaagaaaataattatagacaaacagaaagaaaaatttgaagaaaggagtaaaaaaaattacagcgaggtttagaaagttgagaatatgcaaaagaaaagttatggtgacaggcaatgacatctaaaaggaaaatgtgcttgtttttgctcacaccatagtttataggcaaggaagcaatcatgtgtttaattcttggatgatgaaagattttggaattgaaaaataaaaggaaaggataaattgttctcgaaaactagaaaagccatgcgtaaggtggagaaggtaagggcttgctagcactgacaaagaaggaccaaatgaaagtagatgagatgtgaaatcaaggagtcagactatcttctgtgacaatttcaaagcctacagaaaaaacagctttgactttataaaacacgcaaagtattattagcatacaaaattaagcgtttatgaaaactcttagcatataggtatacaattagttatcagaatgcctaaatacatggaagtttgatttagtcaacattttataaactaatagaacctaaagaagatagttaccagtacataagtattacatcttaaatattgttagaatcagtgcagtaataatccattaacttgctgcttggattccattaagtggtatcaattttattctgttgcctagcatggcatctggcacagagcagacaatcaagagccatttcttgagttaacatataatttctagcccagggccatcatagaaaaattgatattatagacttaacgcccaggaaatatttcttatatacctactatgtgccaggtaaaagggacacactgatgttccagggaactgatagtctttgaagtggcatacatgggctccttagcatcttcctactaacttgaggtcttctatatcagctttctgggtttgtttttgtttttgtttttgagacagagtctcactatgtcactcaggttggagtgcagtggcgcgatcttggctcactgcaacctccacctcctaggttcgagtgactctcctgcctcagccttccaagtagctgggattacaggcgtgcaccatcacacccacctaatttttgtatttctaatagagatggggtttcaccatgttggctaggctgatctcgatctcctgacctcaggtgatccaacctccttggcctcccaaagtgctgggattacaggcgtgagccactgtgctcaaccatgctatatcagctttctgactcatggaaacataatcatgatccagctaaggaagtacaagttacaaagactgagaaaacgaagaaaacttctgtccctgaggaaacagaatgtgttcatacactgcgtccccgtaatgtacgctcctttgttggaagctggccttcccaccccctctaggccctctggtgaataagcaaaaccagtctcactctaatttttacatcaactaagttgcagaaatgtcagttcattctgtgatgttctctatttttttctgaaataagatttgtttcttccttccctctgcttttccaggaatccattcttctccttctctccaaggataactatactacaatttcttaagaatgtatagtatatctattttccctttacaaggctgcaggcagttttattttgaaactaaaactcatggaattatcaagaaggacactggggaagaagagagagggatgtgattaggagaactcagattctcttttaatattagggctgatgtcgctgtactaggtaataaatatgtaaattttctgtttgccccaattgattaaatgtaattaacacctgttctaaaatactttgttttccttaatgaaaaaaagtgaaattttttcaagcttctactatattctatacattttatatgcaatgtctcaacctttattatgatctttttaggtagcttgtatattcccatgtcatagatgaagaagctgagtgtcagaaagattaagagatttctttaatttctttcttatgcctagatatattatagctatattctaagcctttatattttccttcataacatgtttttggtcatttaagaaaacaagtatttcatttttatatgacattttgatgcaacaaatttcccctgagagttcagtctacatttcttttttactttcgatttgtgctagacatttttgcaagggagcaaaagttgtaatttgttttccatgaaagtggccctggttttttcatattagttgatgttttagggatgtgtttccattgtttatccctaagaaaagcagaaaatacatttctttcatgctattttgtctaagttattcctccagatttgagggggttgtttgtattatgtctataaaattatttgcatgtacttgtatttaaatacatacacccataatcttcaatatagagattgcctggctagacctatgtcttaataacaactgcattgctacagaaggccagtgtaggcaattattcgctttcctcaatatgctgaggctaccaaaacttgcatggaacagctattgagacctttctcttgatggaagttttctactgttgacccttaaagactcataataaactcacacttcagcaatagatggtaacagttaagttctacgttctaaatttgatttatttttatcattaatgtttgataatggctttaatatttaaaatcatgcaagcatctaacaagttgtaacatgtacggaattctgagtagcttgtcctagagtgtagtctaaattatgttttctgtgagaatgatttcgtagtgactaagcaccagcagctcaagggacaaatacaccatttactctattatattatattatattttcttctttgaacagctgctacttattattcatactacttcagtgtcactgttagtgctttctactatctaatatatcacagcatttgctcacatttttgcctctttcacatagaatttgagaagaaaagaaaaacaggacattttctttttagaatttcctctttttcttcagcctttgaaaatggtattgctaacattctgttttctatgtctaagtggaaaatgtttcatccttgctgaggttacagggatgaaataacagtagcagcaagctactggcctttcattggacagttcgttggggagggagtggggattgttcaactgactctggaactctggatggggttccccatctctccctcagggttaacttcagtccatataattgctttaactgcctgcagagttcaatgttcagagacagacacttggatttcatttattctaagtttaatgttttatacagtaaaacatgtcagaggaggcagttgtcaatactccaatttctgaacactacatatcacaactttttaaatttaaaatgactttataaattcagacaaataactcattataaattcaaaataactagttagaaattcagacaaatttctgttacataaagatataacatgatatagtaagggaaggtaaaaattgcatggattggggccaaactaatcaacatttatatctgtgctttatccactttagttatgaaacctaaaaccattaattttattctctgaaattcaatagaatgggaataagaagattcaacttgaagggttgtcatgagaaatatataacacatcagaacaatggatgctactcaataggtgttcaaaaagtgtttttcttcccttccttttcttcctcttcctttacacaacatttattgaatgcccagacactatgcttaatttaaggaggcaatgataagtaaaagcagatgcactctctgctcactgggagcatatttcctagtgaggaaaactatgataaagaaacaatcaagaaaatagtgagacactctgactggagcaggtgctgcagaaaggagggacagagaacagcatattttagaaggatttgaacctgtcacaaagatctggaaagacttctgtgaaaaggtaacaacgtagctgagatccgagagataagtaggagttaaataggcaatatcttcactaccaccaccgttagaaagcatgattgtgtgaacactaagcttcctttaattgttcagagaagtaaaacctgccaaaaattttgtaaatcattaaattttgctatgtatcacatccttatctttccttctccctttccctatgatctcacctttggtttcttgtggaggccactgattggcagtggtactaaaaaagctgttatttatttattttttttttgacatctttgttgctctgctgggatggatctgatatatcttattctgctaccgtgtataccaacagcagaatcacactgatcactctttgtccgcactgtcaacttcagttgttcccaacattgttaatagaccgcctatctttccttgcacttaactgaaactaagaggtactgttggatccatgatgcacattcttaatggctcatccctaaccagaactgatgagccttctgtatggagcagaccgtggcaaacaagcacaatggcagttgttttcatcatctattgtgaagtgtctatagaacttagtgacttgatgtcagctcttgccatattttctgtgctcagagatgccttgcttgtgactaatgtcctcattacagattgaatgaagaaaaaagggaaacggagagcagatgacagccttccccatccactgaaagaacattcttttcctttcttatctccatgaactcacccccaaaatgttaccagacatcatttttttaaagtagtagatccttggagatcctagtttatgctaattgcatcagcattaagcaatttactaatttaattaaataaattaattagcttatattttttacctaagtacatctaaagcttttttttacgagaaagagttggttatttatttattttaaacagacaaaagttcaagcaaacttacaaacacccgtgtagtatcagtaatgagaatagggaggaaggtagtatacattgtttgagactgaaaggaattttaattgatgatcatcagccccacacctaacattttatagatgagattatatggcttgccctagatcacactgcaggtgtttagggaaatctccaagcatcaggctaggtgtttggatgcaatatgccatggctattggtggcccagttacctagttccagggaacagatactccagaaagaagcggtctgatttctttgtctttattttgacaaaggataatttgaatcatggactattagttcaaaaggaatttcagataaccataagttagaaacattcacttcacagatagggaaactgaggcttacatcattgcaatcacttatccaagtgtgtaactggtttgcaatcaggacactggacttactcaaaactaccttagtgttcactgaatgccctctctaagtgaggcattgtactggacagtagattataaaggtaattataaggattttctctctcaggattgacagcttgttttcctggttcctaggcagcagaaaggaatgaacagtttatacccacctattaatcttaggctgcgcttggtggcatgcacctgtaataccagttatttggcaggctaaggtgggaggagcccttgagccttggagttcaagatcagcctgagcaacctagtgagaccctatctcaaaacaaaaacaaacaagcaaaaaaaagttaaaaaaatttatctcattttatgggtatccccattaaaatatttcattttctgttcttattctcaagataaagtttaaaatgcttagctagactctatatgaccttttacacttggccctttgcttcctaacactcctgactcatctcctaatcctctctcctccacttactgacctccagtcattcaagccttgtcccggtctctagcttgtatcaggacttccttgctgtttcctctaatgagtcagaattcgagtctgagtcttaaagcccttcacgaaaaccattcttgactgtctacactagattaagtctgatttgtcacatgctattatagaacattctgacatgtcctctacagtcacagatataaaaatatagttatttatgtaattatttgttcaagatctgtccttgtcaccagaagataagtaatctccatgaaacaggaatcatctttttattcaatataacacctttaggctgggggtgctaatctcagcactttgggaggctgaggcaagaggatcacttgaggccaggagttcaagaccagcttaggtaacataacaagatcttctccctactaaaagtatatatacataaaaaattagttgggcatggtgtcttgcaccttgcatctgtagtcccagctactagggaggctgaggcaggagaatagcttgaacccaagagtttgaggctgttgcactccagcctagggtctccagagcaagaccctgcctcaaaaagaaaaaattatatatacacacacacacacacacacacacacacacacaaacacacacgtgtgtataccacgtgtatacgtgtgtgtgtatatatatgtatatgtatatatgtgtgtctgtttttgagacagcgtctcaaaacaatatatatataatatatatatctttaagtatatatatttaaatatatatatctttaagtatatatatttaaatatatatatctttaagtatatatatttaaatatatcttatgtatgtatatatttatatatacttatatacattttataatatgtattttaatatatatacttaaagatatatatatacttaaagatatatatatttaaatatatatataatatatttagtacataaaacagagcctggcacatatttagaatatcaaaaagtatttggttaacgtctgcataagtgaatccatctttcttaggatggtttgtccctgcattgttgattggcaagcaaaagtcctgttcgaatctcaagggtatattttttcttcgcaatcttttccacattctttaagagatactttttatgcacttttcacttagtgacacatatttcctttttacctgatgactaagattgagtattcaaaaaggaatgatatactctttgttccaaagcaattgaaagtcttgttcatttagggactagggtatatgcagccattggactatgatgttagagttttaaaacaaaattttctttcttcttcttcttgttcttttttttttttttttttttttttttttttgagacagggtcttactctgtcaccgagtttggagtgcagtggcatgatctcagctcactggaacctccaccacctgggtttaagcaattctcatgcctcagcctcttgagtagctgggattatgggggtgccccaccaccatatttttggttgagatagggttttaccatgttgaccaggctggtctcaaattcctgaccttaagtgatctgcccatctctacctcccaaagtgctgggactataggcatgagccaccacacctggcctgaaaacatatatttaggagcgtaaaatctagtaaatattatttgttgatgtagtacttatccagaaataactgcattgttttacttttgttgtaagactcaagaaagattttatcaagaaggaagcaggtaaaagaaaatttcaagtgtggaagatagataacagttgatcccttagatttactcttgctgctgacttccttgtttgtacaggcagaacattacatctgaacacataggggcagaggaagttgcaatggagaaatactatctactgggtatgtgcagaacaactagacttctgatgacagcttctgggaagaaaatgttgtaatgggaaaggtcttccctagagctgtccacaatgtgtgtaagaagaaactggttggattttaaaatctctgtataaacatacattgtttgccattcagtatctaaataagggaggatgaaaaaggatgaatgcaagaaattggcctcatggtgactgcctaatttacatgttatcacaacatccagatgtaatataaacaaacaaacaaaaggtttctccataacatcacctgtaagttactgaaaactgcttgtctttggtcttggtcttttgacttttcatctggagtattcagctatgtagatatcttcttatctatcagtttggaagatttgcatctcagtagtttatctgaaagctacatttgtagatcaagcctactgtttgagtaaggttgcttatttatttgaagaagtttgggttgcagcaaggtgaaactgattgaaataataaggtggctacaccttgatactacccctggatatagagaattcaggttgttagtggtcttatgatttcaaagtaggtgcgtcattatatgcacatagcatgactgaattcattatgaaggaaaaaaagcagatctgttcaaatgcatgcttatgtctcatttgcattttctgtatgcttgatgccatcatttatcggtgaatacagtgaaaatataaggcagagaaccctataatttgattaagtgtacaaactatcttgaaaaaatgtttatctcactcacgctttttgttttttagcctaaagacctttttgctataacttagaaaggaaacttagcataaagccacagtttaaaataacaagatgatttatggcctgctagatttccaaagtcattttttatgatcaaatagttcagtcaaaggactgaacaggtgtcaggagccctattggccccaggcagatcagtttgtctttctaggcctcagtttcctcatttataaaatgagaagattgttctagcgaaataatcttgaagatactcttctaaatataataagcattttttgtttggttacatgatgtgagcatttggcactttgctgacaaatttaatcaatctagacaaatggcttgaatgccaatcaatcaaaccgtaactgttaatttaattaactagaaagactccccttccaaaataaaaggtcagctttccagtttgaaacaatatcagagatctttattccacatgtagaaatcatttccttaaatagtgcttctaaccaaaaaaaaaataatattaacatatacacatacacattgtaaaatatttctcttctaacaaaaattattataacctattaaacattactgtcactctttagtgatgactaatacatattaattgaaagcagaatgaagtgctcttccattacctgattttctgggaataactccctttgtaacagggtgactatattacattccagtcttcctaaagcacattaatttgggcagttaacgttcctggtaattattggatacttttcacttattcactctcacgtgaaggtaaacagttcccaaactaagtaaaagtgtgatgaagtttgtcccctattcatgcctctgtgcttttcctcttctggtcagaaatttgtccagctggaaatttgcagacctaaacggagttaattctgttatcccatcataggcttccttccctggtggatgctgtcctgccctgattcgccctgtaccaaagcaatcttcctcagctccttatctccttcatataggcagatctaccctctcctatcccttatagccctgctcattattttggactttctactgaagcctttttcatgttgtccaggctatgtgactgtattttacttcgtgttagtgataatttattaccatagcaacactttcctcatggcttacaccatacccttatgattcctgtgtttgttttaaagtcagataatgaagtttctggtgagagtatgtcactgaattacatcacctttgcaaattggaggttactgagctaagatagaaaactcatttcctttgcattgtcagagtattctatttggtatttaacaaaatgtaacaaaacattagcttacagattgaatggatttgccaattttctaagaacttgaacacaggtacaagtagtagtggatatgtatcaaaataattttatgtctattgagaattcagaatgcatttctgtgcctcaaagtaatcattatgcacactaattattgttgtacactgcagaaatagtggttagtagaggtttcttttgatagaaaggcagataaatcaacttctctgtcattaattctttagatgatgaataatccttttatgcaaatgcttgtcttcctgcagtgtacattaaggtctaaactccagctctgttatgatgtgtggaagaaaattcaaagccgaaaaagttctttgtaatgcacttgaccctgggatcattagaacatttcagcacaacttaactgctggtagaaagaacagtgctttagaagagctaagtaaggtagttgtatccaaaaaatttaaaaactcacattaaactattaccctatttctgcagggtataataggaacacatttcaaaaaacaaataaaaggtcaggtgtttagccatgtgacaaatgtgttttttgaaactgtggattccagtcacaaactatagaagtatagcttcaagttttgaattatgattccagggtcacctgagtaggcgcacatctataataggactatactagttaagataatgtttgtgcatagatacactatttgctttttttgaaaagaaaataactgatataatccagtttcaaatatcctaagaattcttcatttccacctgttccttgccatggaggatcatagaaacatatagtatgtttatcaattatttaatatataaagatatatagccgtaacttgttgatttaatctaacattgattaattttctcaaacttaacaaactagttttacttcaatccatttttatttgccatgtgttgtaaaagtaaaaacatgtgagtatagctattatttctccctaaatataagtgtggtggatctatttacccaactcactcaaacaggccttaagtaagttacctttggaagtgaggccttgttatgctaataatcagacagacagagtaagacagagatttccaagcaaggatgaacagtctagataagcaaatcaacaattttgttgtgtacaaggaaagatgagaatatccttaaaacagaataacagcacagcaaaaccatagaatgtgaaggtttaagggggcttgggaataaaatatagtaatagctactaagcactactccagacactatgctaagagctgtacctatattatcttatgctattcccacaatcatccctcaagttaagtttacttttcctattttacagataggaagctaaggattaaggagttaattagcttgactcaattgacacatctagaaaatcacagagctgtgatttgaatctttttctgactctgaggcctgtgcttgttaaaacacaatcttaacatgagtggtttagcacagcttaaggaagaggcctctgagaaacatggcagaattgtgaactctttaccaggctgctgataaaggcctatggacatatgccctgtatttgtatttttctgattctcaaaattgtgttcacaaatgtaagttatttccaggattattgtaatgccaaatacctcttctgccagacttctgaagggcaaataacaaatccttactggtatcttaaaaatatagatttgtattcttgacttcttacaatatgcagaatgtacccagtgtttaatatgccagatattaacctcctgaacataccttctttctttttgccctctgccctatatcagttgtttacacccactggcataccttacacctcgtcataagcagagatccctccctgatcttgctgtcaaggattcccctctctaaccaccagctgcttttttcccagctcaccctcaatgctccaaacctaacatattcttcaatccaacccagcactgtagttgttgaatcaaccaactcttccttatttatcatagcattaatacttctttcctttgtttaaaaagcttaaagtccatctttgttattttcttacctatagctggacttaattcccttactcctctctctttctggaacttgattgtctccttctccacttactacactaaacatggcaggaaaactaaaccacattgaatgggtcaccactttaaatatactctcaacttaagtggttttcagactgcccagtgattctgctactgttcacctgtccattctccttctacttcccagtctacttctccctctcaaatcttcaacagttcttccccagtcctcaacctcagctgtttactttgcttcccaattcagtgaaaacatagaagcaattatagggaatgtccactctcctccgatacctaccatctaccccatcccttcccttatactccaagaaaggccaaacccttgacttgtatattagataccatcctcttttgccaactcatggacattgttcaaaaacattctacccacccgtcttttcagtaccatccacttttcactgtctactcagttgttttcgtcagcatgtgaacatgctacaggtctcaatccttttatttgtctttaaaactacactcattgccttattcatttcatccagactcctggctttaaatactgtctatgaatttataatgcttaaatttagatctctgctgcaggcatctccctcaattaagatctgaatatttcactatctattctccaactctacttggatatccaatagtcatctcaaactcaacatacccaaactcttctttcttctatatttgtttcatggtcttccctgtcttggttaaagcaactccaaacttccagtggctcgggccaaaacacttgaaatcatccatgattttcatcttcctctcatacaccatatctaatttgccagcaagttatgttggctataccttcaaaatatatctggaataggctgtcttcctactaaatccaccctggatgaaaccactgttatgtctcgcctggatgaaagcaacaacccaaacttttttctctttctattcttgtacctctagggctattatcacttcaatatccagagtgattatattcaaacattagtaagtcatatcatattatctcttgccttaagatcttccagtcactctgtgttcatccagaataacagccaaagtctacacagtggcctaccatgcctcaaaaagtctagcccctgttgcttctttgagtcatctatgttctattctctctcttcttcagccacattagtcactgtcttctcattctacctcaaagaagtcaccctctaccctcagaatctttaattgctgttttctctgccaaaaatgctcttcccccagtatctacataatataatataataataatataatataatataatataatataatatctactcagtttcttcaagtactttttttttctttatttctttcttttctttttttttttttgtttttttttttgttgttgttgttgagacagggtctcactctgtcacccagagcggggtagtgcagtggcatgatcacagctctttgtaacctctgcctctcaggctcaggcgatcctcgcacctcagcttcctaagtagctggaactgcaggtacaggccaccatgcctggctaacttttgtagttttttgtagagatggggtttcaccattttgtccaggttggtcttctgaactcaagcaatctacccgccttgggcttccaaagtgctgggattacagagatgagccactgtgcctggacttcaagtgttccttaaaatgtcctcatattggtaaagccttctctaactgtactacatgaaattgcaatgcccatttcacccaatactcctcattcttctttctctgtttcatattttttctgtagtatttattaccatctaaaatattacttaatttacttatttacttagtgtattatcaatatctctactaatagttctattagtgtaaggatttttggctatttgtgctgtatcccctgggcttagaatagtacttaacatatagtagacactccataaatatttgatgaatgaatgaatacattggtaggaaaatgaataagagttctgtcacaaatccgactaatgcagaaaaataaatattcaaatacattgtccaagttttaacctaagatagtactgaatcttcttaaagatctgtacctacactaatgttttccttcttcttcattctttgctttcatatcatgcatttacatgtccagaaagtcactatttttttaccactttttatgtcaacactccattcattacactttatttaatttatacaacaattccagtatttgtcaccttcaatcactcatcacagagtttaccatgaaatgccatctaaaggttaaagataggacttgaaatctgtttctgaaagataaaactatcagatcaaggtagtgcttaattgtttaagagaagataattgtgtaagagagaacatcatttgaaacattccctgacaatatttttcttagaaaagctttaaaaatcaggaaaaattttgggtactgtttggcaattttgttcagttaatatttgcaatatacatattccatttttttacaaaaattagagcaaaactgtactatgtgtattatcaaggtttaccaatattctgatgttatattggtataatattgatgtatctattgcattatttaatgccaaatctaaggtcaggaaacaaattattattgcatcattcttatgattgaatatgatctttcttattaatgagtttacagaaagatatggtgctaaaacttacaaaatactgctgagacatcagtttgcaatatctatattttttaaaggaaagaaatataatttaaaataattgcctatttcacttgacatttgacatgttgtaggttctttgggagcaattttcaaggcaggcccatgtgacttatagatgctgggatgggaaataccacactgacactagggctgcctttggagacagaagcaggcacataaagacagatgagtggcaaggttggagttcattcctcaaacacattgtcccagtctgagtaggtaaatgaaaatggcaagactaattaataattaaggagggagacccaaatcaagaatgcaaacataaagcgcaatgtaaagttgacacattttgtgttcctctagcacactcaagaaccctgatatcaaaggcatagtcaactgtgcccagcaaacatttttggggtgtttagcaaatttaagtgcattaacagttttccttacatatttctactgacttatactttaattaaaatgctgcttctataactaatgatgttatatattgattcaactggaagatcaattgtatcattggtaaaataggttatattacaaatgaaggcattttgcattatatatggtatttttatttttaattatactccttttattcaaaaatatcttcaacaaatagagctacagagaagtcttaaatttcattcagtaattccgttgttaatgatatctacattaatgttttgggattttacacaatcacatttacacattttttttgtatccaataagataaagcaaataagcaattacttttatgtggtaagacccatgaattttagtataagagaaaaatgataaaaacataaaaatcaaagtataaatttttaaaagttaaattttaatagtaaacatcaatataaatttattttatttttctcttcaaatacatatgtatcttaactttgaagagaaaaacaagtcatggattcattagttaatgttgatatgaatcaaaataattagtgtaagagaaagaatatggaagtataaaaaaattaaaccttttcagggtagagagctgcaaaattataaatataatcatgaattcttcagtacatgtgtgtagatatatatatgcaatatgtgtgtgtgtaaatgtatatattccagctgtgtgtactaaaaaaggcttagaaatagtgacaaagcagaagcagtgagcataaaaattgcgtctctaaataccatttcccattaataggaaacagaacttcttacaaaaatggctgattacagatctgtgtcaagaaatgcacaaaatgattcagggacatttattttgttcagaaaacaaagaagatacaaagactaatggataaatgtaaaaaaaaaaaacccagaaacacatagaaatctatataaaacaaaaacctacggtagaaaaaaaaacaaatttacatgaagatccctttgactagtgcttttttgtgtgttaaaaagaaaattgactgatgtttatacaaacacttcaaataataaaaatcaaagagtctataatgatactaagacagagaaagccaaaacaaaagccaaacaacaaataccaatgcttcggtggcaactaggacactgactccattttctaaacattgtcaattagaagaaaataattatctagaggtgatgaaaccaatatcttcgttgtaaaagaattctgtgtgtaaattgtggaagatgctgcaactaagaaaaatggacatttttgcaatatctagtgataccacctataacagataaaatcactgatgaatgaaaccattggatgaaaggttaatgggaaatcagatatcaccatcttgatccattgtctaatctcagaatcacttaaagcaggaaactcagcattatgtgacatactgatcctatcctgatatgttggaagatgaattacacagaaatattaagaaatattcttgtaaaaaaaattaaaagttgtacctgaatctaatcatgcctttagagctaattgatagtttacaagaaacataggtgatggtggagtaaattaaattaaaccatttactatggtttaattaaactatgtaaaaaaaccacatacctttaaaatgtagaacattatagaaacaatctgactcagtttcttaattaaggcaattatagccaaagaaggtggatgggaaaagagggttataattttaaaaacttgatacataacaaccaatggcaatgtgcagatatcgtttatgtcctgattcaaacaaagcagcagaaaaaaaatggcactttggagaaaatcagagaaattttaaaatagtctgattgttagattatatgaaggaattatccttactttctttaggtgtgcaaatggccaagtgattatgtaaataaaagcccacgtacttcaaaattacatactgaagtttataatacgatgtctgaaactcgttttaaaatacattatttcaaacgaagtaataaaatacatgatataacagtgcccaaattttaatatttatctaacatgggaagatggatgctatgggctgaattgtgtcccctccccaaattcagatatgttgaagctctaagcctcaaggtgtctgtattcagagacaggacttttagaaggcagttaagattgtatgaggtcgtaagagtagggtccttatctgaaactattgctggccttataagaagaggaagaaacagagagaaaactccttctctccatgtgcatgtaatgagcaaaggctatgtgaggacacaggaagaagatgcctgtctgcaaggcaggaggagagccctcatcagatatggaatcagcttttgtcttgatcttggatttcccagcctccagaactgtgagaaataaatttctgttgtttaagctaccaagcctatggtattttgttatgagagccctagcaaactgagacaatggacatatggaaatttatatatttgaatctctaatgttatgtattttttaaaaattttcttgaaaatttctgaccatgtcaataaaacagaatgtgattagaatttaaattctctttttactgcttttaactcccagatcccaatccatctgatcttgtagctttcctgctaatatattatctacagtactttatagcttacaagagaaaatccaagctgcttacccagccagtgtttcccataattagctccaaatgaatctttccagacatgtcttgctctgacttttgtaacatatccttattcttcaaccaaaataaactttacatcgccaaaaatgcccccctccatgtatatttgtagcaattctttaagtgattctcaatttttacattaaaacttaaaaaaatagctaagcagttactatacccaattacatgaagctaaataaatgaacgcagtgtaggttctgatatcagttctcaatttttccttcctagggaactggaaataacccttaatcagtgtggctaaaggattgctttagaaagagctgtagattctctcctgtggatctcacactgggagccttgttggtgcatgggtatctcctaattttattgcctttattgataaattcttaattttgcacttaggtacttgcatgacgttcagcctatacatagtaagcattatttttcttctacatcccacattttcttccccctttctcaccaccttctttctcacatgtaccctagaatctcaattttaacttcctaacatgaatttttccttattctttcatgtaattaaatacacacacacacccaattttcatgtctttggtttaaaaataaaatattttatctatttttctatgcatcttcctttcactaattaacaactcatcatggaaatccctgcacatcagctgatagatattaaatgcatttttaaataattttataatattagcaaagataaaccataatttattcaaccattttcctattaagaaacattcacctttttcttatgtagtttcaccaccaacatggttcatcaattaacgtctttgtacatagcagtgatttaatctctatgggagtggagtcactgctatgtatgtttttaatttgaacacgttttcacattgctttcttaaaaatctgtgacagctatttctttgagcaatgtatgagagtactctattacatggagaatattaggcattgcaatgctattggccacgtagccatctactgaggcaaaaagccctattgcgtgattactttcatttatatttcccttacactctggggttgttcatcatacttccatgtaactattgccatttttatttgtagaatagctcgtatattgtttttctttggcccagttttctactaggatgtcagcattcttatcaatttttaaatcttttgtatataatacaaaatatttttattatctgcattatttttatttttaaattatttctattgttatttatctcccaaattgtcctctaagggctttattgttttataattacatctttaatcaactggaattgggtgacacaaggatctaatgtgttttcttttagtgggtagttagttgtaacattcacttactaaattagaccatccttttcaaacgaattgaaatacctccttagtgatccttacattccaaaatatactgtgctctatttctgaaccatgtgtgcttctctgcaagtggctttaaatttttgcattcctataaaatcacctctttcactagttggaaattctgtcgtcttgctctggggtcccatagaactttatttttactttgagcacatcctatctcaaattatagttgcttttatctatatgcctactgaatttcactgtataatctctgaaagaagaatccgcattgaatttgtctttgtatgcttcacagtttcttgagcaatttagaaatttatgacatggttattgaatacatgaatataattattcactaagtaaatatactaataattaaataaatattatgagaatcataatagtttcatacaattttagaaacctgaagtgaaggtgattctgttcaagacgtgagaagtttttattcttgttttactttagaagttcttgcgacagtgaatgaagttaaaccaaaaaattatatttatgtaatctctcaatgtgctattcattagtacataaatccagattacccttttatgcatagtttattgtactatatgaacatttagtaagtagctcagtctaatttagttttatttagtacctctttctaattaaagccatgaatgatatagataaatttatagatctgcaagagccaggaaactttgataatattaaaccaaatgagagaaaagcatataaaagacagcttattcatattctgccctcagtcacaggttttgagatgtagattttgctgtagtacaataaaagcaactaaaatgtctaactcattaatatgacacagcaactaaaatttctagctcattaatatgttagtatcacaaaaatcatcccagttaagtcagcacaatagagcaattagcagatgtttacctagagctacctacaatcatgcagttttaactctgggcctataacaatttttagagaaactgattgtggtagcctctgggtaaaataaaacaggaaattctgcttcatttccagctgtattgtgtagtacaatgagaaatgttgacggccgactcagtcttgccctttttgctataatgtctttgtactcaacatatagactgaatataagttagtgtgcaatgactttcaatacttatattaccatataatgctaaagaacactgagatgcagttcttgtgtcagaaacaacctaatttgcttgttctagtagagagctcaaagcccactggagtgacgtcttattttctcttctattaaagaaagaagctgtctccctggaggttggcaggggtcccaaactcagaagaaaggttgattagataagctgcgtttagtggctatgacagatggacatggagtcgatgggtaagaggtaggggagccagtgtccacaatcaagtgtgattccaaaatacagttcaactgaggtaaaaactgaaagattctgatgaggcgggtagattagcatgatatatagagcatcactaccttttaaatatgattatttagttcattttgggcagattttatgagatttcttattaaatagaccataatatttctgagatcagggggccctccattttaatagacttctttaataacctgcatttcctacagaaatatttcttctagtctggtagcttcaaatatcagtaaaatgaggaaataagaccttagccaccattatatgcgttggatgctctttttgttcttgtagcctttgttctctgatttaaacttatcaattgagacagataatgcagactttttaccagggaaaaatcagtgaatatcaaggcaaatctaataaaatggagctaaggatcgtcagtctgtgaggcttcagttacattttgggaatgaaccgacagaattctagttctcagagagacaaagcaaagaaataatccaagaaagcagttgaagggttacagaatgtttcaggggcaagagtcttcttatagcctactggtaattttagtactattcagcaatattaaggcattattctgcctcaaactgattatttcatttagttcttccaggacaggaataagccaaaggtagcttggatggttctgagcttagagagcagaggaagagaagagactctcttaataagaaaggaaacaaataacagaaggacagtgttgatgatagattccagggactcatgttctccgatatgcaaacacactgagtgtgacttgccttctccaataatgaagtacttttttgttgttttttaatgaaaggaaaagcagtttactataacactaggttgctaaacttgggatctgctataaaagtgacgatgcaaacacatatctgtacctttaaaatgataataaattaaaagaaatggagaacaaaatatttgagtgattaaaatctagatgagatgaaatatactatagctatagaaaacatgcaaatgatgtgatttttttctttactttcttatgtcttaatggtgggggaaataatgtacttccaactgatactaaaaagagactgttttattatgtttactacacaatgagcctacctaaggcattctctagttatggtatacattattaactgttataaaccattactctgaatagtacccaagcggcctgaaagttaatgtttctctttaagtgcttagctcactataagagagtaacttagacatggaaagtgactgcttagtcatcgacgctgattctgccaagattaggataaagttttgggtgagattggagcagattaggaaatataaaaggaggaagagggagaaagggttaaactcattaaaacagaagttccaaatgctaatcgtatgatactttagggcatcaatttcaataagtgttgtggaattctccaggcaatgggattgtgtaaatttgtctctgatacacacacacacacacacacacacacacacacacagaatctttgacagtcatgaggcatatgatttcatgttcctacagactgcaccctttttcttgttacaactactgataattaaatatttggagaaatggacaaagctttgggagcttacttcattctttatcttcttgcagtctgttaaattcattaggtcagaaaatttgtcagtagctcatatactgccaaggacagagatgattaactgtgatttatttaatgaacatcattattccagcacatgatgtaaaggaagtacctgacccctttttttgtcctaacccccactagaatctataaatacatattctcttgtctaattgaatttatttcttcatttaacaaatatttatttacatatctactctgtgctagacaaaatgtaaggggttgtgagaaaaaagacatgtaatttcatgccctgttgaataaaatggaaagcacagcagaaattcatgatttgggtttactttttgtattacaaatataattttggtttgataagacatttatgattttactttatttctcattcatttttaatgtttcctagacctgtgaaactttgttttgatacacaaagcttctcatttaatttgtatatatggtataactaacagagtttgagattcattagctgaatctagaactgtcctatgccttcaactctccagcaaactcctgttttctactacctagagctataagaaaaaggggaggtatgaggaagaaaaatattgaaaagggaacacaaaaaatggaagcaagagggataaagaggaggaaaaaaaagtaagaaaaagaagaaaaaagcattttcaaagtgaggaaacaatatgaggaatgttaatgaaagaagcaacctcacaacccacttaccctttcacacatcaagcatactcattcagtttcctgtgaaataaaagatcattttatattcaaacattttccataaaatctgtactgtgctcagtaagctaacaaatatctgaagcattgcattgaagaagttgtaacatactattcatttatggttttttaaaccttgttttctctgggcatgatcactctttgaagttgcctgtgacattttcatattctcaccaatgaatgtcaaacaaacaacaaaagctctgtacacttcatgatggagagaagttcaacaggagctcaggatgggaaagactagactgcagtagagaaggttttttaaaataggtcaaaactggaatgtggtctccaggaaaactaatggcatcttaactgacctggaagcctaatgtgcagaaagtaggtgataagtatactctgtctgatcagatctaccttaggtttcaccatgaagggccatggacagactaacgctatgttcagaggggtgtgactgaatcactgcttcctgtaaggttcacttgttcattaagcaagatagaagcagaatcaaaaagaacagaatggttgccttcacttatctgaaggtctgccatgtggaagaggtatatttgctcctgtgttccgaaggagttaagaagactctgagaagtatatctcagcttatttttcagatggcattgtcagatgccaataacagattgggctaccacaaaagttttaatgccaaatttccattagtcacaattagcataatctgcataactacctggtaagaatttgttgaaggattcactcattaaatgggtagtagaatgaaaggatttctagttctttttctactcaaaaacacaattttctgaataggaattaagaaacataaatatagagctctccagcctatcaaaaatatatttataaaaaatcatattagtatcatttttctagaataaatgacttattactttgtcagtgtacccatcagacatttgtattatttttataatgctgcaagggtgccatctgatatttcttgttggataatttccatttctaacttattagaaagaaaatatttttatgtccatctttagataggctttgaaaagatggagaagtgaagaaatgtgccagaaattgctaattgctgtgggtgcatgtgtgtgtgtgtgtgtgtgtgtgtgtgtgtgtgtgtgtgtgtgtgtatgtatgcacacatacatttgtatggaggaggttttttattcagagatataattccttcttgctcacagaagtatttctggttcatgaggactaaaaagaacaaaagcgagaaagctggtgtggtataaaaactttaactcactgaagaaaaatatatagaacaatgtgttgccagaatctaaaacaatatagaatgaaaatttcattgggttgataataaaaggtaattgaccagatagacaagaactgtttctgcactgtggcctaagcacattgagagaaaccaatgatactttatctggagaaatggtaaaaggatatgcaaaataaaaaaccaagaggaaatctgccattaggacaagaaggagaaaaaaataactggactcccttgtctttctgttttgaaatttcaatttttcctcttttctcagtaacagcttcctcagtaacctgagacagtgccttgggaggtatggcatcttcccctacagaatgttatacactctcttaaagccatacatcccattgttattgttccaatctctctctataaacttagtccagtttacttcaatttctgggattttggaatgaccattgccaccatgcagagcctcaagcttatattatacggtaagaataccaaaggaaattgtttctcacacttttattgcaggcttcaaaaggaaagaaaaacagaatgactgccatttccattctgctcattttgttctcatacatactcatctgcttcaagatgatatttcatcatctctttctgtcatttaccacttcttccctcattccctaccatctcctctatcccttatatcctttgaatgtaggtcatgctcatggttatagtggcatagtaaaacttgatggaggagaaactcttctattttctagattactgtacacatattattatatggatgcatgcacagatgcacgaaaacacctagaatcttccttattatgttttgtcttttttttttttttttctgagacagagtcttgctctgttactcaggctggagtccaatggcgccatctcggctcactgcaacctctgcctcccaggttcaagcaattctcctgcctcagcctcccgagtaggtgggattacagacacccaccaccatgcccagctaatttttgtatttttagtagagacggggtttcgccatattggccaggctggtctcgaacacctggcctcaagtgatctgcccacctacgcctcccaaagtgctgggattacaggtgtgagccactgcacccagcctcatcttcttttcctcatactttttctcattctttcctattttccctcctccatgttctcctattagtagtagtagtagcagcaatattaattgttatactagtagtagtaggatagtggtattttctacttattgaaccctgactatattaggtatgtgcttgtcatcttacgtacattcttcataatcccaaaatgtccctattatgttatttctctattttataagattggaaacaggacgaggttaagtcataccattagaggagcagcaggacctccgcattgaattatcctaattgttagaatagtactgattctgaaatttcacaatttgtaaagttaggagaactgttctcaatgaatattgaaagaaagaagggaaacttgttttgcctttttcgtttttataagaatacgtttttaaatcaaagccagattggaataaaaagaattttatggctgtcatcttatacagagtatcattaaataacatgagctaatatgcaaaatgattattacaaaatttttatctagataaatgattttgaaaatttgattaaaaccgatctgctgtatttcttcctaaaattatctccttcactgatttgccattctctagttcagtaatgataacataaatagtaattacaatgtatcctgagagggtattttaaagcttcagctataagtagctgtaaatgtttaatgtgtaattataatgcggatataaattaataatctggaaaaacaaaagaagggactggcgtgtttttcttcaataatgagtattttctaatagacagagaaacagaaatgtaaaattggtactgaaaacaatgctttaagtctgaagggatttcttatacttgatgaccaaattatattcatttcttcttccaacaagaagaatctaacacgtatttgacacaaaattggtgtctgacctatgttaggtagatgagtgatggacaaaccatactgatagttggtttgtacttagcattaaaaatattttattatatgtagaggatattggccaaactcttggaaagtacaaagatatttataaggggaataggcattttcaccagacagtaataataataataaatattagaaaataataaatactaaatgatcgtaataacagagaattatccagaaagtttaagatactgactttttaagaccttttcacgacaaatgtattctttggtttaaattgtccagccaattcattgaatagtgcaatttgtttaataaatatgttcattgtttactgtataagtacagggaacatagagtaaacaatgacccattcaatttgaagaaatcttagtaaaacacacatttatttttatcctaattctatatatttaagttttataattttcttcaacataaattatagtttaaggtcttgaaatgcgtctagacaaatcatttgtcaaaattcaacaattaaaagaaaattcgtattttgatgcaattgcacaagtcattttaatctctgcctttgaataattacatttttgtaatttgaattataatttttaacaatttcctttgaacatataaaaatcaatttaatttaaatttttcattttattttaacattaagtaagttgttaataagaaacaagcttctcatattgatttctatttttttctacctgaaattgtctctcaaatatgtatgtgttcatgaaatacttagataatttatccaagttagaaaatggaaattaggtaaccaatatatattataaaataatttcatttccgaatacctgagtttggggggaaaaagttactgttaatgttgaaagaaaagtaattcattgaattttagagaatacctaattcctactatgtgagttcagagacaatcttcatgaagctcttcttctccaatcagaatggacttactcctcagttgtcagttgcttgagatggtaccacaggagctgagagaaaacttggtgagacagttcatacactcagtagcttattaataaatcaatagccctctccccaatcacagtaaataatccagtgtagatttgcctcttaggatcttgagatttttcttctcaagcacacccctttcataaatgcccaaactcttgaaatggtcaccattcattagtttacaccttatgtatcacatatgccaaatatttcctgaggccatcttttaaaattttcccccttggaacttgtgttaaaaaataacctttctatcaaactccatttatgttttaattaattttctttcactcttcaaacgcatataataaccaatcaaaaataagtgtgaagttcctaacgttacaactaaattattatcaaaagtaaaacagccccaaaaccaaactaacattttgttgttgttgctgagacagggtcttgctctgtcgcccaggctggagtgcagtggtgtgatcttgactcacagcaacctctgcctcccaggctcaagtcaagctatcattccaccccagcctcccaagtagctgggactacaggcacgtaccaccacacccagcaattgtttttatagaggcagggtttcgccatgttgcccaggctggtgttgaaatcctggactcaagcgatccaccctatcagcctcccaaactactgggattacaggcccagcctcaaattaacattttaaccgacctagattggtctccattactttgttcaagaatcttcagggcccagaaagtccaaattaagaggcatagttttggaggcattaatagtgaacatcacctcctaccccttacactcatcttttccacagctgtcagaatatcatatttaccatgaaactcctctgccaaaaatttttcagtggttcactgtttcttccaggagaaagaccaagctaattaacatggtttacaaggacagtccatccctcatcttccaccattgtgtgacttctatgctcaaatgactgtaaactacttggccttctgttctacacttcatctcccaacattcccccaaacacacatatgagggccatgtgtttcctgccagtcacactctttctcatagccgatttacctcaggaatctttcgaacttttcagcatgtggtcccctgacaactcatgcatgtgcctggggtaataatacatgctatgcatgaaactgtctgcccttctaggtgcttatctctttgaaaggtgtgtctatgtctcaagaacctttttatttatgccaattcatccaaggcctggcacaaattacagagggcaggattggagatggaatgtgggctgcagatagaggcactgattggaaacacagaagagtataaggttgagtgcatctacttaacaactttctgaattcatatgccagtgaataaatgaacagggagggtcttactggttataatttatttgagctatctaaaaaagagtttagtgtcccttagcttctgctacattcttcccttaccttatccctctggaaatatctaaaaggtagcatttcccctacaggacagtagaaaaatatcaggtgtccctgctttatgatttctgcatacagaatccataactttcaaagctcaaggcaattaatggaggcccctaagcttctgttatattccaaggatacagcaaagtttggaaacggtcctcttcctagagctctggaaaatgtcctatcttaataaagataattctcaagccattaggaacctcagagatctagagcaactctttacaaataaggaaacttttgcttattcatttattctgtggtggaaaatgccagaaaaatgcctggtgctggaataaaaatgagtcagctggctgctcctcaggccttcacagtctagttagaaaaaatgacctataataggataattagacatgtaaaacatttacagaacttgggctacagaggtgagttgattttcccaaggttacctgcacagataacgttggttgatctaaagaggagagtacaaatgatacatcataatttctgcccttggcattttaaaaaattaatagattttaaaagttttataagttaaagagtcatatggatacttaattactttgttgctaccccctgatattttgcttctctcctggtagaatcttaaataaatatttactggaatatatctaaaattttagttcagtgctgctcctcatggattcctaattcctttgaaggagtgtatggtgtaatgataaaaagaatagattttggagtgagaaacaattgattcacagctctggtccttcatttacagaaaatacaatttcagatcaatgtatcgacctttcaaagtctcagtttcctcatctgtgaaatgaaaatggcagtgtgcatcccaaaaaaggcttgaaggggattgaataagatactgcatgtgattcaattaacatataattcgcactcaatagaatgaaaaaaaaaatcctgctattttgccatgaagaggctttcaacctttataggagagcttgtgaatcaaaaagcatactgccaataacatagcctttcaaaactgaacccagggcttattcagcttataaagcagaaatcctgtgctcactctgtttcctcagctggcagcgttctttcacctttcacctctcaaaatccctattgtttttcaaagttcatctcaaatgcacttccacaaagaagtcttcactgagacctcacagagaagtctcattttctctttctctttcttcccatagtattttgcttctattacttctaaatcatttattttaatcaccctgatttaaaaattggctgcatgtccgtcttcccattatatgataacatctgtgagcacatggggaatggttagcacaatttttgtgcatagtaggttctttcaaataacatctgtagaatcaaactaaactgaatagaaaataaggaactgtattatttttgtgactcatctgaattttgcaatcttatgccatcatttaaaatcaaacctataagcagatgtgatgattagggtatttgagcacattgaggaatgttataattcaagaaaaatttagaggaagtaattttattgactgaatagcaagataaactcacttatttttaattgaggggcaaaataaatacttcttgagtgaacaagtactcaggaaaataactaacaccttgaattgtatgaggtttgtatgttaccaccatatttttaaaataatggctagtaaacgcagaaaattagaggtctctagaatttgacaaattaccaagaatgacctccaagaactcaatattattaaaacatgtaatggtaacaacattagacttgttgattagtaagtttatgccaacttttaataaaaactttttatatatatcaaacttattttgtccataccgtattgtagtgtgggagcctttcgggcagaaaatgtagaaacaaattaaaatataattataattataaaaatatacatatacatgcatctatagatcctaagatagctgagaattctaactttaatatgttgtggttaacttgtctttgtcaactttgaatttaaccaaaaaacagaaaagtgtgaccttattttttaaaattatataattctctttgatgaatgtactgatcattgctactgaccagagacggaacaaaacccagggcatatttttattagtcacatgtgtttttcaattatttaaagaggaaagtaaaaagatttaaaagattattggctcatttttactttcccttttgtggatgttaatcaaagatttgactaatttattcttacctttaatagtgtatggtaggtttctttttttatttgaaagagcagtttttattataatgaagttaaaatcaaatttgttcacattttctcatattcagtcatgaagttttagaagctactcagtttaaaaatgaaatatgaagccgggcatggtggctcactcctgcaatcccagcacttcgggaggctgaggcaggaggatcacctgaggtcagaagtttgacaccatcctggccaacatggtgaaaccccacctctactaaaaatacaaaaattagccaggcatggtgtcaggcacccataatcccaggtacttgggaggctgaggcaggagaattacttgaacctgggagacggaggttgcagggagccaagatcacaccattgcactccagcctgggcaacaggagtgagattccgtcccacttagataacaataaaaacatcagcaacaaaaacttgatatgccccacattttgtttaaagttaagcttttcttctccttcaacttgttaatgattaggcagaagcctggaccggagaatgggatgtggtggtcttcttctcttcacattcctgctcctcagtgacacccatcctttttctgtattcactgagtgtattattttgttctttcctaggctgccagactcctcctcctaattgcagcttcctctccttcagccagcaggctataattccacctcgcttttgcatccaaaggcatcaccccaaactctttttgcaaaagcaatcttcccctggcagaagtctgcttgggttagattttcttttcaaattattccagatcaacattcctactatgaattccatatccatctttccagacatattcacttttggttctctatcaatcagtgaaagtgccattatttgtttcaagacaacacccagccccactgccataacccacttcagtcaacatttgtctgccttttccccactgtgctcaaagagcttcaagtcacacatatcaagctatccaagctaactccttaaagcttctcataccagactggaagtgaggtgaagcatttatctccctccctctgtggggaggggaaggaatgtgcttcaacatacagctttctacaaagaaatcctccccaaaaaacatttttttattaatcttttattttcatatcatgagcattggactaagttcacaggcagcttattggtcatctttgcaagatttacaccaatgacctagcagtttcaccttggaattggtttgttcttggctttgagacacaaaatgttgttattcatatgtcgttttaaaaaagtatagtgccattattgattttaacttacctgtttgtaatatgttatcattgaatatgatgtttgttatatattttgggcagataactgttgttaatcaatatgatttttattgaataataattaaattaagtacctatttgtgctagaaattcttttcaatgctggagatataatggtaggaacaaaaggtctcccttctcacacagtagtgggaggaggtgggtaggttcataaatttaaaaatcacacatataactgtatatataaataaaaatagttatttcagaagttaataaatgctatgaagtaaacaaaacatggtaatgtgacagagtgactgaggtatgaaattagatgttggaggagaaaaagcttctctaaagggatggagtttaagctgtactttaaaatggagttaatcatgtgaggagcaggaaagagaacatcccaatcagacaaagtagcacacccgaagtcataaggtggtaatatgtgtgcgtgtctaagaaacagaaaggacagtgttgccagaagacagccaggaaggccgatgcattcaaatagcagggcatatgggccacagtggagtctgtttttttatttataaagcaattgaaagaaatcagaggagtttaagcagaaatgcttatgacttcatatgtgtaaactgaagtggtcacaggcaagcctttgatatatagtcctcttagttatcaggctactgagagagccagagcaagaaatgtcagtggctcatacaggttcttggtagtagagatggaaagaacttatgtaaaatgtaagtgggggaagagaagggcatcctgctagataaaatgcttcaatagttgatcttctggctctggacactcactaatatttctctgagtttttggatacccagtcatcctatcttttccacacaaactcctgtattcaatgtctttttgagagacagtgactcctgttattggtctggccaagaagtgaattggagaatatgcagaggattccacaaccactccctgctatcatactccaaatagctgtgctgtgggctctctggactcacttccacttctagaatgggctgtttatgggcctggtcttttcttggtgttgaatctaccttttgtgttaattttctgtgagcatttttgttaaagatttctttgttcaatttaagatcacttgctctctgtcttcccaacattctttgttgtttctgagtacattggtactctcatttgcatttttttcttgaaatttcaagatatttggggagtgagaggatttgcacctctaatacagcctcccccagccccctcgcacgcacattctagatatggcttgtattctgtcagtttaacatagagtgttttccttcttacaacacatttaaacccgataaaatcttttacctatagttttaatgcagtgtctactagttttgaaaaggtttcagatttgatacattataattgaatcttcttcaagtattgaaaatattctttaaagcctttataagtgcaccaagcttatgcaattatagtcaataaaatagttttttatttcttaaatttctagtttctttctcatcaaaatgcaaattagtacaatcaaatatgcttctgttttctgagtatttataagaaatactggatttactaaatctgcactaaatgtctaataattaaaaggtaaaattgcaagaacttaattttttaaatgcaatccgttattatatattcagattataaaatttaaattattttatgactttatgttttttcattactcttacgtgttttaaaatatatgcatcttcctgtgtgctctttgatcttttggtgggaatgtgccattctcccttaaggctttggtctttggagttgaacagacctgaatttgaacccttgacatgttactctgttatctggggtaaagtattaacctttctgatgcttttttttttcccaccatacgattgggatcatgcctcctgcatgagattcttcaaatttgttatataacatatgtaaagctcctttcacaatacctgattcccaataaacattagttactgttgtctcattactgatgccacattggctttccattttgcgattatcatttattagttgtgtaatcacagataggcaatgttaactttttgaaagcatgtgcttttaggttaattaaatggaagaatggacatggaagtagtttaaaaacaataatgcattaataaatacaaagtgggaaaaacacaactagagtgacactttgttaacttaggtcattataaaaatatatccccattacattgttacagaataaagtgaaggatacagaaaaagagaacaattgtgtgatacaactacacagcactgaggctaaaaagggacaatcattatagacagtccagatatgaaaacatagacttttgtctattccagattttctactggagttctttactgtatattatacacactttctactatcaacattagcttatctgtgcaaactgtttattgctatagattctctttccttcatctttttactaaaccttccaggcaaaaatgcccgactagtatttttcttaactaaagttttcttttcctggctatcagtctcaaatgggtgcaattctaaataagtcaactttctccaaatatcggggtaatgaacaaaaaaactttattagaaattgtaatgttttagtaccacctatcatctgcaaactgtgtccaactggccttagagagcccctaagctctctaaaaatatgaaaataaatggaatctaattaatctggattctatgaagagttgggtgagataggttaaatgaaccatggcttgtttaaaattattgttgcagctttgttcctctctcattttaattatttaacattatcagttacctgattaagatttagtttccctaccattaataaataaaatcagcgggcattgatgttaagtgtcaacttgttgtggtgttgacaacctagtacagctctgattacttcaggaatatgtgtgggaaactcgatttaattacctgtcccttagaattgcctttgcatgtcacatttccatatctttaatttcctcatacctgactacttcctgatgtaaattgggcaggtatggaagtgacatgaatgacttggctattatatgtttattttcctccgtatataaaagtaatgtggttgaccttaccacattaggtgacagatttggttaaactagatggagatacctctctgatcctctgttatgactgactaaaaaataatccttattgtaaaattggaaaagcatgttcaagtagcagtggaatgatctttcataggaaaaagtcaactgaacacacatatcaaacctgtgaccctgatctcattatcatcataatctaaccatacaagacaacgatcagactgtgtataccacacagacaaaatggaataactatataacttgggaaagcagtaagagtgattaaaatctcaagctctataataactgctttaaattcaaatttttcactccttggcttacgcaagttatttcatctttctagaagtttcggtcacctcatctataaaataaggataataacagtacctacctaataggcgtttgaaaagaataaatgaggccatttatgtaaggttgttctctcagtgcctggaatataatgggtaagtgttagctttactagtttatattacaatcatgaaacagtattttgaatgcccaaagtagcaaccatatggatttggtgagtgactcattgtgaataagtagtaggttctgtaagtgaacattgaaatgactacttttttgtttgttttatcttgtttttaattgatatatagtaactgtatacctctacagggtgatgtttcaatacatttatacattatgtaatgatcaaatcaggataattggcatatccatcacctcaaatattttttatttccttgtagtgagaacattcaaaaaccttttagctattttgaaatatgcaatacattattattaacaatagtcaacctactgtgcaatagaagaccagaatgtattctgtctgtctgtctgtctgtctgtctatctatctatctatctatctatctatctatctatctatctatccatcccatttttagaaatccattcatcccttggtggtcacttaggttgatttcatatcttgcttgttgtgaatagtgctagaataaacatgggagtgcagatatatccttgaaatgtcaatttcaggaaatgactgcttttgaaaagttttctattcttttccaaactccatgctggtctgaaaaggctcatacaaatttcccaagtatctattccattcattaaaaaatctagcatgtttataactgataatgataataatcattgtattaaacaatcaatacttcactatataaatgtgattcacttttgttgtagtatattccttaagtactataacccaatgaagcactcatcaaattcacttttcacttgaagtgttaaagttcatccttggtacctgcaaggtcattcctgacaaattgactgaggttgttaaggtacaatttaagataacacacaatttctttagtgtctgtttttttaaaaaaaacctgtttttcattgtgtataattatatacttacattgacaaatatgaatgtcttgttcatggcagctactttatcttttctggctttggagacctcttttttagttgaaatttataaattaaccaaatgaagtacctcagtatttctaccattgttaatttttttaaaggaaaagactagagtctcgaataatttacagcagaatttattaggcgatggttttaggaaatagaaatgaattttttgcatgtgccaatgtttccatcttgttacagatggctcttgctggcacaagataagggtagaggaaaaccaataaacttgccagattttccctaaaaatatatgaagaattttgcatattgctcttaaaaatgaatttttgccattattatatactaatatctgcttctttttgtttttctgctttaaaattgttacacaaagatgatattaaaccttcataatttttatgaaagcaaaatgtagctattgaatggattttggctctcagtcttttctttcttaacaataaagttaatgctccaaaaatgcatgaaaatttatttttaactgacagttgattttttttcagtaagtaaattaaatcatttcatcttcttcaaatatagaaacaaatatagaattctggattacatattgtaaaaaataatatgagtaattaattgatatgacaaaaggttgtgatatcatttaactaacttacagtggtaaaatttttcttacagagcaaatgtaaatacaaagttattcaatttaattgagatatctagtgtattcctggtataataaacaagataagtgatacagaaccatatttaatattttattcattaaaatatgaaatactttaaagaataagaacattcctaaagttagagttcattgtgcttaatgtattttatatacaaatctgtagaaataaatagttgctttgcagaaaaaatggtattttgataagctaaacaaacttgagattggatatctgattaactagatattagctcaaaattttattttaacactttcaaataatatttctaggaaataatatttgatttttcttggcacacagtattgaacatagactgcattttttgttttatatttattttcctcttagatgtcttaaatccctcaggaccaacattttgaatatcaattatttttatatcagatgataactgtgaatatatgagtggaaaatatttggctgaatcattagaaaatatggagattaagtggagggttacttttttattcaagtcatttttcttaatggtttttactctcccttatttatttaacaaaattttacggagtcctgtaatacatcaaatcctgggccacaacctcagatataaagataaagttggcatggtctttttctttggatatttaaagtctgttggagaaattggacaagcatcaaatcaactgaaagcagtgggacagagacctagtgttaatatggtttgaactaactactatggaacataggctaaacctagatattaccaaaaaatgagaaaatcaaactgtgtttcagataagtggattttgaggagagttgtcagctacaaatctgacagtataagtcccatgcactgggtaacaggccttaaagatgagtggcagaatatggtgtaaaataataaaaaatgttttactagtttcccctcatcaactgctatttttgcaagattatgtaaaatgttcataaattgactcttcattttacaacttcctttatcccttttttccaattttgtcagttgtctttgccagaaaatgttatccatttacctacaaggtctgtgagtcagagaattaaaatacatgaataaaatttccaaattgcatgcataaaaagctatacattttctagatggctgcccatggaatatataatttgttctttgaaacgtccatatttaaacttacagttgacactttatccttaattcatgctgcaatgcttctcacttccatacataataatgtgaattaaagattgtattaatctacagttgctactgctgtcacttggttcatatatttaatgatgatgcatatgtttctctctgtatgatatataaatacatgcatacatgtatctgcatatggtcagtgtacatgtatacgctcagtggggtcataaatgtgttaaaaatgttcgttatgttcaaagtatgaatctcaaataagactcaatagtttattggctgaaataattgctatgacaagtgcaaataactggaagactttaaagtttcaaataatgtttcatgcacacacttaaattgaccatctataccttcaatgccacatgtactagcaaccaagacaataacatgcattttgctaatccaaccataatgttattctgagcagttactttattgatgaggtaaaactccaattcatttattccagtagagtattataactagagaaattaaatatttattctaaaagtcagtagagatgtgtgcacaaataaagttgtttgtagagcaagcagtaatctgagagaagcagacatttaaaggtgtgcccagagtatttacttgatttattatatgttaaacagcaagttaaaaattctgatcacatattttaatgatgaaaataatatatgttcatggtttttgaaaacgtaaatattggccgggcacagtggttcatgcctgtaatcccagcactttgggaggccgaggcgggcggatcacgaggtcaggagatcgagaccatcatgcctaacacggtgaaaccccgtctctagtaaaaaatacaaaaaaaattagccaggcgtggtggcgggcgcctgtagtcccagctactcgggaggctgaggcaggagaatggcgtgaacccaggagggtggagcttgccgtgagccaagatcgcgccactgcactccagcctgggctacagagcgagactccgtctcaaaaaaaaaaaagtaaatattgaagagcatgtaagtgaaaaagtaaaaatccaacccatttctccatgtcacatactgtactcataccctagagaaaaagcatttaaaatagtttattggatatccttccaggaaatatctgtgtatatttaaacagaatatggctaatacttttttctgtgcaaataggatgatacttttcagattgttctgtaatttgcctttttctcttaatcctatgtcttagacaactaagtatcagaacatatgcatctacctaattcattttagtaaatataaaaaaattgaatttgttcactgttatggattatctttgatgggcattgtagttagcattttggcttttatcgtacccatttttgacttaatggatacattgttgtcaaagtcagttgttcaatttaagatctgaggataggtttggttgatctccttgaaacgtattgaatagagacatggacactggagttacccccactagttagtgatatcacttcagacaggaggggttaactccccgtgtctcagtaattggatttgtaggacaaatatgttttttaaaaaggcacattagcccttggcatacgaggtggtcagaagaatccactgaagcaatatatgttgatgtgttttgaaaaagatgaaatattttttaaacaaagtatattaggcactggtactcttggtagagtcataaactattagctcaaactggacaatgttatatgcctcagtcacggaaaaccttaaagtaattttttcattaagctttatttgatttaagatttaagggaaggttgagatcccactgaagaacaggcaagatagagtagatcaatttatttctccttgcttttttagttacttttattgaaagtgtccctgtgggtctcaccaaagcaatcctactgttggaagagctttggaagtgtctttttttttagttttctttgtctagggtatattggggatagggaggaatagggcaaattagacacgaaatctaaccatgttgctatggtcaatttgggaaagacagggtgttgaaagagctaagcagggaaagtacataatacatacaacacctcacaacattcctgacaggcacataggcactcagatgttaattcctgcaagcaacatagatcagcaaattaattgaatgcattaaaggcgcgggtaatgtaaatatagtaaaacagaaaaaaaacctctcaagatacttttaccataaaactatagaaatgttataagaaataaacaagcatgtgcatgtatgtgtgtatgttttggtgaactgatagtatgctagttttgagcactgcttattttcaaaaagttcagttcctcaataaaagctccattttatgaatgtttgtagtttatggacttttgctcttgggagaaaatagtaaaataactgtaggtattttatctattcactccatgcctcgggcagcccccaggagagcaggaaagggaacatgtgtggccaggcaaattttattgtgtactcaaagcttacctttttttttttttctttttgcattgttcttaccacccatgattttaaaatggtatgagaatttttcaaactatgtcctcatgtcttatcaccttgcttataatgcccttcattcccctaccccccgctcccagctttaagtatttacagctaattcagtttctttgaaagaaatctgaaatcactcagcaggtataaaaatatatatactaatacatgtactaatacaaagagatctcctgaatatattgttgagttaaaaaaagtaatgtgcaaaacagcaaatatagaaagctgtcttttaagaaagagagggaataaatatatatgtataatttataattgctaatgtctacagaaataatttccttcattttacataaagaatgtggaaaggatacacacgaaaacaaagagtggttaccataggattggggatgagaggtaggaacagggaagctaagggtggatgagggagaagcatgattttttactgtactttggtttttattgtttggatttctcaactttgtgaatgaattacatattaaaaagagaccattacatttgagaaaaacattcaaaaatccatagttgaggcagcaaaatgctgtgaaaacattggctataaacctgaggagcatgaggtttttgtagcagatacgctactgttgcctgtaacttggaacaagttactgagactttcactctccctggcctcagtgtcctcacctgctccagataagaaggttgcagctgattatctcatgccctagatgtcattctgagctatattttaattgatctaagattgtgcataatccagagttattggattagcgccataggccactcactgaaagtatggaaacatgttctagtatattttacatccaaaaaacttgtcataatgtttttcattcatttgtttttttgttttttgagacggaatcttgctctgtcgcctaggctggagtgcagtggcacgattttggctcacggcaatctctgcctcatgggattcagcgattctccagcctcagcctcctgagttgttgagattacaggcatccatgaccatgccaggctaatttttgtatttttagtagagacagagtttcaccatcttggccaggctggtctcgaactcctgacctcaactgatctgcccacctcagcctcccaaagtgctaggattacaggcatgttacaatgtttttttgaagagatctgttttataatattctggtaatgtttcttaaaggtagaaactttgcttaaaataatctgtgtaaaatatttgattatgtagcaggtttccctagaggaatttaacttttcaataaaattttagcactaataaatatgcactgataggagtcataaaatgtatggagcactgattatgtgccaggtaatgtactcagaactttacatctataattttcacaccagttgacaataagttgcttttgtctacattttcacttgaggaaataagccttagagacttttagattatagaatagatattctaggtgtaaaacttgagtttcaacagaatatgttgaaaagtaaggaaggtgaatattaacatctctccatggaaaatggtagttgtattctgtctggaagccacaaaggactaggtaatttcctggagtattttcattgacagactgggtctgagagaggatatagatcatgggagcttcttttatctacctcctctcccacaggcatgctcaacagggacatacagagggaagtggccacactgagatacctaccccatgattcttatataaataggagaaagaaagatgcacacacacagaccgtacctagaggcagagagcgagaggcagagacagagacagaaaggcagacagagagaaagacagagaaatagagtgagaaacagagagaggagagagagacagagagaaagacaccttcagaaacccaaagtcagagacagccactatagactttgtaatatgatcagaaaggaacacaggcacacagagggatcacatggtgtcaaagacattctgaagaagagagactcataaatgaagatttgtaaatatatacaacagatagaaaacattttagaagcacacatctggccagagagataaacaaggcatagcaagtcacgcaaataagcatcagcaagacaaaattaggcagagtatcatacatacacagacatatacacagaaaacaaagtgaatgatatgaatctccacatgggaagaatgaaacatgttaaactagacaaaagaatacacacattaacacaaaacaaatatatagacagaggcagaaatgacatttatgcacacaaacatagacatacacacacataacaagacagacatagatacccatagtctgacaacaagaagaatcagactttatttctggctataataatagttcaaaagccgccccacttccctggcttctgcactcggcagggggccaagaattccttgtttcccaggccacagatggcgccatcacccttggatcatggtgcctcattcttactgtatttttctacttctgtttatttcattatgttctagtgagcacatttctcttactctttagcatttattccccatcaatatatcttgataatttccacatcttccttacaatacattccttaattttcttaaaaatatgttataaatcactgcaggttgggttcgttgttttatctaaaaatgattttcttctcccagccttagttttactaaagtctgatataacattgtacaagatagtagggtgggcattttttggtaatatgtggacctcaaagaatctagaatattgtcagtactagataaattttaaaccaacatggtacaaaatattttgagatagagattatttattgactaaatttctaagtacatagatattttaatggcatacagaggtatatacatatgcatagttgagtttatatatatatatatgtaaaatataaatgtgtttatctataagagtgtatgtataatctctcatctatttacagtattcttacaaaataaagctttgtttgggagtagaccgtactgtttcttcccggcattgtcttctcaaagagaaattaacatttgagttgagcttatagtatcaaacatttccatctgttgtgcctcatagctaagcatgtacacaatgtgataaattttatacatatatgtacaacttttcattttactccccagtgagaggtagaagaggaaagggtcaaaatcctacaaatagaaaaagggtctggacttcaagttttccttaaaatgtggtacatagacctcattcaacattaaattgctgaattctaggctctaccctgaccaacctcagaggataagagggttagtaaatgtcatttttaataagctccctaggtattttttttatgcacattcatgttggagaagcactttctagagaacagaattttattgatttttatacagggattaaatctgaaaggtatgttccaatgcagagggagggccatgagggtaagtattatggctgtgagttttgtacattgaaattgccctgaatatccctatgtgttcagttttctttccttcttttttttaagtaccaaaccattttgatctttctgtgatcttgttctcatatgttttctccctgctcttctgattaacaagaaatatccagaataattaagctgccaacagaaacaaatttctacttcatttcaacaaaatagtattgaaaatcattctttctcaatggaaagttatctttaggtgactcgcaaaggagaagtgaacccatgtatcatatgtgtgtaatacacacacacacacacaaaacccatatacataaatatgtgtagtatttatatttataaatcaaacactactgccgtgcttaatagtatatgaatcattctggcctaattatttgtaactaaaacataggatactatttcttaacctgtatcagaaaaaatgaattttaatactaagtaaatacagatacattcatattcaaaggaaatatatataggaatggtaacttagaaaacagatatggggcagggcatggtggctcacgcctataatcccagcattttgggaggccgaggagggtggatcacctgagatctggagttagagaccacctggccaacatagtgaaacctcgtctctactaaaaatacaaaaaagtagcagggtgtggtggcaggcacctgtaatcccagctacttgggaggctgaggcaggagaatcacttgaacccgtggggcggaggttgcagtgagccgacatcacgccattgccctccagtctgggaaacaagagcaaaactccgtctcaaaaaaaaaaaaaagaagaaagatattggagtgattattcccttataagacttgtttacccaagtaattcaccatcgagtactcaaaattgcagcttctcttagtgtatttaaaatttacaagcattaattcatgtgcaaatttttaaaaacatctcttgcctaaagtcaactgtatatttttattgctttaaattttaatacagctgtttctatctttctatactaaaataaaaagtctgtgatattcaggacatggctgtttatctaaatgtgaaatatttcacaaaatcaaatgtgatttccacatattcttaaaaatacacttttttgtagaaacactggagactaaatggaaatgcatttatattggtaaagatatttttcttcaaaggcaatcttggcttccaatagttaatattagtattaaatatggtatctttgataaatgttattattctggactcttacaaaaagtagcttgatttgagacattttaatagcttaaagggaagaatgaaaatataaggaaggaaaaatccataaagcatgaggcctcttatcccatattgattcttgtaatccagcaaccattagatacttaaataagcctcttttaagatggcatgtttacattttgaagatcaaataccttaatttgctcatgggtttcccaaacacaattagtacacaagatagaaggtaggctttcagtgaccatgtttccgatgtttttgagctgaccacagcaaaggtgcattgtaaatcaaattatgctcaagcaattgcttcttgcagtgttggtgaacataaatgccttttaaacgtgatcacagattatgaaaatagagctagaacattgaagctggtgagtaataaaatgagtaaaaatattttaatagtcaaataattgaaaaatataacttcatccagaatctctttcttattttccataaaaaatattggctttttaactggataaaattttagaaatacagctttgtcccaaacctgcccattttctccttaatgagtattattacaatggaaataaagagttctgtgacattttacctttaaattttctgtattttttttctaatgctataaacccagacttgacattttgcaaaaaaaaaaaaaaaaaaaaagaaaaagtttatttttatctttacttgctggtaatcaatttcaaatatatagtgactaaatattaaatagtaaatggataaaaaatttattaaatacatttagaaccctcactttttaaaatgcaacataaaatatcaattgattttctactgcaactgttccactgtcaattaacctatttttttagtttttaatttactgtgtgatagcaaaaatttttaatatttattgtgtcctcaacatataccagactctattctaagagctatacatatattactgcctttaatttcataaatgatcctatgaaattggtataaattatttctattcccaattaactaatgaaaaaaaatcaagagctagagttgttaagtaactgaccaaaagtctaacagcaggtagagtggtggagtcaggaaacaaaatcaagaaatcttactcctgctggatgcagtggcttgagcttgtagttccagctgctggagaggctgaggcaggaggatcacttgagcccaggagttggaggctgtagtgtgccatgatcacacctgtgaatagccactaccataatccagcctgggttacacagcaagacctcatttaaaaaaaaaaaaaaaaaaaaaaaaaaaaagacctgattccagaacctgtgttcttcatagccagtaagaaagaaaggatgttggccgggcatgatggctcacgcctgtaatcccagcactttgggaggctgaggtaggcagatcacgaggtcaggagttccagaccaacctggccaatatggtgaaactctgtctctactaaaaaagtacagaaaattagccaggaatggtggtgtgcacctgtagtcccagctactcaggaggctgaggaaggagaatcacttgaacctgggaagcagaggttgcagtgagctgagatcgcgccactgcactctagcctggatgacagagtgagagtccatccaaaaaaaaaagaaagagagagagagagaaagaaagaaggaaggaaggaaggaaagaaagttagttttaattaaaaagaagcgtgaagtgtgcatgcacttttttcctgaaaataatacaaatacagccagtcctttgtgttgtaaccaggcttcttttctttagtagtccccactacttccagctcacttaatgcctattacattaaacttccacattacacgtgaaaagcctttgcagagctttcacaaacaccatcatatttgatcctaccacaatctcccaaggtggatagaacacattgtcccttccttttcacagccaaagaaatgaaggctcagagatagaaaatgtcttgaacaatgtcatatagattatcacctaaaatgtaagaggcagagttcaaactagaacccaaggcttctgttaataacttgggctctttgactacagaatttagcacctgtaattcagggatgagccctctcatgctggtgaggcctctgtgtactgtgggagcaactgactcacagcttcacaatctgggcataatgtacggtgttccacactccgcccatccttccttggattaagcaataaactaaagttcaaattcaaactttcatatttgaatagaacacattttctatatttttcccaactgcctcacctccatgcagctaatctagttctgatttctcagcatctctattgaggacaaggcacctgtgagcttcattccttctgcagagcacagtccctacccttgtctttttttaatcctttgttgtcataaccatgcctttctttcctcataccataggaggcacatcttgctctctaccttccaactacatttataattgtttcttttatttttttcttcatcatggtaccttatgccatgtaataaaagagcaacagatttaccctgagtggttaggtagtttcaaatatatatatgtgtgtatatatgtgtgtgtgtatatatatacatatgtgtgtgtgtgtatgtatgtatcccagtgaagcactcctcttggattttaactaccattctattattctccctaaagtagttgcacagaatagtgtgaatggtgtgaattccagaataatacagagctgcgtccatatcctggcttcccatttattagatagaggatattggacaaatttatcatctttctaagccctagattctttctcaaccacccacaattcagtgataattatcattactctcactgtattctctttatagatcaggcattatactaggtatttcacgtttagaatattgaattgttacgaaaattttattatgcaagtattattctgatttacgtttaaagaaactaataatagagaggataagaaagctaccaaggtcatatagctggcaggtaattgagtggggacaacctaattctaaaattcttctttttaaagtgcatatcatactagaaggtacatgtgtgagtatggttgtgtgtgtgtgtgtgtttgtgtattaaggatttagtttgagttaatggatagaagagaggtgaagggcaaaacaaatatttaactaaacttctctatgctaatccctgtaggaggcacttttaattattatcacaatatttttagaagagtatggcattgtctcctgagatgctgtgagattagaaaacatgtcaaaggttacacagctagcatatgaaagagcccaaaatccaaacctgtatatatctgtctctaagccctttatgacacagacaaattatcaattagtattaatgtataatttaggaaataccttttagagtcttacacttctagatttggaaatatctttgagaataattcagaggtgataacaaacatataagttgtctacagtcgttaaaaacggtatctgcatagagtactgtgactgggtgtggtagccccactgatgctaaacattaactctttagtttcttaatcatgctacagtaagggtatcctgggaaattggcccagccaaagcaacttggacgcttgagtagaaggactctggaagttctgggtaatcgttattcaccaacctgtacaagcatttcactctctcattggcctatatgactatccattagccctagctactcttgtccttactttacatctggttaattatttaatttttccaagctttaagtatttattccgcacaccacccaatttaatgatatccactactgagaagttatgcaatttaactgatattacttatttagtttgaactctaggatcttttgtccttccaaatccattggcttgtttttaagtttcttctgtttttttttttttcttttaaaggcacttcaataaatatttttctttattttaatttaaatttcaattgcatctagatgaagtgttgcttggggtagtgctaacggctttccagttgtaatatgattattaaaaaaacaattgatttatggtttgcttaaaacaggtctatgctacacccacacccaatttttccttttctctgcttgtctttattgctatgtgacttattgtataggagctaaccagactgggtgagaggaaaactgagatctagacctagttctgcttctgactagctgtgagtcctaggcaaaatctgttaaacactctatttttgtttcttcacctgtgaaatgaggagttcgatagtcactcagtagggtcatttctagctctagcgtcctatgaatctgggcacatgaccactggattccaagtgtttctgtagtatgtagtatatgcttaacatttattgcatcaggcaagatagacagaggcagagagagaaaggggcagagaattgtgtccccgaaatactccagcctgcatggtaaaagaggatcaactcatgtggaatagcacagaaagtatgaaaacaatgaaattgtgcttcattgagaatcaaagatgtttagcaaggagaggcatgtgtgagaccagaaactgttaagaagtcatttcagggggatagacactgtcagagagctcatccttcactggcttgtttccagtgagacccactcagaaaacaggatcttcataatgactgcttcaatctttttatctcacttatgaagataaaatttaataatgccaaaaagttaaggtatttttatagtcaggtcttgctggtgtgtagagaactatctctctcattcatatcctgaagacagcattttgggccaaaatacaaagtaatactcctttcttttcaatgtgaaatactcttacacattattgtagaggagactctccatgtttgcactaacacctttcctcctctctgaggtgagttgattataataagaactttaaggaatcaaacatatggaataaaatacacaaggtctaaggatgaagtcactgttttgttcaacggcacaagactcacaataaaaaaaagacatattttggaaagcaatggaacttaagagataaaatgtgcagatagtaagagggtcttatgggctggatttgagcatttagtatatgacaataggaataaggaaatagtaaagacttttaaggagagtagtggaacaatgaaagtcatgtttaaattacattaatctgcactgcgtttttaaaaatgtattttaaatgactagcttccatttggaatagaaaatatcttatttttgctcatgaatttcgaaaacatcaaaactagtgttaaaccatatttagttttcatctgtcttgttttagctattttaaaactcacagtacaagattcactatgtctaagtaagcctttaggtttttaagttcctgttagttctcttagagtgcttgcaattttagtctcagaaggagttgaatgtgtgcacattttagctgatgttaatttacaatgattaaatcttttttctctttgggtttgccactattaataactacaacttcaaaaaacccattgaatacaaaatggattgggagagagtctggagtctgcatgatggtagaagcaaccaagagctttctacaataattcaatcgtggtaatggtagccactgactaggctaacagtagagagtatttaatgacaggaatgagatttccctgggaaatctggtgaaatatgatgagagcaaaggaaggaagagggaatagttaaatattatttctagatttagagtttagagacagagggggttatacctctgaaagcaagacctatgctggagggaaaatgggctttgaaggtggagatgatggtcatccctgttgtactgagatgttggtgagacatccaagtagaaattgttgcagaatattgtatctttatgaatataagatcaattaaaatatgttaattctcaggcaaagtgaatttaactttaaatacatatttaatcaaaactttagaaatatttataaaatttcagaagtgctacagtcttgaattttactttttggtgacattaattttacttgcaaacacaaatggaataagacctcagaggctcctttttcatcatctaatttcacttccataaagcaattcttgtctgatgagagcataatgcaggcttctatataaaatattccctgtcatatttctgagaatgattttgcctctttttgattcttgtgtttaagactcagatagggcagagtttatcagtgtgtgcttaaaccctgtaaatggcttccattgcttttaagattaagacaaaaatccttcagctgaaggggctgtgtgttccagttgattcttgtctggctctttgtcctcatcacccacgactctcttttctactccttgtatgccagccacactgacctccaggcttcctctcttttggggcctttctatgtgctattttctttccccgaaatcttctttccaccctacctcctcatacccagccctttgcctgcctggtgtttactcatctttcagccctcaggccacattacacctagtcactgaagacttcccagactcagccaggtcaccttgtataacatcttatagcaccaagactttttccttgacacttatcacaatttataagtgtatgtgtatgtatatttgcttcatgtctctttgctgagatctaattttcatgagtgtagttgtcttgcctgttttgttcctccatgtatccttcatgcctaatgtaccatatatttgttaaacagctggatgacagaatattgcaaccatggcagggaggttggattattgatgccatcccaatcccatcttcattgaaatagctctagacatctagtggcacttgtgttctcaccagactcctgctctaggtgcaactttggataatacttggaaagtcagggcaatggagagtgtgtcttcacaaagtgtgaaagggtttatagagtatacagaagcatttctccagaataaaaggaacatcagtttgagattcttcaggctgtagaaatactgtatctgcatgtaataaaaatcaaacaaatatagtgttaaagaataatgagctttgcaaatttgctgatgctcaggttaggggttagtctatttaatttactttttatctacttaaattctttcttccccagatgctatcatttttttattctagatggaattgcttttgacatcaaagtgttatgtaatcaaggtaatttatggtgaaaaactattttttaaataaatacaaatgagctcttctcagtgtactagagcagagaaaaattctcttttcccctttcctgactttaacataagattctcctttttttgtgtgtgtgtttcaagttgtgctcttacctctgaaaaactgtctgaaggaatatattttgtgtttatgtgtcttcttccaacacaaaactaaacatagggtatgtctgttgctttcagacccttggaaattgtttccttccaaaacatgtgtacataggagccattagcctaaacaggcagctcacctaaatgacactcattgtcatgaatgacagagcaccaccaccaagatttgcactgatatggattctttttttaaataatcaagtgttccaaaattcacttccaatatctcattggagtggcttgcattagatttttagtttagcataatacaaacgtatgacattctcaaaaatgtaattcccctttaactgaaacattttccagaaagaaaattatttttcagctatgctttctttatatctggtcatataatcaatagttttaaaagtgtgataactttttgttgaataaatatagtaatatcaaattagcgagaatgattccaaatcagtcacttttactgatttctgtattctcaaaagttatgtattcattttagttatataaaattaactaaatttcaatgggtaaaattcaataactttgcaatgacaactgtcataatatctagtttcttaaaaccattgtgttttaatgtttgtcaggttgaaaaagtcaaatatagtaacataatcctgtcgttacttaaaatgcattgaattctggcattgttctccggaatacacatattttttcatatccttgattcaagttttataaactaaattttaccccaagagaatacatccttgagaacatttagcctgcttccaattgctccagaacaacaatggcaatatcttaaattctctcattttgtaaaaatggccttagggatgctttacaatcagtttacttcaaagactgctgggtcaagaggacaggggaaaaaaacaaggtcaatagccagggctttccatctatcatggtgggaccactggagccagaagctctaaataatcctaaaaaattcagaggcttcttcccttgagaaggacgcatttctaatggccagcttttctaagtcgggagctaataataccctcaacctacttgccttttgcagatatgtgtgacacaaagtatggataatttctgctgaattgaacccataatgaaggaatttataatcagttctaatgtatttgagacccaaagtatattagcccttcatcaaagggaatgataaaaagcagcattaatatgggtggatagtaattatttcagagctcataattattctcctgttaactacagagaaacgctgatatttttactccctttttaaaaaataaaaggctctggtcggattctgaaatgtaagaatgcatcgcacgtcctttaccagaacccatactttgaattatgctcatgttaatcgaaaagaaactattttggaattaaatgagttcaaagttcatgttaggagttccctttaccttgcttagtcctgttgtttcaccactgaatttatttattgcccataggagatataaagtatagtaattactctcactccctttcaaaatgacaggaggtctactctcctattaactctaatgagagttatgtgtgtgttcctcagggaggacagacccaatagagtttcaaggtagaattaatcacttctacacactggttttagtggtctcatttgctttatattttggtgctttgagatatccatttaaactgcttgtattgaaaatgcagtatttgttgtttaaaagaagcataagctgtggttagaatgttgttaataactgttatttctatttgaaggataaatgtgttaccctttgaggaaatgatgttgctcaatttacaggaatagagtgtctaaaatgtgactgtctacttttcataaaaaattaatgccaattaccttttacaatattttctttccgtttaaaatgttttaacatgagtgattacatcagttctaacagtttagaacaaagggaaagtgagccagagagctggatgccctagcaaagaagggagctctaggcagaggtggtgttttgtttccagcaggggaagagggaatcttgagatcatgtagggatctgctgcggtaatccagaagcatatgtttactccactgaggcttcctcagagaaaccagtgtggagtttctcagtttgcagccctgaactctgtagatatttattctcagtgcctttaggcgtagagataaaggaaatctgtgttctttcttcttataatcagttttgcccaaaactgttaccaaccctcttcttcctagggaaccttcaaaaatcagatatgtaaaaaattcttgatgttaagaacacccagatatactgaaatcactaaaatactgctgtaattcgtactatgggaaaaaacttactgtcatctaataataacgttttatttagtatcaataaatgaagtgtattgggataactggacttaatcctcctccaggataatcatatccccatgatgctgaagcaatatttgtatttgcttctaattcttcagatttattacaataaaagatgtcctatacaatgcatgcatgcaattattatctcacatcaggtaagagaaacacagtttcctaagtaaggaaggtaaaaataactaatgtagcaaaaaacaaaaaataaaacaacaacaacaacaacaaaaaaaaacaagaaacaaacaagcaaaaaaactgatccatcaaccatgcatccatggaaaaactctctgtatatatactgtccatgacttctctacatatgccctcaactagcaactgagagccatgtgccacatgcaaagaagtgggcgatgatgttttgacaacaattctcttactgttgcaactcatgtaggcccaagagctagccagctctaaatacatgtaaagtatatagaaagcactggctcagtggctatataagctgaatgattcctcatagaaatcatgtaaattgacttgggtaccctagaaggggaaagaaagacaattccatctgactaattcaagagagagctcttatagagccccgaacaaaatgaagacagtgatttaattgtgatagattttacacgtgcctccaaatattagcaaactaatgattcaggaaaaaaaatttgagctcacattaatgatttcttaatatagccaagaattaagcaaattaagtaatttaactaaaattggaaagtagatagtggttttggcagcaataaatgccactgcatttaaattgtgttgctaaccagtgaataaaaccataatttctacatagcagcctagaaaatagaaatgtatatttttttgcagtctttaagaaattacagaaaaattaaaagcttgaaaatataatttttgaagtctaatattttgagggatgctttgaaattggaaatattttaaatataatattctgattcagcaattttaaaatttaaatgaaaaaatatgtatagctttcagaaatgtagctatgttgttgcatgaatgtcaaataatcctaagcatgccttttgcatttaaacagggtcatgttaaataaatgtacatttctgtgaacttgcaactgagtgtcaattaatataaattattgctttatctatgttttctgttaatggaataattgcttgcaggtgtgattataaaagtctatcacttaatttattgtttatagtttccctgtctgtgtttgaaatgaccttgaaaccgtgacctttcaattgaggtagtcaatgggttacttcaattacttcatccatttctgcctttccaatcttctgatctttgacaagttattactgtttttcaaggctgtctccctgagctgatgaaacataactgtattatatcttatttttccccctctgttttctgggattgtgtttttcattctttgagagttataatagtaaatttagtttggaattataaatataatgaatagtaatctcggaaaagacttagaaattttgctaaaaatgtttaacaatctttccctatgaagtgtgcttagacttaatgcctgcttctttactatttatattattgaaatcagtacatgactttcagtctctttttccctcccttttctttgactgttattttatgcatgacaaaattctcttgcttactgctatgtgattggctgtcttttaacttgagtgtcgtgtgtttgtaatgattgctttttgcatgaggattattaaatgtcatgcaaattaaatggttgtggaaacaaaaaaagaatgtgagacttcacttgcttttttatgtgctgagtatgtcaattatgtgacacttaaaattactttcatatgccctttgacgtcccctttggtgtgctcctttattcttgcaaattagcattgttaagtataataaaacacttattaagcattcacagtgttttaatacaattattctcctcaaacatgatcctattataaataactatactgagcatgaaactgcactaaggcataattccattatattactaaattgattatgaaatataagccctgactcggtaactaccttaatagctaaacactgacttctactgatcgaacttttgctctgctgagtgatgagactatttagtgatacatttgtgcaggatgcaaatgtcttaaatccacaagtaatatttaaatgaaaacacatggggaaatatttgtgtaatgacaagtaattttaaaaagtcacagttttgaaaaatgtatggattaaaaatatgtgaaaaccaaatgttaatgttcttaaaaaaaagaagaaaatagaaaaagagcaacttaagatattcatatctctgtcttctctaaggttattatattgtctcaaattaaagaatgaatttgacctacttttttaatgttgccaccaatttaaattagaaaagacactgaataaattaagttctttcagctaataaaactgtttacttttttgtatgcaatgggtatttttttttttttttttaaaagtctttgctcatgacttgattttcaagccataatgtattttttatgctggatatatttacaacccaaatcttctatgagatatttttgggaaagggtttttttttcttaaacaaaaataggtagtcaattatgatgtgaccacttccccactctttttggaaatatccttgagaattttagtatttatatttattttttcccctcagtcttgtttattcttgaattgtcttttttttttttcctccatttctccgttctcaatcctaggtccccttacaaagaaacagacagatgatttaggtgataatgacggtgctgaagatgaaggtattttttttcaccaaatctatttgcatgacaagggcctcaatcactttttccacccctttctatttttttacttcttgtctttttttgaagagttgtttttaattcctgtttttgatgtgttttgtcttcttgcttgttgttacatacaaatatagagtattaatttttttaaaaaattaatattaagttttacattttgatgccaaccattaaaatgttttaaaaagaggggcattttttttttgttttcttgaactgacttttgatatgtttcatcccacattttgactgaattttgtccaccttctttgaactaacaatctctcccttgtagtctctctgtgcccattttgcatgttttctaatctatgtaaatattttcccgaatattaaaatgtgcttcatttttacattcgacatttgttttaaaaaaacacacacacccaataaaatgaaggacaagctgaaagctaatataaagtgtttcttgagcaatatattttaatgtaaaaaatactgttttctgtttatttgcttaaatgtcacataaatgcaattaaattgtatacataagaaaaggcattacaactatttagaaaactgtagtaaacattgtacaaccatttaagtattctggactcctgtagtacttttgatagagtctgtagctattttcttagacaagattcaatgaatattcttaatttcaaggagacatgatttccagattgtcaaataaaatattctgattttcaaacattgcaactataagcaatagaatattttctacttcattaatatccaaattgtttctccttacaactttcatttgacatacaattctgatttactctgtaaacctatgaactcactacctagattgacttgacatttctgatttcactgtacctttacatggtgttaaagtgagctcatcttttttggttccaatcaggattaaagtttatgctttttgtttgttcattttgttatgttttgtaatcccaggtttcagagtaagtgccagaaatctagaaattaaatctcataacgaaaataataatgtggttagaaaagttttccaaaataaaataatctacaacaaggacagcaaaagttttgttccatgagttacaagggaactatgggtaaataaatttttactaaaatatttgccttatttgcattgacatatatacatttaataaactccttcacaacagataattaaattacagaggtggagtattgagaacttaaaaattatatttggtgttaatatttttgaaacacttaagaattattttgattaaataaaatgtatgacatttgattaaatatttatttaccacgaacaccagcagtggattaaagattaaacacaaagcagtcattaatatttgaaacaaatcattatcgctgtccaagagttattctgaatgttaaatagctaaaaataaacttatactatcaagatgcaaattctgatattttaaacactatttgaaatttgatgcattcaaacattcaggatattttgtgacattgtagaacattaattactgtttccaaaactataagaagactacttccactttcaggctttgggactttttgaaccccttgaaaatccttaactcctagaatttgttatctaaataatactgaaagcatacaggacttcttcatgtgtatctttgtaaaggccaaattttccccatttaggcaaagggttaaaatacattattttcctattttaaaaatattttgattgcttatttaatgtgattttttttttccttttgttaaaacagcttcaagtaaggcatttacctatttagagtaggtaagtctgagcgatcatagctaggccatgtaaacctgaatctattttatagacatgttttgaagcacatttaacatttttaaatagccatttaaaatatcctaaaaccctattaaaatgtcaggtagtattcaggttaagtactaagccattcagtcacaagagttattgaatcaataaatatttttaaatactcaaaagcgtagaatgtcaaaacagtcaattccagttcggtctcttcctctgtgttgtttcagataattgttttgaatacaagaaagatgaattcagatatcctacaggggaaaagaaaccttttatagaaatttcagagcatttttaactcaattctttttatcattattttgtagatgtgactgtgaataaaaattgtgatcaatattgaatttgttccaaatgttgactcgacatcactggacataaggcaacaaatatgaaggacttgataagtaacttcatttacatcagtcagaagtcaggtcatcagatcacttatgtgaaattccccacccagttcccctccacctatgcttcatttcaggtcccagtctcagccactgaattgcaaggccactggccatattcctgggtatacaaaaagatatacaaaagaatgtatatctttttttttttttttgacagaatttccttttgtcatggagactggagggcagtggcgtgatcttggctcactgcaacctccgccctcgtgttcaagcaagcaattctcctgccacagcctcccaagtagctgggattataggcgcctgccaccatgcccagctaattttttgcttttagtagagacatggttcatcatgttggccaggctggtctcgaactcctgacttcaggtgatccacctgcctcagcctcccacagtgctggggttacaggcgtgagccaccaggcctggcagaattgtatatctttaagacaattccatagttaaaaacaagactaatctgaagtgacaaaaatggttcaaagtaacatcccagatttctaccaacttattttaaaaatttaagaagtattttaaaaatttaagaagtatttttaaaaattttaatggtgctaataatgccttcatattaacatttcaatatttaccctgggtgtggtggctccacaccctgtaatcccagcactctgggaggccgaggtgggcagatcacttgaaatcaggagtaggagacaagactgtccaacgtggtgaaactaaaaataaaaaaatgagcccagcatggtggcgagcacctataatctcaggtactccggaggctgaggcatgagaattgcttaaatctgggaggtggagattgcaatgagcccagattgcaccactgcaccccagcctgggccgcagaatgagattctgtcaaacaaaaaaaattaaatgcaattttatatactatatagttcaagacaattttttgtagattttgaatatttttaagctaaaaaggtgtgtttaattctgttatgtccagtttaacaagcagaaattcagccaacacttctatgttcattcagtggttctgaatgataacttgaggttcataaaaatgactggaggcacaaaagtctgccttgaaatgtgtttttttataatagagaaagatttaattgaggcaatacttcacaattttaaaactgttaattctaaaaactctaaaatatgggcaattaaatacttcatgagtcctttaagacaaaaaaaatcagtaaacatatttaatgattatatcactaataattattcactaagatcattaatggaagttgtaatttcaaactctggttgtcaggtacaaataaatccccattaactgctctagatctattgacacttgctacattggcttaaaattttggtctataagaaagataaaataggtactaaaattttaaatcaaggtgtttactcagactccaatttttttttttaacttgaagaacttgatttaaatgcttgtgtttagtaaggcttaaaaccattgcaaataatggaaattataaacatgcctgacaaacatttgtacttttactggaactgagttagtattttaaaatttctgagtgtgttcttgtgattttagtaaagtcagtagatgctgtttaggcaaagtaaaaaatcttaagtgaaaattcatagttcacaaattccactatatttataggtggttaaatatgtaaaggtttaaagagacaacttggctctaaaaaattaattataaattaataagctgcatttgatatatttgcacagaagataaatgcccccttcaacattattattaaaatgatggaattagcagatggtattcaatggtaggctatctgatatattagttttatttataaagagtctggttctttctaaaaacaaataaatagttgtaattgagagcctttagattgctatttacatcaaaaaaaaaaaaaaaccctataaactaagcataaaagttaagcctaagatagaaatttgtaataaaacattatacaaagtaaagcctggccaggcatggtggctcacacctgtaatcccagcactttgggaggccgaggagggcagatcacctgaggtcaggagttcaagaccagtctggccaacatagtgaaaccccatctccactaaaaatgcaaaattagccagacatggtagtaggcgcctgtaatcccaactactcgggaggctgagacaggagaatagcttgaacactggaggtggaggttgcaatgagttgagatcacgccactgcactccagcctgggtgacgagagtgaaactcagtctcaaaaataaaaattaaattaaaataaagcctaaggtggaccactctgacaatgcactattaaaggcttccatttttttcctgtaacagaaaatatccaaagtttctacagtttctcaaactttgttaacaatattaaggtttgttatgtccaagaattttacctgttttagtaagtatcataattacttttgcaccagcctaataatactttttataacctaaatctcagggttacttaaaatgaaaaatatttttcagaacacagcataagaatactagagaactttatggaaaagaactgctcaatatcttaagttattaggcaaggctgaaatttgaaaagtttgaaaaggcaaattaaaaattaagattaacccagactatcagtaatccttttaagtctaattttcaaagaaaaataaagagataccactcaaaatagctcctagaatctattgtcatattttcagtgttttctgacaatgtccacttaattctgttattaaatataaaacgtggcaggtcttctcaatgtgtgcctgtattgttgtattgttttccaggtgaacagaatggttctaccaagatttcattactgttcacagttggtgctttgtaattctatgtaattttaattaaagaagaattctgaaacagcctccctctgtgctacctccaagcatacaattagccgagtacagtgtctgctgtgaacagtcagttaatgatttcagtttaataatttattattgctttttcagtgccagccacactagaaaaataagaagctgaaactgtatgtagcaaacaggcatttaaggtgcacagtttaacaatctcaaaaggattgctttctctgtgtaagtctaacatctccacaagcccccagatctttataaatgaatgaatactatttttttctcccaaggtttcaaggagaaaataaattcagattttcctcttaaatgtgtctgtgtttagtgaatggttcctatgtcaaagtatccttccctcactacttaaaaacaagatattattctcaaatatacctttggggaattagaggggtactagtaactttatacactggtattaagtcaaatttaaatagtcttttaaaaaagtttgttaagttctgcaatgagccatttccccaactcgaaaatctgggcaaacaagctgagctgcaatccttgacctaaaatgattcttcatttgaagatatcactttattattacgctagagaaatcaaggcatttacattacacattctatttttttacaaaaaatgcaaagcaatctctaagtaatcactagttctttcaataaatttgtattctgttagtccattctgaaaactggcacctcgattataaggatgttggagagttaaaagtgataaaaaattttgaaagcaaaggaacaaaaacatactattaaattatacgttttaatattggcataaaaaaagataatacatttgatgtaattttgtttcaattgtgggtataagagatcatgggctattacataatagtaatgttttctttatgtatatattcagagccatatatatgcatacatatagtagttcaaatatttcaatctatataatacgtagatagaactatgtttgctgatatacacagttaggcttatctacagaaatcagtgcatttttcatactgattaaaattatgttatgtttatttatatattatttctagatccttgttgaaaattacagaattcaggaaaagtatgagaagagcaaatatatttaataaaattcagagctgtagaaatcacttgaaccctaaatcttgacactttacacttgaacttagctctatcccatcccatgtctacatgataaaacatagagccaaagcgtgaagaagaagagtatattagccacacaaagaaagtgaaaaaatatttgtctgttctcttcttccaaagggtaaggagagctggatatagtggatgtcctgaatttcctaaaaaatatcattctaatgacatttccctaaatgcaacaagaggagcacagatgtacatgactttcgtgcctaaacattcatctgacattacttaggtagtaaactgaaacatcttgcataacacaatactgtaattatgttcacaaattggagcataaatgagttgatgtaatcatgttgcatttgacacaaagttttacagtacataagaaaggttaaacagattcttttgttcacaacagcaataataccattgtctttagtttatggctcataatgtcatgtgaagtctatcatatttttaaaaagtagtcctaagaatcattgccattctgtttcttttgcgtttactgtcacttgaggaattaatcaaaatgcactaaaattcacatctaattttaatttgtctaagttttataagtcagtttgcaacttgtaaacaaaattttgatagaaaacaatggatgcctattgctatttccacaatagctattcatatgagttgcttaagaaacactttaataaaaacagcagtttaagaactatattgaaattatgccctcttttcactaagatggaaaatgtattctctgcttcattgtgtgttatttttgaggataagaacgattgccaaccatttgttttccagatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtaagaagagtctctcttttgttttcaccatgaatccatgaagtatgtgatggttttgttttgacttgttttgttctgctttgctttgtttcacccatttttttatgcgtgttgacattctcgagcccaaattttttatagtttcaatgaattctataggttggttttaagatgtgaaactaaaaggtgatgaaattattcacattgtcatggaatgtacttcctggtttataaactatgaaagacaaaatggcagggccttattgaagaagagtacatctttgaacaaatatttccttcttctgcttttctgtttacaatactctaagtttccctgaggtttggcgtgagctaagactaagtttacattctcttctggagtatgtatatggactcgcttttgggaatgattgtttgccattgtgatggaggtttctttggtttgttgttgttattttggttccataataattagtaatatttttctgaatgtattctgattgaattatttaatttgaaaaaacatgcattgattttataaagtaacaaagaattcagttcaatgatgtatactcttgccaaaagaatgataaatacaaagtggagatttttagctttgataaaaagtatagagacatattacttataaaataacttaggtattctgagataggcatgttatcttatacaataaccagtttttaaaagataaacttgctattctagcatatatttgtttgttatagtattaccacaatttgaggagtaaaattactgtatgatttagtaaaacatctttatctgtgatgtatttaattaacagaatttgctaaaagagcacaatgcatccacaaaatacttaactttttaatcttaattgtcctccaagtcttatcccatactatagacttgaagaagcgtaaattataattttgtttatacacaaagaagcgcctcactctttcattctattatctaaaagattctgaaaaaggaatttgtattatattccttccttggtagtatcatatcttttatccacgttgagaatcagaatttttccccttcagtgttattgtaactcctatgtaatcataattctgtgtttatgcttatcacaaaatattttaaaaggtagaataatttttgtgaatcaagtttatagtctgggggaaggagacattttaccaatgtgaaggttaagtctcagtcattttctagtttgcttttttgaaatttggagtgtggtgaatgaccatagatgcactgcgtaagtgtaggtataaaatattctgtagcactgatcgaatacacatgagttcctccatagtgtctaatcatccattgcttcaaacattcatatgatttctgtgggctgggatgagtgtctttccaccagtgaaaactctgtgtatttaagacatataaataattgctcataataattcttgaatcttaaaccttgaattcttaaatcttaatgttgtcatttgtttcctatggaacattttcattggaaggagggtttttaatattttcatgcattgaatcttaatggtagtattgttgagagctcagttgtttttgctgattattattcttatatttttctaatttttaagttgaaaatcctgagcagtggccagtttgccagatgaaactttaaattgaaatgctaaattatggtaacagtgtttttaaggacttgaacatccagttattcatatttatctattttatttaagaaatgctttggccacaagtttttttgcctctttctgttattggttctgtttatataaagcaagatttcataacataaactttgttgttatgttaacaaaaactttacccattctttttctttttatgtgttcagaactgatgaggacttgactttgacctgattttaatcctatattcatgcccataccccattttaaatgccgcactgtgaggattggattgcaaggcaatggattaactcgctaaaatataaagcactcagtcaatcacttggtttagatagtagcagagagcagacagtattgatattatcaaagtatgatttcccagtgttaaatatttgttctggctctactgtaccctagaatataacatttagttgtctcctctcctttatttctcttaaacacattatacactgataacaagccaaaggctgtccttgataggcctcctctcaacgtgacaaaacataaactctgtgaaacattgtttaggtagactttaagacattggttctcgaacagaggtattctggtcacttttttccaaaaatatgtgttgggtattgtgaaaatgtatttaaataaattaattcataaaaaagaaattatcagaacatttgtttcagcatactttgcatgagtgccgcaccacagcaagatcaacagctcatcggacagaactgcaacaataaagactgtagacttttgagattgatgttgtgaatagtttgtctaacagtaaaaaggtaagccaaggtttcttgggtgtgggatccaagactatggctgtctaatttgcacttgagtgattaagtaggaaataagatatgatcccacatccgaggaaatcctgagctgtgttttcactggggtattttggtgtgaaagaaatagatttgggggtccaatggacaaactgggtaattacaagatcattgatttgaggcgactggttggaacaatcaggatgtctggaacaggtagtgcaatctgtgttgatttgaacttgccatgtggaggtggtggggaatcttacaagttttgttttttgctctttgattttagtgatgaatagagatgtgataatgttttaattagaaaattcgtacagctatctagctgccaatttttcagtttaaagatctcatgttaaaaaaaatttgtttattacaaagtaggaatagaatagaagaaaaaaatacctctaccattcctcagaagaagctagtaacaggtcagaattagttcttctaccgacaccctttagtggtttcctttccagtggtaacacagaatatcactcttactgtgtggtgtatgattttcccccaccctggaaatgctattggaagtgataggaaaaactgccaataagattgacaaagagggaagggaatgcaggactctgcctactaacctcactccccagtttcatgttagagctcctggcgacctcctgccatttagtttcacacttcttatacactaaatatttaacttttctttcacttttgactttacacattctttgtcctcagccagttttgacataaactttccatatttgctttcttcagcatctattatttgatatattgttacatagtccttatatatgtttaaaattattgttagtagggtattttttaaacattctattgtatggtttataatcatcttagaaatgtagggagaaatggccaggtgtgatggctcacacctgtaatcccagcaccttgggaggccaaggtgggtggatggcctgaggccaggagttcaagaccagcctggccaacatggtgaaaccctgtctctagtaaaaatgcaaaaatcagcttggcgtggtggtgggtgcctgtaatcacagctactcgggagcctgaggcaggagaagcatcacttgaacctgggaggcagaggttgcagtgagctgagattgcgccattacactctagcctgggtgacaagagtgaactccgtctcaaaaaaaaaaaaaaaaaaaggaagaaaagaagagaaaagaaatgcagggataaatacttgatgtgttcttaaaggggggaaataatcaaacttaaatgttctgattgtaactagggtaaacatgttcttatggacaagaattatagaatatataagataagaattgaaagagaatataaaataagtcactattagatgagatgtccacaaaacattttttaaaatagaaattatttaagtgatattgacaaatgtcaaacatgaaaaacatgttaagtaatttatcattaaaatgttccaaccacttatttaaattcagaataaatctttaaattacttttggagtaaaagaaaaattttaatacccctgtgaggatcttacttgggcaaacgagattttaatctggtggaaatttaatcagttacctttatcttgacataaatatcttggaggcaattatgcaattcataattctagcacatgtgatttattttagaaaaaaagtttaaatattttagaagtactgatatctatctggacatttggcacatttttggaaaaggatctaattaaatattttacttggtaattgaatatttacaccacccgtccatggaaaaaaataatttaaagtgctagctcacctacttatatttaaacaattagatttagcttactttataattctatgtggggctaaattgtttaaaacaagcttttgttaacttcactgcatatacatttaatgaacaccttaatttatttttattctattagatatggttaatgaaattttttgattcttaaaattagactatctatgccataataatgcttcaagtattattagataaatggcaacaataagtataactttaggccaggcgtggtggtgcatgcctgtaatctcagcactttgggaggctgaggcaataggatcacttgagcccaggagttcaagacaagtctgggcaaaatggtgagattgtgtctctacaaaaaattttcaaaaaattagccaggtgtggtggcacatgcttgtattccgggctacccaggaggctgaggcggaaggatcagttgcgtctgtgatcctacaactgcactccagcctgggtgacagagtgagatcttgtcttaaaaaggttgtgtgtatatacacgcacacacatactatatatgtgtgtgcgtgtatatatatatatgtgtgtgtatatatatatgtatttttatatatatatatataaaactttggtgtggtcagtcatcaaatcagtaacacttgttttcagcattatacaccttttctgagggataaaagtgaggacagtatagtttttatctttaaaaaagagctttcactatagttgaggagaaaaacagtagagaataataattgatattctactttatatttataatatattgatttattaattgatctatatgaatagattcacttgatatataaaaggaaaacagaacgagagaaaagtaaggaaaggtagaatatctgatggattagtaaggatatagtaattgatatttatatttgaaactgattggcctaggatcaaggaaatttgctaaagcctgtgcattgatcatgatttaaagagcaaagcatattaattcctcaagtggtacaatgttttgtcattgttactcctgtttattgaattgtttttgtttctgtctgactctttcaaagaacccccaaaaaacaaaagtctcatactccaaaacaaataaacaaaaaacttcaagtgggatcatatatttaagagtaatatttaaacaaatgttaaattttatgcgattgtaatattctacaacacatccaaatgcgttcttgagatgtagaaagaaaaagagtcagtgtgtctatagagtccagactgttttcatggaaatggtggtaccggaggaaggccacaaagagtggagtatccttggtattaattgaaggaaagggagaaagacagtctttatttctattttcatttattcatactaatttgaaaaagtggaagtaatttgtgacaatgcacacaaataaatagattggtaaaatcatatttgaatagtaatacagagaaaaggatacagaaagttaggtcatgaatatgtacaacagttgaacacagatgcatttcctagttttctagaagcacagtaaaatataatggatttaatttcataattatcataatcacaaaaaggaaacaaacatattcaccagaaaaaaatacgcaaataatagtttctcttacattgtactacagaagaatttatcatatgggttgtatttcttctatttgaaacgtgacaatacaggaattgtgtgatagtcttcgtgtcattataagatgcaaaaatattctcagtatatgattatttatagtaaccttctgtaaaaaccaaagacataataaaggcagctggggaacaaaagcggcgaggccgagggctaggcctgtgtcctcccacggacgaccgtgacttcccagcagcccctgagctgggcccgcagggttcgtggggtctgtggctttcacccagggtgcgtgtctcgcccacaggggcaccccatagtgtcataacttcataagtgctcataacttctataatatcattttagcaaagagctaaccaaaggcaatctgggtaagatatttggtgatttcacttataataggatagagctaaaatacaatttagagcaatggatggtttatttgatccatagatttcttctctcaaatatgttatgtcaactgggttttaataagggctagatggtaatcaattttagattgagtactaaaatgagctcctggaatagagaaactatttgtcctgtggcgacaggtgcaggggacaactttagataggtaatgatattttgcaaagttgactgctcattatttttattcccttactccctccaaaatggtttcaagtggcccgcagtaaaagcaactatttatttattcccaaaacagaaacaatctgaaagtaagtgtgtcaattattgtggatgttagttaaaagaagtaaaatggtgtgtgttaggtaattcattcatgtattcgttcagccatttattcccttattctctataaattgagcaatattatgtatgtcattctcttagctattaagtatattgtgaaaaataagatatatgtgaaccttgctatcagtagattgttagctttagggaaggtagaaaataaataattaaacaaatcatatagtttacatagataacgattgaatgcaaagttaattttcttagcaattacctatataaattctagagaaatagtgcaatgagaagggagctactttattttagaaacacagagcagtttccctgaggaggtaacattcaagtttccatttctttttttcttttcttttcttttctcttctcttttcttttctttcctttccctttcttttccctttctttctttttctttctctccttccttctttccttcgttccttctttccttccttccttcctgccttccttcattccttcctttttcttttttttttttaagatggagtctccctctgtcacccaggctggagtgcagtggctcactgcaacctccgcctcccaggttcaagcaattctcctgactcagcctcccaagtaggtactacaggcgcctgccaccacacccggctaattttttgtatttttagtagagatggggcttcaccgtgttagcaaggatggtctcaatctcctgacctcgtgatctgcaggcctcagcctcccaaagtgctgggattacaggcatgagccaccgcacccagccccatttcttatactctactgagaaaacccttgtcaagattcccaaagacctctagattgccaacttcattagtcacttctctgtttttatcttgtatgatcacttcctagcacaggacacagttaaccattccttttttggcctgcttgtttcgtggtatcacccaggattttcctcctacctccctgactgcttcgtctcagtctcctttgctgactcctactctcctaccctgacctctaaatgttgtgcaattaagcataatccttggctctctatccttctctctctatgatacgccttaaagaaccctgtgcattaccaaatgccatctctatggaagtgacttttcaaaaccatgtcttcaagactaacccttcctcagaactccagcctttcatatacttctgtgtaccaacccttccatgtagatgtttaatgaatatcttaaacttaacatggctgaaatatgttgaatttctcaggcctccttttcttattgacttctacaactaagttataatattattatgtcattcttttagttattaaggatattgtgaaaatccttaaattatattataataattaattataatagttaattaaatatatttacaaaattataaatataatatagtcagtaatgaaatactgtaattatatatttaaatttttaataatagttataattaaatctatatctaattataattgtcaaatactataattataattattataagattatagcctagttgtagaagtcaataataacctaataatcattgcaacaagagcaatagtaatggtggccacattcattgaagacttatattccaaaatttgttttaagcaatttacatagattgcattattacattctcacaactctatgaggtagcattgttagtttccagatttcataaatgcagaaacaagtgagtagagaggctaactaatgtatttacagtcacacaggctaaatagcattcagtggtggaaccaggattctaacctctcttaaagcaacactgtactgatgtcattgccttatccatctggatgatcaagtaaaaactctttattttcctaggttttctaaaacgctagatttaaatcagcgaaattatcttttaaaaacctgcattataacagctcacttctctgcttaacccactctagtggctttccattattcatgtagcataaaattcaaacttcatccctgccttgtctggcaaaagccctcatgaagtggtcctggcctgcatttcttagctcatctcaaaacactcttcctctctgttccagtggtcatttatacttcatagacatcaaactttctcccattttaggcattatatgcctggtgtttcctctaccccagatctttgtggggccagttctttatcattctgatttggtttaaatgtcatcttctcagggagatcatccatgttcatccaatctaacaagagccatcacttcgtgccatctcccttttaaaattgtctgcattactgcattacagttatcatccctgattatcttctgtttatattggtattgttcattttgttattgtctagctccacaaagcccaaaatagtttctggcaaaggatattttatcagaaaatatttgttaatgaatttaaactggatctcaagggtcaataggtgttgatcagatgtggtcataaagcggagaaggcagagctgtgggcagaaaagagggtctgggtgaaaaccagaggaaggaaacggttttgcatgctaacagagctcagcaaactcagctggaatgctcagtgttaaataaggttaaaaacataggcagcaggctgtgcagcaccttgttaaagatttaggatttctatgaacaatcagaaacagttataagacactgagcaggtaagtgacatgattagatctgcatttaaaaaatgttttggtaggcctagaccttgatcaaagttgacattctgctgtggatacaaaaagcacggctaatacctcgttaaagtgagacggttggtagtcaatggatgaggcagatattttgctcatagaagattgagggacctgctgaggctggactcactcaggtaagtataagaatctattttttacacaaagagcaacacagattttggcagtttttcttcctttattttgataatggagtcaatcaaaccagcattgtgaagagttcttctgaatgcctgctttgaaggagtgagaatcaatatgagttatatttcagagactggcaaatatgagagattataatatagtaatctataatatagtaatcatgtaatcatgatgcctccttatttcttaatgtttctatggtattaatatggcttcatttaagttttgagttgtcctaaaaaggatatcttattatttttaattattgtcttaatagtctttgggcaaattctgggaggaatttgagaaaatgtggtttgtgattttctcaagttgttaagatcagtgatttggaataagactacagaacatagtatcaaaatttccctcattgctagttaaagcattcttctaggactagaattcaacaaccatttccaggtattgataggactacaactaactaaacaataaacaaaaatatatttagctttctttcagagcagaagtcatccttttaactcattcattcatttattctttcattaattccacaaatatttattaagcagccactatagccttctaattattggtgtttacaatgttaaaaaagtcagcctcaatccttcctctctggacctcagagtgagtgagaaaaaatgacattaaacaaatgaacaaaacattgaatgacattaaacaaataaacaaaacattaatacaaattttgataagttgtatttccaaaagaacgatgtgctacaaaaatgaatttttttgaaatgtagactgagggtttcagcacagttttatgagtttttcctgcatgcatttacaaaattaaatattttgtaagacagataaaatattttgaaataattttaaagctgtaaaataattagaagcagaacaaatcgtttaaaaaagcaactgtggaaaaatgcaaaatccagacaaacaaacagaccacccacaaccaaccaggcaaagttctctatctgaattaaatgagcaaaactggtttgtaaaatagaaaatacacagggaaaatatcccaggagagtgactagcccttaggtagatatttgatctgtggaatggacgggtaaccttggaactttgcagagaaaataaaacgttctcttcttcacctgcctataactctgagaaaagtcatgaagtgtaataaattagctgcattactgactttttaacaacaaagatatgggtcttttcttcagccagggtcagttttttctctctgttacaaaaagacaatgagggcttggattttgctttttaattttgttctgcctttgaatagttcttttttttttttttttccagtaaggaactaagggagtactcccttactttcccatgacctggtgtcatgatctttgatgttctgcccacttttactgatttgcctttaaaatatagtgcaatttcatatgccaagacatcttgtttattctttctaaaatcctttagaaagggatttctaaagtctttccttgaactacttactctgtaaacatatggatactgctccttttcctttgtctttttagttttaatttgcagagttcattttttaaatcagcttatgttagttttcttctttctattcccattgctactacctactcaccttgggttaccaagtgggtttttggctgacccctcatcctctagacctaaattcatatgccaattgcatcccacaccacaaccaggcaaattactttaatccaagagcaccagttttctttagcttttcctctgctccacatctctaaacggttctcactgactctcggatccattccacagttttcctgtcattccagatctgctgaattactttgctcttcttcttgtcaaactttaccttctattggtttctgaggaagccttttcaggcaggccatgctagactcctcactgcctaggacgatcctttccaacagctgacctgccacaaatacccatctttctcaatcgttgtagctctattatctttctcccttcaattctttgggcttcattcatccctctcttctctctgcttccgtggcataagcagcttagtctctactttggtatgcataataccaatcctacttgttatggttatgtatattaactgcttaatatggtagatgactcaccacccaaattaaaaaatatctggttttccaattttattaagacaacagactgctctgcatacgtaatcaaaagtcatcaataaatatagaaatgaattcactgtgtgcccttctcaggatatgcatttctaggaatacagagcaggtagaaagagtggctggtggtatggaatgtgggtaataaattgtattaaccatgtgcttgcacaggcttcctttcaagtcccaaatacatgaggtgaggccttatcctggctaacacggtgaaaccccgtctctactgaaaaattagctgggcgtggtggctgcgcctgtagtcccagctactcggtaggctgaggcaggagaatggcgcgaacccgggaggcggagcttgcagtgagcggagatggcgccactgcactccagcctgggagagagagcgagattcagtctcgaaaaaaaaaaaaaaaaaaaaaaaacgagaaagagtagcaatcctttacctcaataccagtggcaagaaagtctcctggattttctagagaagtattccttgttctgagactataatgcatgaaagctgcaatttattttaaattgaaaatagctatttctacatttcccatattatttgcattcttctggttcctgctcagcatgaggtaagtgaaagcgttggtgctcataagcattagataaacatgaaaatagtgttgaaatgctactttttgaattaaaatgcagtaatccccccttatccacaagggatatgtttcaaaacgctcagtgactctctataactgtggatagtacagaaccttaagtaaactacttctctatgcatatgtacctatgataaagtttaatttataaattaggcacagtactttattaacaaaaataataataaaacagagcaattaaaacaatatactgaaataacagttatgtaaatctagtctttgtctgaaaatatcctactctactgtaagatatttacctattttcggaccatggttgaccagaggtaaccggagagtaaaactgtgagtgagggaagactgctgtacatacgatattgcagaaggataactattcactttatatagataataggctttggaacctgtaactttttgaggctcagcttaatgttgttcatttgtaaagataagaaataaaaggaaattgtttgtagtttaactttgccttttgatacttcatctatcttgaattgaattacaggtgcacaaccattatcacaaatagagatttgggtgcaatcttaaaccaatccctgattaccctcacacccactcatcttttataacagtgtagtcaggaccatagatttaattatattctaaaatttttccccaaatatggaacaaatgacatttctcgactgatttatgtattggtaatttcaccatttacaaacctttttaagaggtgaggcatatccctgagatgaaacatatctaagagaaatactaatttctgttctagtatttgctagcttcttgcatctgagctttgaaaaaagccatctttactggagaagtcagttctctcagagaatatgcaacatgctcaaacagaagtaagttattaaaaacattctttgtggtaatatcaccataattaggagcaattttctgacaggaataagagatgagtttattcctatgttatttaattatgctagaattctttatgtttttgactttgtatgaaaataagctttaagaaatactctttattcttttttaatacaaataaaacaattgcttcagtagatagtgtttttccttaaaatataccacaattttatctgctttaagtaacaagaaattgggattttagtgaatatatttggctcttctgttttagtatcaatctgtactatttactaaagcaatttatagtctacaattcatatttggatttattttttggaagaacatgtttacagagaccacagatcagacatatataactttttccctgattccaagttgatctgcatctatatgagaaaaatctacatagtcccttagcgatattttactataattcatacaatcttgttatttaggaaagtaattaaataaataattcatttacctatttttacccttccttgtgctagaaagtatttgtgagagcatatacaataacattatgttgagatatacataataaatcaggtttagggaaaacagaagacttgaaaaggcaaataattctcaaaatattttccaagttgatgaattgaaactctgccaggttttattcattttttaatatcagaaggttgtgaaacatgacaagtcttcagagaaatcaaagttattctaggcactaagctctgcaaaagaaatttctcctgtgggactttatatgttggggacagttaacaaaaacagaattctatgataaaaatgcttttaaatagaaataagccaaaactgtgtagtttaattttatttacgatccgtacttccatgtactctgtttagttgtaaccatctactccatgcattagcttttctctacctattcagagtcagcatccaagtggaactgctcggggattccaatggccaaaagacccagcaggggtgattaataagtaataatgatttctgtgtatgtgggtattccataggtaaatgttctaattgaatattgttttgcatgagaaaactactgattataggttgaacatttctaatccaaaaatctaatatctgaaatgctcgaaaatctgagtgtttaaaattaccttctggctatgtgtataaggtgtatatgatacaaattttgtctttagaattagatccttattatgtatatgcaaatattccaaaatccaaagaaatctgacatttaaaacaattctgatccccaagcattctggctaactgttactcaagctatatttcacttttctgatccgttaatataggaaatctgaatcaatgggtttgaataaaaaagagcttctctgtggcttgccaagttcatcagctatctttaagaaggagagataattgacttatttttcttttttaaaatgataccatataattaagaaagccaaatttttgttttctcttattctcttaaaaaagatctacttgctatattgtccctttttttctttttttgtacaatgcttctgttacagtctttatataatagtttttaaaaacctgctattttttggaaatagaattaaaattgagtaacttcaatttaataccatgtcagttaattctctaagactgttctatatgactcaagtggcatacagtagatgtcagtggaaattcctagttgcatcaagatcaacaaatcccaattaaagatattcgcatataatttttaagtgtacctatatatacaacttctatagattaaaaattggtctattagtctaaacttgaatctgtcataagttgtgagtctgttcttttaaatgtttcttatataaatctctctatccaccacctactacttttggatcggtgctgtctaacagaaatatactgcaatacacatacataatttgaaattttacagtaaccatgttagagaaaagtaagaaaaaatagataaaattagttttaaatctttatttcgttcaaactaatatatccaaaatattatcatttctaaatgaagtcaacataaatttattaccagggtactctgaattttttattctttgaaatatgctatgtactttatattgtacttacaaaacatctcaattcacatgctaaatcttcaacagcacatgtagtagtcccactaaacaatacagttgtgcataacagaaaacactgtttggcgctgcttcatttaaaaaaaattaaatcaactaaaattaaataaagtaaaaaaatgcagtaacacagtaacatgagccacatttcaagtactcaatagtcacatgtggctattggttaccaggtcagacaacacacagttctacattgttgtaaataaagtttttaattatacacacctgttgggagaaatatttgcaacaagaaccctcaattcatggaagtatttataaattatatacatgtacatgatatgaatatattatgtatgctataaaataatagaaattttgaagattaatgagtattttaaaataatgttattttcttgttaatttaaaaaaaaaaaacaaatcttttttaatgctctgtgttaggaaaacacttcgttatttttaagatattccttttacattttgttttccagaggtttggaagagtgtttctaagatcagtttaatgtttggttttaatggctgttacagctgaaagagatgattcacaaagacacaaaagtacaataacacatttaaggagcagttcattgttaatcacagtatatttaaatccacataatagtcttatggataattctgagagctgaatacttgtaaaataggattaaattgtcatggtttctaccttgtaatgtggttggctaaaagctcattcttacagccaaaaggaaaaaaatgtcagctttgccattttatgtgactcattggtacttgtacaatcttcaatctgtggtttatttgcaaaaatcctttgaaccacttgctccatgcaaatgctagttttattaaaattgaataacatagacactaaattcacttaactaggtgcatgtaatcaattatgcccttgtttattgttgtttttaaaaaattaaataaagcaatgtgctttaaaacaacaaaagtaaacaaaggtgtaaggggctgctagacatctccctgccctcaggggaccgcatgtgctgtgtatgacatgtgtgtattgacatgtgcacttatatgacatgtttgacttacataaccaggaaagggtatgtatattttaaaagttagatttcttttttcttttataaaagatgcatataaatacaggttttgctatttttctccaacactcatatgatcgtgctgtgtctcccttgactaagcacttaaccattgtgaatattactaatctaagttaaaatgctccgtatctataggaatatgatttagtgacgttgtgtactgatttatggtttgaagattttcctcttattaaccgtatgtagccatttcaatatatctaatggaagtaactagaaatatctttcattgactagcgttgaacaccatgattttcctaaagcagattagaaacatgtaggttctttcagttttgtgagtatataaaaatgatatccaacaatctggcagccctaaagtgggcccaaatagccacttagaccttcacaaattgtgcccaagagaaaatcacagaaaactgtgccagccaaagaacaagtgacaaaaatgaaattaagatttctattttaaaaatatttcttattttcattcactttataagaattcaggttatgcttttttaaatttttggctatgacactctgctgaaagggattgagaaagcttttgagcaaaaattatttttgaaatgttgagagcatgattaattttcatttatttttaaaagtaaatttaaagttggaccatttattttcaagtggcatggcaataatgaccaattggaaatacctttttgcatatttaataattcttagtggaaaaaatgataagagaatatgccattttgttcaatttcaacattgattttgatttttatatcctttgctcagcctttgtagtgattaatattagtaagatgtattctgttagttaaggtttttcgttttattctatttttcccacagtatataattattattagaaaataatggatgcttacattgtgttctccaaagctcacatagttcccaacgaaattagtggaagcttacctctatttaacctgatctttatttacatggtagttgataagctgctttccactaatgagaattacatctgaaaggattagatctaagaaatggtaaaattaaaataactatattcatcattttgatcttttatatcagatcctaacatgctggagttttctcaggtgaaaaatcaggcatcttttgctacaagatatgttctctctagatcactaagatagcctaatccttaactgtgattttggtttttttaaataagtcttgtggtagagcaaagtagagttcattctgagtcatggctcagatggaaacaagcaaggttacacccaagactcaattaaaatcgtggctcatattctagtttatacctgcacctatgagacatactaacacaaaaaactaacaaatgtagttttttttaacaactaaaagtgcattagctgtgtgtgtgtgtctgtatgtgtaggaggatgtttctctgtcagccatgataggcaacattctgctgcaggaatagcaaactcaaaatattagtggcttaaaatgacaaaaactacttctggcacactcagtttcctctggaaatatagaaaactcttgatcaactgtcctccatgtgacatttctgtaactcagactgccttgatcttaatcttgtatctctgccatctcaatacctgacctcctcatttcctgaggtagagaaagagtagtcacagggttccacattgccctttcattgcctcaacccaaaggaacccataacattggctagaatgagagatacagctacacttaactgcaacaggactgggaaatagaaggaaacacatagatcgtgtcatgagcgttactgcctcagccatgattccttactcatttgatcataagcagaatacttaaattttcatgtctgatttctcagagatttatcctgaagttccttataaatagtttttcttcaaatgctggtttgcagtgttctgaaactacgggcttctgccgagggtgttaatgatgattcattcggttgaaaaacaactaggtaatttatcataggctagatattggggatacaaagaggagtgagatgcagtgcttctgacctgaaggagcttactgattagttttcaaaaaagatgtgtaaacgtttatattatactggtaaatgcattctcccatctattgaacaagtgtttattcattgcctatgaggtgccaggtcttttaatgggggcttgacttagcagaaaaaggtctctggtttgcagtgattatattttagatgggggttggaggaggtatataggaaacaaataaacaaaacagaaacatatttcatcagcaagtaatatgtactgtgaagaaaataaaacattgtgatctccagagaggaagctggaaaatctacctctgattaggtgattaggaaagaatgctctaaaatgggaccactaatgcaactacctgagcagccatacattccaagatctgatctggggacagaacgttctaggagtaaaggtcagaaaaaaacaagtttcttctcttgtaattagttagactttagaagacaggccagtggcactggagcatagtatatcaggaacagagaggtaagggatgaatttgaagaagtagggaaaatccagattatgtagagtctgtaggttgaggtaaagattctagtgaagagatataaataaacatacgatatttaagggaacaaaattgcttctgttatcttaaggctgggcaggagatcagagaaaactgttctcttcggagagaggatgcctgagctggattttaaatgaggatgagtcagttggccaagaagtgtggagggtcagtacatgcagaaaatatttagcagcacatcaatagcacagctgaaaataagaaagcaatgatcagcatatatttgactgtgccaagaacttggaagcatggaaaacagagacaacaccttaagaccctcatcttaatgagggatcatatatatttatgatatgtgtgtgtgtgtgtgtgtgtgtgtgtgtgtgtgtgaatgagataaataacatttattatggaaattggctaatgcaagtatggaggctgagaagtcccaccattttccatctgcaagctggagaaccagacagagaagctgatgatgtagttcagtgtgagtcttacggccaagaattaagagcactgatgtccaagagcagaaaatagatgttcctgctcaaatagcctttctctgcctttttactctatctgaactctcaaaggactggatgacacctgcccacattggtgagggcagatcttccttactcagtatactgatttcaatgctcatctcttccaaaaacaccctcacagacaacacctggaaataatgtttgaccagctatctgggcatcccttagcccagtcacattgacacatgaaattaaccattactccatattaatattctgctggcttaaagaaaactaaaggatattttataattttcataatttggggtttgctaaaattatttattttattcctgtgatttaaacttgataatatatgtatataatagcataatttgagttgctgtcacatcatgtggacacttgatttaaacatttatcaaatttgaccatgcagatttctttctatattgtgaatccattaatgttttttcatgacttaaacatttttgtggattgttacaaactaggaggtctaaaacactgggaagtatatatccaggaacacgggtccccttccaaatgataaaggcagataagtgggagctgtcccaggatataagagtttttctgtgttcatccaacagatattcacagaatatccttctatgctagatactgatctaggtattggacacagagcagcaaacacaagatacaatctcttttaccttttttacctcatattccagtgagacgatgcaggtaataaataagtaaataaaatacaaagtatgtttgatagtgatagatgctgaggagaaaaataaatcatggaaggtggctgggaaatttggaaaagtggtggtaaattatagtagggtagccagagaaggcttttgagtaaagacgtgattgatgtgagaaaatatatcatgttgatatctgagggaaaagtgtttcaggcagggggaaaagtaagagcaaagaaattaaacagagataggaactaggttggttgtgaaacagaaacttggcctgtaaatgagatcagataaaccatgagagtagggtaatggcaaatgttgtagagatggcattgggaggaatttgttgctttttgggggggattaatttggaaaggcactgaagaactttaagcaataatgccatgacctcagtgacttcctagcagtagtcccttggctttctgtattgagaacagtttggagaagagcaagaatgcaagcagggagaccagatggaaggctactgcaataatccaggcacaatatgatggaggcttggaccaggatggtgagcgtggaagcagtgagaagtagttttatgttctcagtcactgcaagagggagctttcatattctgagcgggagaagatggcatgaggaacaactttttggcaagacagcatccagttagggtagattaaatttgaaatgcctattaagtatcaaactggagttatctatttgataattagatacacaagtttagaggttagaggagaggtcaggctagagagaaaaatccaaaatccaaatatgcatgactttcagatttgatttttttcctttaaaatatttaattgataaataaaaattctatacaatgtgtacaatgtgatgatttgacatgcatatacattgtgtactgattaccatagtcaaattaattaactcatctatcacctttcataattaaaatttcatgtgtggagtgtgtgcgtgtgtgtgtgtgtgtgtttgtgtgtgtgtgtgtgttaagatcacttaaagaaactgctcttatcaaatttcaagtaaacaatacagtattattaattatagtcactatactatacattagatcccaagaacttaattcattttataactgaaagtttgtaccatttgaccaacatctgtgctctggtagaatttacctgatttgttctctcaaattcctttcattcacatttttgctgattcttctgcccccttgccttccaaaagttgatattcagcccatcttaatatgtggccttgagcatagccatgtctaaaaggttttgagtaatcatctgtgatgtttccttcttacctacagtaaatagctaattgatccaaacgtgccctgttgagtggtcataatatttgcccggtgactttgggtaggttatagaattacagtgggtagtgtgggggggggagggagagaataaaaagaagtctttgtgtccaactgatttatcaatatgttttcatccatttaaattatgtttagttgaacttatctgagcatgtgaagagatatctttttaatatagcaatctatgcacacatcccagtatgtattcatcgagatttataattctgtaatttcataggtcagttaatagtattcccattcaacccccaggctgtcataacttatgacattcaagtgtatgtttcgatacggtcttagccaagggaagtcatgtagccagtgaagcagagagaggaaagaagattgccatagttgaatctgtatcatcaaaatgataaaatgggtctataataaacaataggttagtggcttgatatgcctaacagcatccactgcagtgcacaacaggcaagttatttatgaaatgggccttttgaaaatgtatagcttttataatctgaatctcatttctatgtcctttccaacaaaatagattggcattatccatctatttgggacacatggttgctttattattttttaaaatatgacaccttatagtcaggaaatattgaggaaatccaatccatacaataaatgaaactcataaatatatttttaaaaaatctctcttgtggcatttgaatttttataattcaggaaaaaataaaaaatcttctagaattcaaaataatataagctagtgttattcatatattacgtacattgcacccataaataatactaatgatgaattaactgtcatatgtactagccggaaaggttagtcagtcagaaaatgttctggaggaatcatgtgaataactagtccatgtttaccttgtacttctaatatagatttttatttactcttagttccacatgagattgaagttcaggattttcaaggagactaacacagagtaacatcaatgaagaatacacttgacttctagccttcttcaaaaatagggagatcgcttcagatttcatctagttatagctctcaatttggtcaacccaatatccccctttaaaaataatattttcacttaacatcatggtctccaattccatccatgttgttgcaaatgacaggatgtcattctattttatggctgaatggtactccattgtgtatatgtaccacattttctttatccattcatctgttgatggacacttaggttgcttccaaatttaatccctcatagctatcctgaaaaaaaaaattcagtttagtatcatattacctacctgcacatacatttgaaaaaggtatatatcaaccacatctcttatctgcaaaataaaagagaagataaaaggaaaataacttttaaagaaatgtgtgtttcaaagtgcaagttttggatgaggacggtgctacaaggcataataaagtagacaaatgcctgcccatatacacagaaccactgtgaacacaactactacagtggcaagatgacaaacactggtgcattgtactgatggctcagttaccaccagtggcattgccattggatgttgatattttctgagatagtataaacatcttgattaaatttcaaataaaaaagtacaatgtttgtactttctacaaagtgccataaacttctttaaaaatttgttatatgaaaacaggaagatgtttttttcataacaatcacgtgcattttatggctgtctggcccaatttatatcagttaaaaatatacccacaattttttaaaactttttaagtgagaatgcttgatttagaactggatgttacagtcatataccattcattataattcagtagagacacatacataatctgcagagaaatatttagattctctttctcttcgttgttttctttattcactttagagattgagtaaacaggctatctttataattattatttttcatacagctaagtctatattctactttctttttctttttctttttgacatatagtcttactttgttacccaggctgctgtgtgatggtgcaattatggcttactgcagcctcaacctcccaggcttacgcgatctttccacctcaacctctcaagtagctgggccacagttgctcgcctccaagcccagctaaattaaaaaaaaaaaaaaaactgtagagacagggtctcactgtgttgcccagtctggtcttgaactcctgggctcaagcagttctcccaccttgacctcccaaaatgttgggactacaggcatgatccactgcacctggcctttacttcattcttaaaagaaaattatttctcctgaccaatgaatcacaaaatttctcatgtttcttccaatgcgtatctactattctattatcactggaaaactttccttatattaactattgaatttattgtttttggataatacaggattgatattcttttaatttcatgccaatttgtagccatccgaagtcttatactgctgcccttgcaaagagaaatctctttaattgggggaggatgtttgctagaaaagtttatgtaaacattaaaaacaaaaaggtatgtatgaaatacttatcttcctttaaagaacaagaagactattcaagatataaaacactacggttcatcaaagctatttccttgtgttgtcaaattttgttaacttaggaaagtatgaaaattaacttctatctcacgttaaaaacacatcgttatacttaactagtttttatttttaaagtaatacatgtacatgattaaataaataaatatataaagcctagaaaagagatattaagaaaagcaattttctcttcaacctaggtttgatcttctttagtggcaacaattattgtttgcttgtttatttctatccaaaaatttcttacacaaataagtcttgttaatttttctcggtaaaggtatattggcaatcttttctggtcagcactcccagaaactttctatttcactacgggatgcagagtattgcatatgtggatgaaaccatatgtgttcacaggtgataaatatttaggctattacatattattacaatacaataaaaatctttcttgcacattacattttatacaaactactgaatatagaaaaaattgagaagtgggattactggattacagtatatgtgcatttaaaattttcatagagattggcaaagtgcattgcaagagattgaaccaaattacctgctctcaataacatatgcgagtgtgtaacttcaaaaacccttttactgtgtattttcaaaccatgtgcactacaccatttggtttggtttaaaatatatgtcaatttgatgtgcatttatttaattatgaggaaaataatctatatggaatttaatatactttttttccttccatggattgcttatttatacttttgttggtttttaaaattatattttaggtatttttttaaatctgtactaaaaaaaattagttttttttgtcctttgtctatgcatgctgcaagtagtcatagtttatcctctatcttttatttttatttatttatttttttgagatcatttcccactttcttgtccaggctggtgtgcagtggcacaatctcggctcactgcagcctcaacttccaggccacaagtgactctcccacctcagccccccagtggctgggtctgcgggcatgcaccaccacaccctgctaattttgtatcttttgtagagatggagttttgccatgttgtccaggctgttctcaaacttccgggcctcagcctcccaaagtgctgagattacaggcatgagccaccgcacctggccatcttttaatttttcatggcatgttttctcctataggagtttaaaatttgttatatagtcaaatatacattttttttcctatatggcttcaagattctgtgtcttgtttcaaaagaccaagactattgggtgttttcaagtcactcagatttttttaaataatccccttattttttgtggtttacttctcaaacttaaaattgtctaggatttattttagtatgtagaaaataagacttactttggtacatgaaagaaaaaaatcaaactttttctctcaacaccatgtttttcttaattggtaggcccaatgtcattcattaatccatctatttctaattttaagtgttaacttttcatattacacattcatattatagtcacactcttatattccattctgttctatcttttaaattagctgtatattctttgctcctaccaaacttatttaattaataaggcattacaatacattttgatggtgggcatggctaaactctgctctttattactctttattttttggaaaattcttgatctttttcacgttgtatttttactttatatattttaaaatcagctcctctagttttaaaattttactatattttattggaattccattaaatatttaggaagaactgatctttcacaacattgaattattctttagaaaacaggtgttttccatttattcaagtaaagcttattggttaagtgaattttcccatttacaagtgacctaaaattcttctaagttctctaatgataataataataacaatgcttaccacttagggtacattatatctttgccaaacactatgctacaagctttacacatactatctcatttaactcttacaccatgcaatcaaatacgtgaagaaattgaacatcagaaaagttaagcaacttacatatggtcacagagttaggaggagattatcaaactcaagcccacacaaatttaagtctcatgctgtccctcactatgctaaactgtatttatctctatgtaatcactctcattcatcaagggaaaaagggcacttacgaaactcaacaggggatataacagaggagaaatcctgtgaacttcacataagaagaggcgtaatctctacgcttttcatcacgccagcaacaaaccagaataaaggccattgctctgttggcactgaacttatgtgtgctgcctaattctggcaatgaattcttacccaaattttctgataactaataatccctctaaatgtatcacaggagaaaatattttataacaatttgtagagttttcccctatttcttttgtctctttgtacagacacaatctcacttgaagttggtagtgatttttgcagtagactctgagcattatagtttatcagaaatttattattttgctttaaacattgcttgaaaatgttttctggactttgatatatcgtggttgcttcactcttgtatcatataagaaataataattatgcattgatagtgcatagacaagtacaacaagaggaaaggctttttaataaaagatctttttattttactctgcacttgataagagggtaaaaccttgcattttcctggtgtgatcattgaaatttgcaacagaatttaaggctggattgttttctttggatacatatttcattatcaatcatctaagaaaagtaatatttcatgtttaatagagataaagcatatatattgaacaatacatgttagtatatgtaatatatatggataataatatgttcaaacacatacacacacacacacacacacacacacacactttttctctcatctatgcccttgtttatctccaagaagatttaaaataacatttgggtacaacaggtatataaaactcaaagttttaaatattgaattaaagttatgaattgcaatcaaagaatataaatgtttccttaatccaagaatactagatgtttccttctgagagagaaagaagaggcgaacatcagttgaatcttgagaatgagaaatttagaacaatcagaatagacataaatcaatagataagggaatttgaaaaataatatctttatatatacattagcatttgtgaattatttttacaattcctatttcccttgatcctcacaaccgcactgtaaggttgacaaggaaagtattaataaatccattttgtaggtaggatgtcagagactcagtgatgttagcaaggaaagctccactgatagttattgcatgcccagcactggaacttgcagccaggtaacttcatgcctgctaaaaatataacttcaaaatggttaagatgaatctgtaacataaaacaataccgtcatgactataggaaatatgaagacattagaatattttggattacagccctaactttatgatgcctagtatatcaaatatcaagcattgtgataattctataatgacttaggtatcttataacattgttttcattataacattgttataaaacatattggagttttaagattttattcataaaacaattattcattggggttagcaccatattatcacaagtgctgttgcaattattacaactaatactatagtagtaataatcatactactactaataataatagtttattgatttatggaccttaatttacatgcaaatcagaggattttgtaacttttcttttaagagaaaaatgtataaaatcctcataatatgctctcaccaataaaacaatataattgtggaaaataaattatagttttgtcagattttcttcaacggcttcttccaggctacatgaatttgttgatgttgttagtttcacacttaaatgtggtattatgattcctgaaaaacttccttgatttttgaaactcaacttccatctcccccattactgagaaaggatatttttcagatgcccatcaccatccatgtggcataatctttctatattcacaaagtctggtacaatcttatcagtggaatcaaaagttagaagagtgtggcatttcacgtaacttcaaattaaaatgagcatttcttgtttggatttttctaaggccatcaacaaaatgataatgctcacatgggtaaagggatgctgaatatgtaattgcttcctaaattgatctaaaggcttgatattgatctactgggtaacatgatattcatctttgaaaaacactataatatgtgttatgaaaatcatctaagtatatttacataatagatgttaatacctgttttggaactttcagatcccttttacatatttacatgatggactgataatagtaaaattgtaggttgaagaaacaattttcttctttttccccaaactaaacataaaaatgagaagaaacaggaaattaagagtatgcgattttcattcttaattcatctccttgctggctcagactacagctactttattttttaataaagacaaaagatgtttttaaagtttttaatacatataaaattaagtaaaatcaggcatatactttagagtaacattttcattaatttaaaagtgtatctatatttaaatgcactcatcataattattatagaataaaggaaaatatgctttgggacagtaaacatagacaaggctttgttctttatgaggcaatctgaattttaatagcatgtctattataaaagtatctgaagactctgaaaagccttttgtttcataatgatattcattaatgtacaatatgttgagtaaaagaaatggctgtcacctaaagtagactctctggtttctgaatcttagcagggaaaaataaaaccagggaactgagcattccaatcctaattccactgtacgagatggcctacatttgtatacatatattaaatttctaattaattctttctactgcagaggatttttccaagcatacttacatatacatttaagttatttttctttttaactatggcaaagcatgagaatataaaagaataactagccaaaatgtttgcatgtggccatggggaatgtcagtgcagttggagggaagtgggactgtatgcagttctggtgggaacaggtggagactgtatgcagttctagagaatcagtattactgatttgaaatttttttgtagcttcaaaaattggtatataaacttgtatgtttgaagttttacaaatggcacacttaaagctgaaaaatatttaattagtctaattttgattttgtagaataggaaacagtgtttcacaggtaagagatattacgtgatgacaggattgagtgtagaatgagatttttttgattcccagctcaaggtttgttccttatacagtgtctgattaacttgagcatttgtttagtgtaaacactaaattgattgtaacctggtcaactttctacactgaccagggaaaattaaaaaaaaaaaggttttataatctactgtataaaaagaacattttatcctttttttaacatcaagtttggccaagaggatagccttataaaatagatatgataaccaaatttttgataatttacatttactcgtattgctttttgtttgaccagcttcaggttcattgcaatatttatctaggaaattaacattgaacctctacataatggtttgtttagttactgatttaggttaccattttatcaagaaaaaatttgtttagtaattttgtgtacctgtaaaaatgtttgccaaccctagtcttaaattcattctcctagaacatacgcttaataagaactggggatttatctgcctgcttccatgctggactcccagcctctaaatccctgcctgtcaaaagagagactttaaaaaaaaaatgtcgaatgaatgaatgaatcactgctgcttttgtatgaaacttgtgagaaaaagtgggtaatgattttggtagagtttcagaatatttccaagaacttctgaattgcttagagaaagagaaaaatgggacttatgattgctgaggcaacggattctatactcatagagtgaaattgtctctatgtttggatcctgagaatgtgtgaataaaaatatgatgagcaagcagtctacgtttgactgatgcttcacatgaaaagtcttactgatatagaagtgtatttttttggtatacattaatccagttcaagatgctggaatgtataaattattttttattcagaaagccatttttcgtgtcttaattttatatcatcaggaaccaaattttgcagataaatgttgaccctcacagtattctttttttttaacttcttgaattggatgactttttttttttttttttacagattaggattcaagcaagcaggtaacttcacctttggttaatatgaatagtaaacaaaaatccatcacccttttcttaatttgttaaatttatgtaagacaatactcataatattcattgctctagcattttcctactttttcttttattttgaagtaaatttggaaaacagaatgtttatgtgcctataaaattgtcatattcttaaacaatgagttttcacacagtcatgaactaggccatgttctcagcaagataagatcctgaacatcctcagagaagttttttgtttgtttttttgtttgttttgtttttttgtttttttttttgagacgaagtcttgctctgtcaccaggctggagtgcagtggcgtgacctcagctcactgcaacctctgcctcccggattcaagcgattcttctgcctcagcctcccgagtagctgggactacaggcatgcgccatcacgcccggctaatttttgtgtttttagtagagatggggttttaccatgttggccaggatggtctcaatctcttgaccttgtgatccacctgcctctgcctcccaaagtgctgggattacaggcgtgagccgctgcgcccagccgagaagtttttaaagctagtgtgcactttaaactttcattaaagggctatgcctataatgcttaaagcactcaaacattagcagcaattaaggagtaggaaattcaaatcatctggaaaaattagtgcattgcattaggaaatgtggtattatagatatagctaaaagccctattcttattttcccaacttataaagcaactgaggcacagaaatatgtaagtaacttgaaatattcatgcggctagtgtggtagatgtggacatttaaacctagagacaacttaagctagagattccagcttaaccactgtgctattttacaaatcgcaacatcgacatattcaaggaacacatatggcaatatatgtgactctaaatgccattattgcattttattggacagagtcctgatttcatctacctcaggtgctaaattcaagactccagagttgccttaattgacaaataaatatactatcattcaagaaaaaggggacaaagtcttcccagatcatctgaatttggggagaatgtataaaatagaaataataacttacaacaagcagttctatggactaccataaaattatcatatttggtatttgatttgggttatatagatgtagctagtgatataaatataaagataactaatttgatagagttttcaagtatttccaagaactttagaattgcttaaaagcatgtaaaagtggagagtaatcactgtgaagttagtagtttctatgctcacagtgtgaatttgtcagtatgtttgtaattcttagagtgggttgacatctgtaattttaacaaggatgctagaagaaatgaggttgtacaggtaagctgaagtcaagttgtaagggtagtaaaacctgggttaaggcttcaaacaacatatttttatctttgactcctccttccttcatcgaatcattaggtatgctttaatgtctttgtcacaaacaatgaaatattcctctcttctcatactcacatttttattgcagtcacagatgctgtgtatcctctttccagtctcccatcattatgtacctagttattatctaccactattttcttaaccacagtgcagctacaactttttgcctcaaaagcttttactagatttccaatcttaatttgctggtgaaattaaatataagaaataccctaacccacacgttaacatcctcacaacttaacttcagcttacctgtacaacctcatttcttccagaatccctgtaaatactgtagatgtcaactacaaacatatagacaatttcacactgtgaccatagaagctcctaactttgtaatgattattccccactttttctcagtgtctaagtaatcctaaacttcttagaaatactttaaaactctaccaaataaattatcattgtatctatatctatagttatatatatatatatcccaaatcaaatactagtcaaatgtgacaatttcatggtggtctgtaaaactatttgtagcaatattacaagtggattgttacttctagtttatacattttccccaaatacagatgatctggtaaaacttcgtctcatttttcttgaatgagaatatatttatttctctattaggcatctttgaaaagccttgaatcttgcatctgaagtagaattcaaaattgagaggactgtcttggcattcataaaatatgtggaacaggaggaggttgttaagggggaacagaggatgaattcagctatttgtgtttgttgatttaaggctgtggtgagatagtgaggtgataatattccctccatgagcaaggacaaatcctgttgtgaagttctggaggaagccattgattggagaggtacattcggatggcatgcatggagggagggcacagctgaagtctcagtagcaaatgaaattgctaaaaaggaagactggagaacaaaatgtataaaggtagaaactttgagaaaactgtagaagtagaggagtcatggcaaagaaaatggatcagcctaagaagcactggagtgataagaaatagcacaggagagccaaaggatgaaatatgatgaaaaggagtggttagttccttagagaggcaatggaaaaatgctagttattttgacagtcatgggtgacagttcagaacctcatttttatagaatagtagggacagtatctcaaaaggttaagaaatatatgcttaatgggaggaaaaaagcagcctgtattagtccattttcacactgctgataaatacatacccaagactggggaatttacaaaggaaagtggtttaattggactcacagttccacatggctggggaggcctcacaatcatagcagaaagcaaggaggagcaagtcacagcttacgtggatggcagcaggcaaaaagaagagctagtgcaggggaactcccatttttaaaactatcagatttcatgagactcattcactttcacaagaacagtgcagaaaagacgagcccacataattcaatcacctcccaccaggtttctcccatgacatgtgggaagtgtgagagctacaattcaagatgacattttggtggggacacagacacaatcataacattccacccctagcctctgcctaatctcacgtcctcccatttcaaaaccttcccaacagtcccccaatgtcttaattcatttcaccattaactcagaagtccacagtccaaagtctcatcccagacaaggcaagtcccttctgcctatgagcctgtaaaatcaaaaccaagttagttacttcctagatacaatgggggtacaggcattagataaatacagccattccaaagtggagaaattggccaaaacaaaggaactacaggcttcatgcaagtctgaaatccaacatggcagacaaatcttaaagctccaaaaatgatctcctttgactccaggtctcacatccaggtcacgctgatgcaagaggtgggttcccatggtcttgggcagctccgcccctgtgactttacagggtacagcctgccttccagctgctttcacaggctgacattgagtgtctgtggcttttccaggtgcatggtgcaagctgtcagtggatctactattctggagtctggaggatggtggccgccttctcacagctccactaggcagtgccctaggatggactctgtgtaggggttccaaccccacatttcccttccacactgccctagcagaggttctccatgagagccgtgcccctgcagcaaacttttgcctgggcatccaggcgtttccatacatcttctgaaatctaggtggaagttcccaaaccccaaatcttgacttctgtgaactcacaggctcaacaccatgttgaagctgccaaggcttgaggcttgcactttctgaagccatggcccaagctctactccacatttgcccctttcagacacagcttgagtggttggcacacagagcaccaagtccttaggctgcacacagcacagggaccctgggcccagcacacaaaaccactttttcctcctaggcctacggccctgtgatgggaggggctgccatgaagacctctgacgtgccccgaagacatttttcctattgtcttggggattagcattcagctcctggttacttatgcaaatttctgcagcaggcatgaatttctcctcagaaaatgggattttcttttctattgcattgtcaggctgcaaattttccaaacttctatgctctgcttcccttaaaaaactgaatgcctttaatagcacctaagtcacctcttgaatgctttggtgcttagaaatttcatctgccagataccctaaatcatctctctcaagttcaaagtttcacaaatctgtaggacaggggcaaaatgctgccagcctctttgttaaaacataacaagagtcacctttgctccagttgcaacaagttcctcatttccatctgagaccatctcagcctggactttattgaccatattactatcagcattgtgggcaaagccattcaacaagtctctaggaagttccaaacttttgcacattttcctgtcttcttctgagctctccaaactgttccaacctctgcctattacccaattccaaagtcacttccccatttttgggtatcttctcagcaacaccccactctacaagtatcacattactgtattagtccattttcatgctgctgataaagacatacccaaaactggataatttacaaaagaaaaaggtttaataggactcatagttccacatggctggggaggcctcacaatcatggtggaaggcaaggagaaataagtcacatcttacatggatgacagcaggcaaggaagataagcttgtgcaggaaaactcctgtttttaaaaccatgagatctcatgagcctcattcactatcacaagaacagcacaggaaaaacccacccccataattcaataacctcccacggggtccctcccacaccacatggggattatgggagttacagttcaagatgaaatttgggtggagacacagccaaactatatcacagcccttgttgtttgttctgtcaagaagtttggtagtagagtaagacagagggggtgtttcgaggagaaacagagttgagaaaaagtgccttacttattttgtttttatttattggtagaatgtgtgggtttgtttatatggtcaggtctatctgtaggattgatcttgcatatttttatgaaaatttttgaaataaaaacaaaaatagttgagaatgagagtttgataagggaatgcataattaatagaacacatttctgaaacacaaggaagaagctgaggtacctgagcatggaatcagaagaccttttcctcaaacttcacagcagaggcagaaaaaacaattcatctggtttcatctcctctgcatttagagttcttgatttaggctgtgagtattttaaggaaggaagggacaatgaataatgtttgtgattgtttcactgtagacatttcttgaacgaagtaagcatagttctagacttttgctgcatgatcattcattgactttctcattcatttgacaaattttattgagcctgtagtgtgagttacacagtgtactagaaagaaaacatgttgtcactacatttaaggcggttcatagtcttctattttaaaataaccagccattataatagaaagaaaattctgacatgtgaatgaagacattatgttatgatctgtggaagttctttgtactcataaaatgccatgcatttaagacagtatctctagggaggaaattggtttgatgggtttggaggaagaccactggattaggtgaaaagttttatcaatgaccttaaaagatagtggttttcataaaatagcatctcacttttcatcttgttagttctgtgttaccaccattcctgctgatattgttgaataaattctaatacattagcaagctcataaagctaattatagtggaacaaatatgtttttgaggtagttccataatgtgtaaggtgagtctaactcagtagtcgaatcctggagttttattacacaattaatacatactggggcctgtcttattggaccatcaatatatggcttgtatgtactgggagacagtaagccaaatgccatctactttctattatagagcatctgagtgaatgatcctctgttgaagcaaaaacaaagacacaacataaacaaacagaaaaacacactcagaagtatcttaatgcaatgagaaatctctgttgtggcgaaataatttaatattttcagatatttctctaggactcaataatttttacttaagatagatggatagatagataggtagatgggtagatggatagacagataggtaggtggatggatagatagatagatagatagatagatagatagatagatagataaatagacgaattattccaggagtaactcaataggaaacataaaatgttaaagctggtaggttcttaaacagaaatctgtctagtttcttcatttataggtgaaaaactgaggcaaggtattggtagaagaaatgagctggattccctttatcttgactcttagatttttttcaataatacttagttcttagtttttcttaagtgttttttaattaaaatttttttcgatatcatagtattcagtcatataaccacctttgtacttatttatgtgttactcatctctaggatggtaatttccattctttttgtttttaaagatggggtcttgctatgttgcccaggctggtcagctcctggactcaagcaatcctcctgcctcagccttctgagcagctgagattataggcatgtaccaccactcctggctaggatggtgattttcttcataaataggagcttcactttgcttcttgtgtccccagtacaagtataattcctaaaacatggtagattaattttaaatattaatataaatgaatgaatgaaccatcttttctaaattctccagttaaaattccatccagtcttactgagtgaagacttattggaaagaaaaggctctttctattctgttagattctcaggcctacaaggtctcagtagataatgggtgacccagggctcagtgcttttgtatatggtaagctatccctagtatttctgggacatttctgagggacatactcccatgtggggtacaatggaagttaacagtagacattcagattactcagagtgggagaggtgagagaacacgtgtggagtatggaatggacctaagcctagattaaaatcccaccaaaataagctgcatgtttcttaattatgctacatctaggactctgacctgaagaaatggggaatgtgatttcatgatgtgccatctgctccctttcccacccccatttctacaaatgtcttgaattgaactgcaggtcgtccttttaggaagagacagataatgacattttactctactgaggagaaaatcgagatatggaaagattaaatcatttgctcaagggtaaaatgaattatgcatgcatgcttacagtattcactccagtgtgtctgcttctctgccttccctgtgtgtcactgaattcacaccaaagtattactcagccctctatgtgttactaaattaaatggaagtatttcctttaattgccatgtgaatagtggacaagcattgtgtttatatctaaataaatcaaggaatcatggtagtaaatatctccttgatgtatcaatagttaaaacatttttaaagccttgttttagtgaataccttttttttaattgtgttatgaatgcacaagaaaataaaatgttaaactgcccatgatgcttaataatagtccaaggtggttgtcttgaaaagtatataaaagatgcctctcctaaatgtattcctttatctgattaaatgattaaagagccactgtttgaaatgatgaactttccagacagttaaatatattcttgccttaaaaaaatactgcaatgagaagcttgtttaaaagatattttgggattgtattctaagatgacaactgatgaatagctttgttttgctatttttttggtcagaaagattgtttatacattacttagatctctcaatgcatttttctcacatcttaaagatgatatggttttttatattatttaccaaatgcaaattagacacaaagggaaaccagacattttgatcaagtgctcaattcttcagataaatgtttccaacaatgatggctaccagctatattaaaaatgtagctttaaagactggcttattacaatgagaagtttttaaaaagctgtattctattattttacacacttaaaaatttgttttcattatcagaagataaaaatatattatattttaaaatgtattgtattattattttggaaggctgaggcaggcagatcacctgagggcaggagtttgagaccagcctggccaacatggcaaaaccctgtctctactaaaaatacaaaaattagccaggtgtggtggcatgcgcctgtagtcccacctactcaggaagctgagtggggagaatcacttgaaccggggaggcagaggttgcagtgaaccaagatcacatcactgcactctagcctgggcgacagagtgaaactccatttcaaaaaataaataaattaattaaattaaattaaaatagaatgtactatattttgaaattcatctactttcaccttttcctcacagtccaatgaatggagatcagtaagaaacaaatatattcgttttccctcttctgagcatttactcttgccacctattttgttaatggtagggtatgatttctgcagctgtattacctgggttcagattatagagtctccaattactagctgtgagacttggagcatgttacttaacccctgcttccttttcctgaaaaatagtgataattacagtatctaatgtagtatgacaatttagttagctcacaagggtaaagaccctagaggaatagttggcacacagtaagcatgaactcaatagtagccattaacaacccaaatcctcatttcacacttatgtggtaggtgttataatctctgacagacagtgaaccttacagaagtcaaatcactttcccaaaagttgcaccttaaagagagcagagatatgattcagtcccacttcagataaacagactcccctttccactcatttcaaactggtcttcaaataaatgttaacgtttagacatcttcaagttatttatttcataaggagtaataatatacagcaatattattttttctttctactgcatatgtcatctttctgaatgctaaattgtcttacttccccattgctttttgcattaaataataacaacaatgtaatgccattttcccctgaacttctaagagagggaacatttgaagtaagtaatagtccttttggaatgttggcctgcatttactgaagtatgaacaattaccttccaatttggaatgcttgttgattttcctagctaatttttcttctatttttgatgaatattttattcaatctttatgtgaattgatttacctcctattgagtttaatgagatgtgaactattttattttctgactattacaaaattaaataggatataccaacattaaaaataaactataattacctgcgatagatttctttttaaacaaaactcataaggtgttgcaaagcaattttctagacataaggtatgtagagggtgaagggttgcatatgagctgagaaaccaactggagactccataaccttctaaaatccatcagatatgtaggatatagccaatggttttatgtacagctcattgtcaattttccttggactatagataattttttgatctattgtataagctttgcgataactaccatataatgaaaaaagaaaaaaattcttttgcgtagggggtagtgttatatcttttcttttaaattaatgacggtattttttttctttgaattactctctgtattactccatatagtagtagtagtagataggtttgcacctaattttaattcatattggttagtcacctttctgtctctactgaactttatacacatcctgggataaaatgtttgacaaatttaatcccatattgactctttgagaaaccaggcttccatgtgtgtctgtcagtcatgtaaaaatcatgggacaagttaggcaaaacaagagactgcagagtaacagtgtgtccttcatctgaatataaacattagcagaggtcacgttactagaaacttgtttgaaaatgtattatattttactaatacaaaatcagcggtatgcaaaatgttaggcatcatttaggtatgagtatcatcctatcttaaagtactgcttatgccaatgctaactacttgtccctggtcaaggactattgtgtagtggtgggaacatagtgtattatgatgaacagggaactctgttgtggctttagcctctcgtataaatttacataactcatttaaactatctgaggctcttcataaataaaattatgacagagcagatgacttcatgttcctcctgcgatgcaattctctgatactgtgactatgaaaaatctaaccatttaatagataaatgtgttctttcataagtgtgattcatagttcattgataccactgtgagctcaaatgtaatacagtaatatactataataaaatatatttatctgaggtaatgttttctctgtattgtattttctttaattatatttattacatatatacacatgatttcatatgaaagtaatatttgctgtagaaaattcaaataatacagaaaaatatagagagaagagtgtgaaatatcctcaagaagtctcaccattcataggcagccatcagaaatagtttggtggacatccttccaagcatcaattctttcattaatacatactaagtgacataaaattttacataaacttccatttattcatatatatcttactatatatgtgtgtatgtatgtgtgtgattatgggtatatacggatgttggatttaacaaaacaggacatctctttatggtaatgactatatgtattgatgctgacattcaataacatacaataactacccatagtgattctgaaaggtccctggggcacaagttctctctcttcttaaaaatcactgtgttgtgatttctgggttatgcttatatcttcctaaccatacaattagaaacatgtttacatttagcttcttctagtacttgccttgtgggtttcttttggggagggtagtattttatttttactctatctgcaatttagtgtaaagaatgagagacattcattccaagtgattagtgaattacctctatccttttcgttgaaacaaaaatttttcttgctgattttaaatgtttttgtgaagtccacatttaactaattttttatttttacttgggttatttctaaattattttttccaactatatccttcaattttgttttgttgttgtttttgttttttgagacactttctcactctgtcacccaggctagagtgcagtggcacaatcatgatccactgcagcttcaacctcccagggctcaagtatcctcccacctcagcctcctgcgtagctgggaccacagacatgataccacatctggctaatttttttttttaattttactttctgtagagatgaagtcttgccatgttgcccaggctgttctcaaacccctgagctcaagcaatcctcctgcttcagcctcccaaagtgctgggattacagaaatgagccacacacctgacttacttatctttcaaacttttatgtattttataccatcgtgttttatttagtttcataatatggttttatatccgattgatcaagaccactgtccacatgcccattactttttttgtccattttcctcgaagtttgcacaagctgatttttctgacaaattttagaacatttcatcaaatctaacctcccaagaatcatgacaggattcttctgtaatgaaagtataaattaaattaatgaagataaacaattatttcaataataaatcattcatctacatgaataaagtttcttttattgtttaagtctttgatgtgtatttcaataggcatacataactaggtcatattgatttatgattatgtttattccttgattttgatacttttttgaggaacatttgacacaatttttaactcatattttacaaatgcttacttttctgaagacattcatagccaaacagtttaaagagtgatcttatactttcaaaatcttgaattttccaggtaaacaactaagacagttgaaactattaataatgttatccccttctttctatatttatgttaacttatgaggaccagaccccggtttcttttgataatattatccccttgaccttcttgggtcagatacctagaagatgcttgataaatatctggggatatattaaaattttgatctagtaatactggcttaggatttaaaccaaagagggagcacccttctattgcatctgctttcataggtttgaagaatttttctgtttgagtcgaagtcataacatattcatgttaaatgttaagaaactataaattcatttcttatattctaagagtcttattataaaacatttaaaatgttgtcaaatacagtcttgatgtcacttgttttttttttctttttcattagtagtatggaaaatcagagtgtttcctgtttatgtggggcttaaaacatacaatttgaggaacctctttaagcaaagaatataaaattatgaatctaaagttgagactaaaagtaagtggttggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaaaagtaagtggttatttagattggaaaataaaagctgccatggaatgccccaataggagtaaaatattctgaatctaaggcttcatcagtttcagaataagtccacatcttgtgttgaattataaaaatttctaatattgaactaatcttgtatttcagaggcaaatcctatttggtcatggcatactattcattaaatatcttgttgacccctaattgttagtaatacgtttatatttgttgtatcacaattaatgttaaattattttataacatattgttcaccaattataaagctttaaaaccactgacatgttggttttgtaaaagcaaattggaaatttccttttctttctatacattttctatattctagtggagctttaatattcttgcttacatttgtaaaaatcttctatattcttaaaatgatcaataacaatctagctagatctgctaagggatgttcataaatacagtatcattttgctttgaaagaagtcatgcttttagctcatcaggctgatactgatagagcgtagataaagatgtttccaggtactctcaagtgggtttatttgtagccttcaaatccacctatgttattgctatttgaatatgattgctaatcacagatttacaagaaatggacccaattctctacacatttatacccgtctccttcactttgcacactactctgtctttaagacatcaacataatcacttgtgacctgcttcattagtcacctctttagacttctcaggttttaggtgtatcttgtcagcatagtggtgccagcacagacaggataatgacaaatgctacttttataaggttggcaggtagcaaactacttgtagcatatggaaaacatacttttatttttcatgcacttgtgatgttcccattgctgatgcttatggggcataattaaagagaagaattagtatgaacttatcataaactagcttcagtgcatctgaaagtcagagaactgatttttattcaatgctccattttataataatagatttgtctttctccgaaattgagtcatcttttcagatgaagaacttatgaatttaaagcattaaactcaatataaaaataagtgtaacaaatacattacaaagtacccaaagtgtctggtaacactaaggaaattgtatatttataatgtagtattatgggtggctgaaattcataaatggattgaattaaactggtatactatttcttatgtgtgcttactaagtgcatttttcttactgtatttgactttgtaatatgtcttttgaaaaactaacacaatcttagaagtttgctttatttaaaaatattgactatgtataagcttcacattttctgcagattttgctcatgattttaggaatatcatgatttaaataccaagataagtcaatgatgagaggttctcatggtcagcagtaataaaaacagtatcttttttgagttaaaattaaaattaatatgattcattttataaattatttattaaatttatatacatttgatagtgatcagtcttgttttatgcaattgatatattcccccaaatatttttgttcattatatgtaaaaatactatacctttaacatataacactctgatcaaacattaagaaatcttaaaaatcgtaactaaactcttaaaattcaaacatcaatccctcattttatcagttttatgcttatagaatttcatgttaagtttttttaagcaagatacacttttaatatggcaacaacaacaaaactttatccataattcaaatacccattttcctttgcagagtacttcagtatagctttttaaaatagccacttaggaactcattttaattaaagtaatcatatttgctacctaaatttgttgtcctattgctactctgccatttcagtgtattaaaaggaaaacagtacaatgatgccaactgtaagtctgattttttttttactttgcccaggaaaatcatttcctttgaagcctatataaaaattataaagaaaaaagggtgggttatgtaagtatgaatctattctcagctttctgtggctgtgtctacaataataatcgtttacagcataaccaggggaggaatgactaacttctcttcttatctacaagataatgaatagcctatttaactttttttaaaaaaaatcaatgtttgcgttgatttttgtatggttacaatagcagccaaagagaaaagttgcatggtaaatttgaaattgctgactgatttttataaatattgaagttcaaggagtgctttaccattaatggtcatatttattggggaaaacagtattggggattgacatctgaactgagctcatagaacatgtagcatagaaatagaaggagacaaggaaaatgacattattcccatggtgcaaggtgatgtttagcagggtgaacttacatctctcattacatctagcgggtagaagagttgaacaaaaagtgccagtccttggcaggctttttgaaaaatcatactacaagatacaaaaattagaacaaaaactagtaaatgttttgttcaaaatcacaaagaattattttttacagagcagtgtgtctctcctggtcttttatattattaatgtaccatgccacatttttaactgttagaaagaaggaataaaagaaaatgtcccatagtctgtcactttagacgctttaacagtgtttgacaaaatgtaggtaaattcttctaagaacattatcattaacagttgattatggtgttcataagagtggtgatattaagaatttatattttaaaatttagtcatatctgtatgtaatcccaagttgctgactgaacttaaatcttttaaaggataattacaattaaagtgaaaatattttctgcactcatgcttttttctagatgtttatatgttgttaaatattctttaaaatattttaacttttagaaattaccaactctaaatattctcttataaatatctattttggtcaattaactagaaatcaactaataacaaaatggtcttgattttttaaatacaagagatgtacttggcaaaaaagttttattgcaccgagccctacatatttgaaacattaattttagatgcctctatggcaacataatgtattcttgtagtcttccaagatgtgccacactttggaatctttgctaaatgtcacaaactgagagacatatcataaacaaaataaagaatgaccacaacggttcaaaaagttgccaatactaacagttccaccaaacgtctattattcaacatacatgatttgaatttcaaatagttctgtaactaattttgacatgaaattctaaacaattctgagtattgccagttgcctccagtagaggcaaggcgatatcacaattcaactctataaataaatattgcaagtcttttataatttataatattatggtggccaggtggcaagttggggatcatacactaccacatcactaccataattttaaacaaccacttggtttcaggtttacccatcactctagctgctttgtgatgaaagaatggtatgtttagaatcttccctctttctggattctcatcctcaggacttatttctctcctaaaagcaagaagcaaaggaactatttctggaccctctagcaacaacattttaatttactcagctgtgtatcaggatcttgaggcattccttttggggtacttcgtcaagtgtacagcttcttctttaagcatggataaataccaaagccactttctgaatgctgcagagacttcacctctagggactgttgttgcaacatgttcaggcttttgcagtggtagtaatagaaatattgctaataaaatagtagtagctcgttttactatatattaactactatgctgtgcaccttgctcagattatctcatttaatccttaaaacaacctatgctgtaggtggtattacatctatttggcaactgggcataaactgaatgttaaaaatctgtaagtcacaagtttggaaacagtcaaattgagaatataaggcaggtctctcccaggtaaaaactgactatagatcataaacttcatatttagtaactgtgtttgtcagaggttgaaaagttctttattaagaacttccttcctaattaggagctatcgtccagcaaaagcatcaggggtaatatatgttgcagtgtaacagtgtggcccaagctgaaattcaaaaccaaatctgggaaaacggaaaggttgatgatctttcctagggtctgtgtgcataaatgtaaatgtatggataatattccaaggagatttctaaagaaaatgagaactgttttacacagaggcctaaaatactagagagaaaagtgaacagcacaaggcttaaaatattatcataaagccagaagttgacaggtaaattttataataggttttatgagactcagtacagaataaactttaggattcaggttcacagggaagtaaaattgcagggaataatatcaccattcttccatacagaacccaacagtgccctggctcctggaatgccaggaaattgaagaagctggaaaggcacctttggtatttgcaaaaggcgttagataaaaaaaaaaaaaagaggcatgaataaaattaagaaacaaaatttcttatgtagctcatcttattcaatactcacgcttgagcacaaaaggaatgccacctggacacatgaaggagtaaccgacaaaggctttgaagtaggtgggggttggggtagcatgtccttaagtcaagcagatagaaggtaagggttagtaattcaataatttggacacaagtgttactgttgatagaatttgaatccactgataactgacccctgacatgctgggacttgcacaccacttgtgttcaaaccctgaaagactagactacctgaaattccctctatgctgtaaatatccccagcttcatggtttgtacagagccttctcaacctgaaactccctcccaggtctacctttgaggtgttatcactttcttttttcaaaacccaatacgttttccaatttatttaactgtttgactgtttttctgcttctcccacctctgtacccaacacaatggacaatattgttattgataataacaatattgaacaaactttgaaaatcaacccactaatacaaaaaaaaatcacagaaagtcatgttgcctcctggattgcgaaaagagggctagaagaaggtggcctctaaaatcagtgccacttattgggctacattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcattgggctacattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcaagaacctcactatttcaagaaccttattttgccattacttctttgttagcatcttcacatgcacagtgagtctggaaagatttccagcctcttttcttccattttgaattctcagagggcaatattttgcttgattttaaaagatacatgagtgaagaaaaatgagttctgtcagattcctctgccttggactgagtcatatattttccctaaatccatacaccagacaaaacagaaggatagactgatttgtcattttctcttctaggatgtttaatttcagacagtttttttcaaggtctgaaaaacagttaccttctgttttaaaattataatccagtaatcaagcctatgtaggttctgggtaaaatgctaagatttgaattatattagggtgccttgccatttggataggtttccaatttctgaattctcttgttcctcacagttgttgattaaaatgggtcatgatttctatccttgcttatcccattgtaaacacacaactttaatatcaaaaggagtctgtgtggatggtttctatgataatttctaattcacacattgtttgatttcattttatttggaatgtcagttttaaacctttaagttctgagcctaaatgaaatttttatatgagatgccttattcatctttgacctaaatcgcatagatagtttatataagtagcaccggatttttcattaccatcacattcctgcaaaatacttctcctaggtctgaaaatgatcttcaaatcatttactcgtctcttcacaaccatggaaaccacattgataatgtcagcagtcttagtttgaaatgcctgtacagcttttgtctaaaataaaactttctaagcttttgtattagagaaaatcataatgtaaattaatgatgtttctctctgtattaaaatatctgcgtttaataccctacttcaatatagtttaacttcacttttttttggcctccctttgcacgtcaataaaacctgaaatgcttcagggaaagaaaaaataaaaagaaacaaacaaagattgaaaataaaggaagtcttcccaacacaagggatttggtatttttcatgcagtttgacagtaaaagaatgaagtattttgaacatcttttaataactaactatgaaaactatatcatggtctcaaagagtttacaatctgttttatttttagttactgacttcctgtttccattcaaaggagtttgcatttgggccaccattattttttctgcctctcagacatacgtaaatgtgacctagcaaagttgttttgatatattagttattctgtttgtccataccattagcaggctacacccaatgtattcagagagaaccccgatgcctgtaagaatctaggaaaatatttgtaagggccctatttcactctttagaaaattatactgttgtgtgatatgaactaaagaaataacagcaaaagagtcattttgataaggttctttgaaaccattgttatagtaaatacaatcagttaattaaaacagtgttttctcctcactgaaaaattgaatttttctttctaggcctcagttttctcatctatatattggggtagtagtggaaccaaataatttttagaggtggtctaaacaatttgttttataaatttgaaattattattcaagattgttgtttttttcaagatgttttcttgttcaagggtacacgactaaacatcatccattttgtctaaattttaaaagtttgggtataaagtaaattttaaaatctccattctgtctgttgctctagtacgctttcattttatttctaactttaaaaaatgtgtgctctcttattttcttgatcaaatcctgccagatgtttatctattatataaatctttttaaaagtcaacttttaatattattaatcctcactattttgtttctttgttttccttgtcattatcattatttacatttttatctttcttattcttcctttgtattgttttgggtttactttgtcatatttgaaatttattttaagaacccttaactcactatttctagtttctttttttcattaagtaattaacattatatacctttccaaaaatactgttttacatgtgtcccaaatatttttataggtagtatttgattgttgttcagttctaggcatttagaaatttcaattattgtgtcttatttgacccatatattatttaaaagtgtgttttggggtttccaaatttctgaacattgttggcaattttttacatttctaattttactgattttttttctaattgtagactgtagactatcaattattttatcttttctcaaattttctttggtgttccattatagttattaactaattacctcttttgttctagaaagtcaaaaatactttctaagattaataaatcaagatgcaggtgtaaatgttacagtaggaagaaaaatgagtgtcatcagtaaattagttaaaatacgtttaaaagagcgaagaaattgcccttgttaacagtgtgatcaggttgagtcattagggaatccagcaggtagggaagtttggatccaaccctctagtctgtaataaagagaactgagaactgctctctagagaatgaaatgtgaataatgttaattcatcataaccttattcttaaagaagaaccttccacagtgtctgcctctaactgcctacctgctttctctatgtcaaaatatgaagggggggttacctgctcatgtgacctgggaaagtatgcacacctcagtcagagacagcattcaaggaataggcctgtgggggacagatgtatgagaccatcaaggaactcatgccaattgcctatactagtcaacataaatatggacaaacaagaaatcttttagtgagaaaagtttttatattataggttttctttttccttctctatcacagtgcatgattaatactctaaattttggttatctgttttcactttgtcaaaaattagcctgttataaattcagagaagactttatcatatttcaaaatttaaatacacactttaaaacttgatgacataaaaacaataataattataaagctaacaaattaaatggtagaaaatagatgagagtttgaaaaaaatatttagttttctcttatctttcatactgtaaatttaatgtgtaattttaataaaatcaagaaaaatggatgaaagtataagccttaaaatccttatggcaaccactagaaattaaaaaaaaatgataataaagcaaaagaaataacagaatctagagctgggagatggaaagaaggatgaaacagtgtttagtctcccaaattacttacttttcatactgataagttaatagatattgttaagaattgccaattccagtagctggcacgtgtgtgtgtgtgtgtgtgtgtgtgtgtgtgtgtgtgtgtgtatatacacacacacatatatatacacacacatatatgtgtgtatgtatatatacatataattacaactgtaatatttacaaataataataaaaataaaaatgattaccaatagaacaatttaaaatagaaacttttgaagtgtgaagatgtggggatagtatgtgtgtgtgtttgtgtgtgtttctaaatttttcattttatttatttatttatttattgagacagagtcttggtgtgttgcccaggctggagtgcagtggtgtgatctcggctcactgcagcctccacctcctgggttcaagtgattctcatgcctcagcctcccgagtagctgggattacagatgcacaccaccacacccaactaatttttgtgtgtgtgtgtatttttagtagagacgaggttttaccatgttggccaggctggtcttgaactcctgacctcaggtgatccgcctgcctcagcctcccaaagtgctggaattacaggcgtgagccaccacacccggccaatttttcattttataccactctaggtagttaaaaatattaaatcatacacataacttccaataattttaaaatgaatctatatacagacagaggattactgttcaaatcaataactaactacatctacatgtgctgatatggaaagaggactacaatatattaataaagaaaatggcctgtaatcccagcactttgggaggccgaggcgggcggatcacgaggtcgggagatcgagaccatcccggctaaaacggtgaaaccccgtctttactaaaaatacaaaaaattagccgggcgtagtggcgggcgcctgtagtcccagctacttgggaggctgaggcaggagaatggcgtgaacccgggagacggagcttgcagtgagccgagatcccgccactgcactccagcctgggcgacagagcgagactccgtctcaaaaaaaaaaaaaaaaaaaaaaaaagaaaatgaaaacataatacatataattatgtatattatagattccaaatatgtaaaaatagagggtacgcatatatgtttgtattaatcaatgcctaaaaatatccagaaagggaaacaccaagcgaataactgtgactatttagacagcattttattttgtatttctttgtattgtttatataaatttttcactacttcaatgcattgataatataataaaattttattagtaaaaaccattgatatcctagatgatttggttggcaagatatcttacttaatttaatttactctgaactcccaatattcaggtaagaagctacgtgggtacaggaattctctgtgccttgctcacttctctaatctctgcctccaggccaggttaacccctatacccattataaaatctctgcaaatagttctgtagtgagttaatgaatgtcagaaatcaccttaatataataggtggtatatagtagttgtgctaaaatatgttaaagctttgttttgttaaatagtctatgtgaaccagtaagaattaatagcattgaataataacatttgaaaactgttcagagatagcaatgtgagcgatggctgataaaaaaaaaaaaactttcttctattttatgttaaaaattacctatttgtatatatgttccttttttaagttaaaaagctataaaaaattaatgtgattgttctggtttaaccagaacattctcatttatgacttttatatttttctccatgacatatacctgctgtctttgtggttcatatacttaaatcagagttctctaaaatggatatacgtttcctaaagcttcttcattatcatctttcatatcagtaaagcagcagcagaaatctttgcttactttaggtttctgaatgctaatatgtagaatgatgtttcttttctataagtcttattacaacaatttttttagtgtgcgtatataatggcatttacttcctcaatttcattgtaaatgcactaaaagttgtgtcaatgaagtcattctgaatatctttaatagacaataagcctcagtcatgatcagaatgaggaaaaaggaggatgtgcacatggactaacttgatggttatggcttccaatgagtttctatttcccttcagggtttggactaaagctgaaagcaaaagaatattcaagatgcttaagtttctcccttgctctgatgtggctgtatgcaaatcagctgcgttactggcaggactagcattccacagaatgatggtgaccataatacagaaccctatagagtgaggtctggaagtcttcaggcagaagagagcttgattggccatcattgagctttcatattgtattaatgtagaaaaagtgatcaatctattgcagcagacatagttaacgcctccttcagatcccaagtacaacgtaacagagctgccttccatatttggatgatggtgatgagaggaaaattggaagaataatgatctgtctcaaatgagaaagctatgataaaaaaggaaacatttaaacatttttgctttgttataaatacaactgtcaacccaataatggactgttgaatggcttgtttaaatgcaagaatttagtgaagtattcatgaaatatgataatatgccccttagtttcacaagcataatatgacaggaaaaataaccttttgtctccattttagaaatgagatataagtaacatattataaatttgtcctagttcaagggtgtgacacttaatagatgtacatattggcaatttgcttatagattatcatttactgtcacttttttaattagaatgtgatcttccattgtctttaatctatttacatcatggatgacaaatttctttcccgtaaagcaaagtctttatttatcataagacaatttttaccaaaattattacacgttgaagggggaaatcataagtgggatcatttagcttttgaattttcagactacctggcatctttaacacagtaataaaacatattttaagtgactgatatttgcacatttgccttctcaaaaacattcttaattttgctatttaccataaatctgttatgattttaccattaattttggaaccatgccatgaaaagtttgattaaatttacgttctgtttatgtatgcaactgaaacttacacgcaggctgtaattcaatgtttctagtcagctctgaaggcaggagtcccctccatagttttcacattggcatatgcatctccttacccacagaaagattgttaaagcaaatagttctactggtaagcagggatatttgtagaggtactctgggaattggaatggtggaggagagagatggaaaacctagaatgagaacatctaaactgccttttagggggaaaaatacggttttgatgggatatatgattccttgccatcaatttctgctgggaatataacaaaaagtatatttagatggtgtttaagtagtgaaactttgtttaaatatttctgattggactgtcaacttaatggtgtggtggtctggtactaatgccagggtaagattgtgaattcagcatgatatttgtcaaagtgaatgctactcactgttaggtggcatctttagctttattttagaggtttagtgtgaagtaaatgtaaccacagtttgtattaatcctttctttaggtgttttatgtttatttcactgagtttctttttttttaatctcaattttgaaccaaacttcaaccctttaatctcctaagaccttaaaatcatggtatattatttgattacatatgtactgtcattttagtatctttaggaaagatacatcctcatccccaaaatgctccatcatttctagtagtttgcttagttcttacatgtacataataataaccaacattgattggacatagtatgtgttagaaaccattctaagtgttttatgtgtactaagtaatttattcctcaataaatccctatgatttcaaaatgattatattcacaatcttacggataaaaacttgcagcactgatagatttttaaaaaaacaacaaagaaacttgatcaagattacccagctgggaagcagagaaactgaggtttaaatccaggtagcttgattccagagacattgccctgaaacttaatcatagagctttgatatttaaaagtaaactgcttcttggaaaggtgaccttaaatgtagttatttgacattatttatgcttcaaaatgaatgatccgaaagaaggctttgatgtgcataaacctgacactggaagagagatcgctctttggggaggaaatatgatgaagaactgagatgctggaatcttataaacataagccccttccttcaaaattttcattagaaaattgtaaacactttattctgctattaaccacatgggcctggagactgagaagtggaaggcactaggcaggcttcctctttaactaaactctacctcggcagggttagatctgcatagttgaatcagccccctaaaggaaacagacacctgtgaccacatctgcttctttcccttgagcctgacacctgttctttcatcaggatacttctgtagtttgggaggatgtggttgaaagaatgtatttgtgaattgcaagcaggtaattaaggtagctcagtaccttgaacatttctgatgttaggagcaggcatttgaaaacagtaatgacagtaattagataggtagtgattctcgcttgaacccgggaggcggaggttgcagtgagttgagattgcgtcattgcattccagcctgggcaacaagagtgaaactccatctcaaaagaaacaaacaaacaaacaaaaaaaggcagggattcttttcctgcgttatttattatttacctgttagaaactaatgtatgtctctctgtaaatgcatgagttaaaaaataaacgaataaatgaatgagagagactagtgatattttgttgagaaattgggcgtatgtttgctataatctattatgagcaaaactattttagaattgaatttttcaaattgacttatatacagttgattttatattctcaactaagtttacatcgatatcaaatttgaaacctcagcggcattcaattgatttgttggttttatataaaaagaaatctcatggaagatgttgtgcctgtgttaatacatagccactgaagggaccaatttttcaataaagccatgttttctgatttatatattcattaggttggcagtggacatttatgtagttgtggggttagttatacagcacccttttgggaatggtcatccttttgtcattagaagcgatagggttgaaattgttccacaaagataaagatgtttctaatgtatttatggggaagaaggggcaaagatggaaaagagttacaaatgtaagaattataccattcagaattgtaagtctgaatctgtatctttgaatgtgtatggcttaaaacagccataaacggcatagtactattttccaacagcacagtctgtctgtctgtactcctaggaagatctagcagcacattaaggataattttcctcatcaactaagcattcttaaaactaatttagataaaaactatcaaataaaatttaaaatgtaaccccctcctaaccaaaatatgcagagatgatatcagattacagtgcagcagttaattttctctccaaaatttagtttcaaccgagcaagaaatgtgttccctgtattgatacagaaagtagaggcaatctttgcctatagcttgattttatactcgttatattaaataaagagaaatgtgcatttttctgtattggctaatttagaatgatttgcataaggttaaaatacagagttactataactggcaatttgtgttacttataatacggttctgacttttattatctttgataaataaattgagctttagagtagttactttatgaataattctttttcaaatataaagaatctgttttccataagtcaaataactataccagtttttaaagaaacatataatgttggtatgttctctaacctcatggcatgttagtaaattaaaatattatttaattaatattaattatcagccaatatctgataatgaataaaaagatgatttatcattattatatgatagtggtgatgaagggtacattccaattactctttcaattgtaataatacaggcacatttgtcccctacaaaaatcacctgaagaggcaaagtaagaggagcatgtgataggttgggaagtttaaaatctacctactaaaaataaatgaatgtataaatattttcagagtgaggtaggccattgctttttgttgttgtttgaattgaatattggacttgctctagatataacagctacagccccataggagaatgttctcatgtggcttattgcctttaaaataatttacttgaaaatcttaatctccactaagaaaatagcccagatcctctacatatcttaaatatattacaaacctgtaacttttaaatatttcccagttacattagtcagtgccacccaatttatatctatggctttcattcacatgaaggaaaagggtaactgttggggagttctgaactttccagcatttacagaatcctagtgggctgattacttagtggagggagaagcaaggtgaataggtgagtatgggcatgagagaaagtgaatatgagcagttatgggaattggatgaccaagatgttagggaagctattgaaggcagtactattttaattgttttatctatatgtgttcaatcaacaattatgactatatcgatataattcagagactgaaaaatattgtggtttagccacccagatagtctggcaaatatggatataacagggtttgtgtggtagataattgttttgaaaaattagtatgcggtaagtctcagaataaagttacactgactactattcattcattggtgaataaaaatgcacttagacaacttgtgttcctcctggtccaggtttctccaccttggggagagagtaaaatagttccacttatagtgaaaggagggattcaactggaaatctggcagggcctgactgcttagaagttctaggtaaagaaagtctacaccagtggctcccaagcttcactgggcatattaatctttgataaaaatgtagactttactggggccctatctccaaagaatctgattcagtaggtcataggatgcaacatctgtaattttaacaagcatctcaggtggtctaaggctaatgtttcatgtctctagttgagcttaaacccacaatatttacatgaggtacttaaaaagtagggagagagcaacagagagagagacagacagaaagagagaacaaagagagaaataaaaggaaaaccttgaaaacaccctgaattggactctaaggcaaaagttgtcagtaagttttcaaaaagtataaggtactgtctcttctctacttcagtgctatttttcatattttgagtatattttactaaatgatattccatacttttaaggagcatagtaatagatcagaaaaagttaattccaactgcagaagatattattcagccacatcataatttgtaagtacagataaatggcaaatagcattaaatcctaactttgtagtttaaatggcagaatcatgcactgctagaaataaaaataatacctttcaattaggaattgttcctgtttgacaaaaatgatctatttttcttaacatagaaattaatatatgcctttaaaacaagttctacatgtaaaatattagtaaagagatccatcaacttaatgaaaatgatcaataatctttagctttgtgagaggatagtattttggattgtatatgcatgcaaactaatggccaatggcaaaggttgtttggttttactccctgggcatcagaaactagtagtctttcattttaagaaaaactgaagatctctttaaatctataccccaaatctaccattaagaggacagtttttctgtattttaagtaagaaatgggtgaaaatatctgtctgtagtaagccacgtttgctggtgttcagtaagctaacctcagcacatcaatgtaaacccagtcttcttggtgtagaaaaagaaattatcacaggtattgggagacacatagcacaaaagaaagtatttccttcaacttctactccccaatatttttttagtggcttttactggaattaaaatacgtatcctacaaacgaggctttaattcattgtctctttgactgaaatttttttttgctgtttgcatcagatgttcaacagaggacaaattacagtttcagactgtatcaagtattccagcaggcagaggcatctgattcagataaattgagcacacatttgaaagaaagtcttttattctagacacggctgacttcattgctagctctgatgttcagcaatagatctagaggctggaagacaggaaatgctgaccagtacaaatgcatttcagtgtgtgaagtatgctagattatcagaaagtatatttagagaaagccttcctaggttttaatagacatccttacttttgtgtcaaataatgtaattattatacatgtaatgaatatacatgttaccattatctcttctaatctgttattaagttgcatgtatttatattgtttaaaatctctgttttaaaataaattcatttacatatatttcctcttgctttcaaatccaataactatgaattccatgaaattcagagctatatcttcacaaaaacctaataaagtacatcttccctagatggtgcttaatgactaagtgttgaaagaataaatacttgctcagtttgaggcagcctgggaaattaaaaagaactagaaaagcaaacagggcctggaagctggttttagataacaaatttatcgccaaatttatctcagttttccgacagtttcaacaaaaagggggctgttttggttttggttttgactgttcagtaaaaggagcatccaggatgagaaatttatctggctctgaatttaagaatgtatcaatagaatggttaaaaagagaggtaaacataatagactatcattctccttctgagtttcttaatttatatttggtgattgatttcatggttgatgcaaaaattagaacattcattgtggtgcttaatacatgcagagaaagtacactgtgatcgaatgaaaaatacctgtttggtctctgcctccagttcctggcacagagctactaaaactattgtgaagtcctggtgcacttagcatcttaaactccaatatttggtctttgaacccatttcttgacacagaactcctaataccttagaatttcctaggtgatatgagggtcctttgttctaatgaggcagctcttggtagactcctggatggaggctggtgaccagaaagaccaagccataattaagagcttgaaactttcagccccactatccgattctccaggaagggtagggaagcttgagttaataataggtcatgtctacacgatgaagcttctattaaaaattcctaaactacagggttcagagagtttctgggctgctgaacatgtggtgatgcagggaagatgacgtgtcccgaagaggctagaagcaccacaccccttaccacagatttcaccctatgtgcctctttatctggctgttgatctgtattctttcttatatactttataatgaaccagtagatgtggaaaaaaagatgtattaagctggaatagagttgcaaatgtatgatttttttcaaaaaagacaaatacaatctttatatttttgtattagccctcagtgataacaggaagtatgaaattaaatgtttactcagtgaagattttacattgaggagccactagacgtagacagatcttgatctttcttttcctagggcttggcaaaattcctggcacctaagagcatctcagtaaatgttacttgaatggaaatatttcaagctcaattaaaaatcaagttgaagatatttcactggttttaatcctctgaaagatagcatagctctactggtggctaaatttatgtataatctctgaaacccagaaactgtacaacaaggccatgcctggaacacagtcttgatgatacatcaagagtgactcccagctggctggagcctgcatattcctgtttcggttctttttcctccagtagaatggtctagacagaggccatgggaacaggcctggataccggagttaaggtgtgatatgtccagtcactatcttgagcctggagtgtttaggacactgtttaggatacaaaaatttttaagatttgggtgacattcaagaaaacatgaaatatttgttatcataggacctttcaatttcaaccgttcctaagagttagctggaattcacaagaataacatcttggtttgtaatttaaataatgaagactggttggatggcccaccgtgagggggggagtcagggctagctgcagtgaaggtgggtaggtcacgagggatgcactggaaagcacgcgcctcatgggcaagagtgtaggaagttgcctccctctcgtggactgagagaggacagggtagccaacgaaattccgtggtaaatggcaggcacatgtctaagccaaacaggcaggaggacgatttgatttgactgactgactgactagctatttagtctaaattgagcacgtggacaataaaaggttttctaatgcgtccccagtgtgggcctatgctagtgattgaacaaatgtgatttagactgcagtgtagtctgaactaaaatgggtcaaagaaatatggaatggcaaatagcttcttggccatgttccctgtttttcttcaggcactagaaaaatgcaaaaacatgaccactggatttttccaatgatcttgacaaaacaaagttttgtgttaaacagaaaatttattcttctgcttttactatagaaaagactttggtgtgagtttgtgtgtctttgtgcatgcaaatgcccctgaagcatcttagttccctcaggctaaacagaggccccacatcacaggattttttagtgtttaaagtaagttaaagtttcttcagggctataagaatgacagattttctttcccactgaggtcctgccgacttgcttcaaggattttagtgttcaatttctatctagcttttctaaatgtagttttgaagtggattataaagcttttaatctactaagtatccatagtttatttttcaacacaaagggctttcatttgaataatatctggaacctctccccacccccattttgacagctttgttttttgttctttattacataaggagacacagaggggatataggacaagcagatgaaaaaggatgtgaaacgatcttagagtttgatgatacaatgtcacatacacagtaattactgtggaatgtccccaatgcccaaggtcaattggggctggcacgtgaaggaactcagtaactacttgctaaatgcagggatgcatgtatgatggattttttttttttttttgagaccgaatctcactctgctgcccaggctggagtgcagtggcgctatgtcagctcactgcaacctctgcctcccagattgaagtgattctcatgcctcagcctcccaagtagctgggattacaggtgcatgccaccacattgggctaatttttgtatttttagtagaggtcgggtttcaccatgttacccaggctggtctcaacttcctgacctgaagtgatccgtccatctcagcctcccaaagtgctgggattatagacgtgagccaccacacctggcctgatgaatttttaaatattgtatttttaagctaagaagatgatttttgaaaaatattctctgtcagtataagaaaaactaacataactatttgaagttataaatagaaagcatttaaaagacagaagcatgtgtaattgtagattttgggggttattaacataaaacaagaaattatttaaaaattttattgtatttcaatgtggatttattattattttttagtagtagaagatggtttatgcattttgcatacatttttgtagtagtctttcaatcaagttagaatggcctgatcatctgtaaaagcttcttctcttaattgtcatcatctcatttcggatatggtattccttcagctgcacagcctgtctcttggaccagagatcttggacagtgatggttatgggctgaactgtttcccaaaaaagtcatatgttgcgtacctaacatccagtaccccagaatgtgactctatttagagacaggacctctaaagatataattaaggtaaaatgaggtcatatgtgtaggctctaatcccatatgactggtgccattataagaaaatgagagtaaaatatagacaacacacagaccaaggggcagccatgtgaggacacagtgggacgatggccatctgtaagccaaagaaagaggcctcagaagaaatctaacctgccaacacctgatcttggacttcccagcctccagaactgtgagaaaataaatttcacttgtttaagccacccagtttgtggcattttgttatggcagcactatcagactaatacagtgactctcttttcatattgggcagtcaagagactttccagtctcatcctggaggatgactgggctgtcagctattcccctttagctggattctaactgctttttgttccacagacctgttaggcggtctgatgaatcctatggatcccttctcaaagtgatgtttaaatgtgtaaaataaaatacataaacttagaaaaggaaccaaccttatgtaaatacagttttcaaaatattttttacatgtaaggcttaaaattatatgggcatccttattagccagtgaataataacatctagcaagggaatataattttaataatatttggggctataattataatgtgaaaatatctgtggtttctattaaggacaaagtcacaagtacgatttatcctcctgtggtttatttccaacattcaaaatggaagacaatgaaaattttcaattagaggttagtgatgataaacatgtaattttccccctcatccaagttccacagactaaagttaagaatccttgtcttagagaaataataacagcatgatctccactgtataaaaagcttaggattagagaccactaagtaaaatgtacattttgggtgataaatttgcacagatctattctatctcttaatcatttctctttgtgactagtggtatgtatttgcaaggaagtgaaaagaaggaagtaatctgacattaggggtagagaaaacctagcctgagccctaggactattgccgtttatgactagtggatttttgaagtgcttaggtgaagatgtgggctacaggctttgcaactacttatgtttagtaacctcagaaagtctttaggcttttggttttcaaagtaatatactattgggggtataaatcacatcccctttgttactcctgtacctgagcaaggaatttttcacaagcctcttcacttcctgtcagactttgccattcatgacataccatggataggaacagcgtagaaggtgtttgaccactgcggacattgaatgtgtctttggtgagtcagtataaaaactgaagccatggcagttattatttctacatatgacagtgaccctctgccatctgaactttacttgccaggtagaatctgtgtctggagccttaatttgtaagatctgtactcaagtcctgactctaccactggacactgaatatctttcacttttagtctattcatttgtaaaagggatataataaaaatacctgttctgctttctaaaaatatttgtttaaagcataaaatgtagtgacacatgcaaaagccattaaatgtaagtgatgaagtacaatgctaatgtaaggcaataatacatttaaaataaacatagtgaacattatactagaaacttcaagttaatgtagcaagacttattatttattccaaataattttgaacaaaaaagtaccattatttttaaatgagaaaatattatgattttaaacctttattaataaaaacagaatcctcataatgccctgcttttttaaacagttgtgctttcaattaggcttataatattaacaggatagagaccctagatataaggaagcttcttcctctctgaagttctagcaagaattcagcacttcagttcaacattttatctaatctaatgacagtttttattttcacaagattaggaagcaacctcagatatgactttgtaaatgaaatataactactcagaaagaagttaggagatgcttacaaagagtttagtgctggtcaggctggggtagataagagttttaaaagcttaacatgtgccttaaaagcctctcaaaaaaaaatccctgagaaaattttaaaactgaagataatgattgatgaatgtgataagattctaagtatagcagtagtgataaagagttgaaaaatcaaactgattctcctggaaggcagtaacatatttaaaaatgtcaagttggtaggggttcttaaaggaaacaagatgtataatttttgaacagtaggttatgatggctgtggaagtggtaattttgacagtgcatttgtggtggttgagtcggaacaggtcaattagcttttacaaaatgcgttttgccttagtaacttaaccaccgaatatttatatatcacagtttaaaagatttgggtatgcttcattttactttaaaaatttagcaagatttaattaattctaattaattaaaataatgttcagggtttgtttgtttgcattcatcaaattgaaacacttcttgcaattcagaataattaatgaggagactaaattcaacaataattacagatttttaaagggaaattgttggtttacattgctgtgtgaaaaatatggagcactgctaaaaatagtgtggttttaaaagctattctatgattccagagctggggcaggaaaacataagatgagcctggggcatcttttgttgccagaaaataaaaatgtgctaaaagagaaaaatggggcatttcaaaaaggcttagacactaatgggaaagagctcccagtggccaaagttggaacaacttaaacaacattataaatagcataaacaaaaacataaaataagcaaatagaaaattttggattaaactcaaaaactaaaataaatatctatgaatacatactgacaaaaatatataggtgaataaatgcataaatgtcatggaagtgagaactcttcattaccaaggaattgcaaagaattaatacagaaagaatgagggaaatagaaaatcagcatttggacaccaaagtaataattgctttagccaagtggatattcaaattggtgagtaaaactttaaataagaataggatatttgcctagtccccaagtatctcgctcccaaataataacaaaggaacaaataaccgtacaatgttgaatcttggcagacactacattaaccaagtgatcgattttaattactagtactgtgtgatcaaatttaattactagtacataaagtgatcaaatttaattactagtacataatatctgtggatatcatgtaccttctcatatgatacacagaaaagggcacaggacctctctgatatccttgccaacaataactaaactcattctaataatgagaaaacattagatagaccaaattgtgggacggtccatgaaatttctggccattattattcaaaaccttcagagacataaaggacaaggacagactgagaaactgtcagagactggaagagacaaaggagacatcacaactaaatgaaatgcagggtcccagattaaatcctaaaacagagaaaaaaaaaaagtgaaaaaaaccctgcagaaacttgagtaagttctgtactctagttaataccagtagtattgtatcagcgctaacttcttagttgtgataaataggctatggttatgtaaggtgctatcataaagggaacctgggtgaagggcatgtgggaactttctgtactatttttgccactcttctattaagtctaaaattatctcaaccttaaatttttttaaaataaaagctcttataataaaatgtacatatccaattttaagataacagctaacatttgtgtagcagtatgtaccaggcattgttacaaatgctttacatatattgacttatataatttctgcaatagtagctgccattaacatcaccattttatagatgagaaaactgaggcaaacagagagtttacagtagagctgggacttcaacctggaattttacttctggaatatgtactcttaactactgttatatggtcttcaaattaactgacttacctctagggaatacagttaccataataatgctactttaaacaccttgagaattattttttttttaatctttttgagacagagtctcgctctgtcacccaggctggagtgcaatggtgcaatctcagctcactgcaacctctgcctcccgggttcaagcgattctcctgcctcagcctcccaagtagctaggactacaggtgcatgccaccacgcctggctaatttttgtatttttagtagaaacagggtttcaccaggttggtcaggctggtctcgaacttctgaccttgtaatccccctgcttgggcctctcagagtgcagggattacaggcgtgagccactgcgccaagccaaaatgcataacatataatattgttttgcagcaggctttttcattaaacactatatcataaatacctttctgtatctataaaaatgttctgcattatttttaatatgaaaaaatttaattccttgaatatataagacttcgtataatcaagtatctttttgaaaaattggctcgattatctcagaaaaaatactgctatgaagatcattgtgtacaaattcttgtgtcattttccattcacacattcatgcatttatctgtcttttatttgttcatataaatgaatataaatatatatacttatatatgtgtatatatatatatacacatacatatataagtgtgtgtatatatatacacatacatatataagtgtgtatatatatatttaacctactgtgcttcaggctctgtgtaggtaatagggatatagcagagaagaaaacaattatcccttgcactaaggatctcatatttcgtaggataaattcctggaaatggaattgctgaatcaagagttatgtggatatttacaccttttgactcactcagcatattgttgcctaagaaagtggggaaattgacagttccgtcagaaatgtcttattgaggctgggcatggtgacttaacgcctgtaatcccagcactttgggaggccatagcatgtggatcacctgaggtcaggagttcgagaccagcctggccaacacgttgaagccctgtctctactaaaaatacaaaagttagctgggcatggtggcacatgtctgtagtccctgagtacaggcagctgagataggagaattgcttgaacctgggaggtggaggttgcagtgagccgagaacacaccactacactccagcctgggtgacaaagtgacactttgtctcagacaaaaaaaaaaagaaagaaagaaaaaaatgttttattgagttcaggtaaactgattcctcaatactttttctctctgttcttcagactgaacaatttctattgatctgtcttcaagttcactgggtctaatgccatcttcaatctgctattaatctcatccactgaaattttaattcagatattgtatttttcagttctaaaagattcatttttaaaatagtttctatatcgcagctgacatatcattgtattaatgctgagcatggttttcctcacatccttgagcatagttataatagctgtttaaaatccttgtctacgaaagttcaacatgtgggtcactttagaatcaattttcattagttgcctcttctattgaatattgatgacttttttctgtgtgtttttttttttatctaatttggattatattctgggcatcatgaatgatacactgtggagactctggattcagttatgttcttccaaatgtgtggagtcttgaatcctctggaatctgcccatttgtagtttttgttcaatgtcttcagatagttttgcatgttttctagaatttctagttgtcatctttgagacagttgttccaataggagccacttagccatgatgagaaacaaaatttcatgtaaatgaattcttaaaagcatttctcaagtgtattttaaaatactttgagcatcagagtattattttgcagacggaaaattatttggacatataagttctttaaactttgtttaaattttatttctttgtagctatatcctataagcaagcatagtttttctttctcatcttaaaaatatattgtgtgtgaaaatccaaaaagattttcttctttgcaaaagtagatcaaccttaaaaatataaatttaggtaaatacctaatttaaagtgagctacagaagtttttaggtaactttaactgaatgatacataactgaagaaatatattgctcacatgtagattgtgtggttgtacaagatagaatgtaaaaagaaataaaatcaaatgtagaccttttctagacttgatcttaaccaaaaggccaaaaaatgatgaaggtagatgttttctaacaattttcttagctgtaccattgccgttttctttttactaatttattttaattaataaataaaaataatatacaggcatagctcagatatattgtgtttcagttccagactactgcaataaagcaagtattgcaatcaagtgattcacacaaattttttttttattttctagtgcttttaaaagctacgtttaccctatactgttgtccattaggtgtacaatataagtatgtttaaaaatatatatatattaatttaaaaatattttattgctaaaaatcattaacaatcatatgaaccttgagagacttgtaaacttttttgttcttgcctaaactaaggctcttgcctcagtgtttatggctgctgactgatcagagtggcagctgccaaagcttgggttgctgttgcaatttcttaaagtaagacaacaaggaagtttgccacttcaattaactcttcttctcataacagacttttctgtagcattcagtgatgtttgatagcattttactcaccgtagaacttctttccaaattgaagtcaatgctttcaaaatgtaccacagctaagtttatgcaaaattctaaatcttttattgtcatttcaactatatgcacagcatctataccgggagtggattgcatctcaaaaaaaaccactttctttgctcattcataataagcaacttctcatcacttgaagttttatcatgagattgcagcaatttagtcacatcttcaggctccctcctttttttttttttttttttttttttgagacagagcttttgctcttgtcacccaggctggagtgcagtggtgcgatctcagctcactgcaactgccgcctcctgggttcaggcgattctcctgcctcagcccccagagtagctgggacaataggcgcacaacaccacccctggctaatttttgtatttttgctagagacgagggttcaccatgttggccaagatgttctcaatctcctgaccttgtgatccacctgcctcggcctcccaaattgctgggattacaggcctgagccactgcgcccagccaggctccacttctgctccactcctttttttttttttttttttttttgagacagagtctcgctctgttgcccaggctggagtgcagtggcgcaatctcggctcactgcaagctctacctcccgggttcacgccattctcctgcctcagcctcccgagtagctgggactacaggcacccgccaccacgcctggctaattttttgtgtgtttttagtagagacggggtttcactattgtagccaggatggtctcgatctcctgacctcgtgatccacccacctcggcctcccaaagtgccaggctccacttctaattctagttcttgttctatttccatcacatctgcagttgcttcttccactggagtcttgacctctcagagttatccatgaggattggaatcaactttttctgcacttctgttaatattgatgttttgacctcctcccatgaatcacagatgttttaatggcatatagaatggtaaatcctttctagaaggtttttaatttactttgcccagattcgtcagaagaatcactctctatgacatctataacctttttaaatgtatttcttaaataataagacttgaaagcaaaaattactcctgatccatgggctgcagaatgagtattgtgttagcaggcataaaaacaataatctccttgggcatctccatcagagttcctaggtgacagatgctttgacaataagcagtaatattttgaaatatctttttttctgagaagtaggtctcaacaatggcttttaaatattcaataagccatgctataaacagatattctatcatccaggctttgctgttccattttttgagcacaggcagagtagatttttcatgattcttaagggccctagaatttttggagtgggaattggcttcatcttaaatcaccagctgcattagatcttactgagagtcagcctgttctttgaagctttgaaactggtcattgacttctatttagatatgaaatcctagatggcatcttcttctaatataggactctttcatatacactgaaaatctgttgtttagcatagccaccctcattcacaatgttagctagatcttctggataacttgctacagcatctgcaccagcatttcctgcttcacattgcacttttatgttatggaggtgacttctttctttcaacctcatgaatcagtctttgccagcttccaacttttcttttgcagcttcgtcttctctctcagccttcatagaattgaagagagttaagggcttactgtagattaggctttggcttaagggaatattgttgaaaccttctccatatcatcaataaagctgtttcacttactgataatttgtgtgcttactatagtagcactttcaatttccttcaagaacattttatttgtattcacaactgggctgtttagtgcaagagatctaactttcaccctatcttgacttttaacatgtctttctcactatgtttaatcatttctaggttttgattaaagtgagacatgtgtgactcttcattccacttgaacgcttagcagccattgaggagttattaattggcctgattttaatattgctgtttcacttactgatatttgtgtgcttactatagtagcacttccaatttccttcaagaacattttctttgtattcacaactgggctgtttagtgcaagagatctagctttcaccctatcttgacttttaacatgtctttctcactatgtttaatcatttctaggttttgattaaagtgagacatgtgtgactcttcattccacttgaacgcttagcagccattgaggagttattaattggcctgattttaatattgctgtgtctaagggaataggaaagtctcaaaaggaggcgagagataagggaatggccagtcggtggaacagtcagaacatacataacatttattggtatagtttgcattcttatatgggtgtggtttgtggcacctcaaaacaattacaatagtaaaatcacagatcatcataacaaataataataatgaaaaagcttgaagtattgcactgattaccaatatgtgacacagagaggtgagcacacatgaagtgagcatatgttgttgaaaaaccggtgctgatatacttgattgatgcaatgttgccacaaatcttcagtttatataaaaaaataaaactgcaatatctacaaagtgcaatagtgtgcaataaagtatgcctgtatatttatggtgcacaatgtgtttgaaacatatatacattatgtcattaccagtttctgatttaaatccctgtactatatatattgatttgtaattgcccatgttgacatggcagtatcatgggccatgatactttcaaaataattgttttattagttttgattaaagggaaactttctttttttttttttttttttttagaattccatgacctttaaaggtaaaaattaattctctcagcttagtaataggaatagagacacaatcacactgatatttcacatgagaaattgtcgttctagcatttttactctttccttgaatagtactgttcaaccataataaattatcctcccctttgaatacgtatttacctttgcatttagggtagggtaaactaaagatttcttactgactttttttttttaatcgaaagaatcattagcaactaaatcatcttaggatgttgtttggcctttatcgtgctgacccaaaatttttgtttgcaatgtcttactaacttacattgtctttgaaaggagttctctgctcagtaattgacaagaattctctgggggagataaaaccataaactgatgtttaaaaaaataaaaagtaagccagaaatgttagagataagggatcaactgcaatttctgatttggtttcctagcacctaatttctatttctaggcatgcgcaaacatcccgtcctagtcttacagtgttatccttatgtgctatttgtaatgaggcacagtaagaatttaggtggtctttgatttatgatgtgtgctatatatgttcgtaatgatctttaagtaagtagcataaatataacactttctgtagtgtctggtaatacagtgttgacaattagtgatgggagatactgatttagattacttaaaaagaacctacatactttgagattagttgaaatttttacatccacacatactgatagtatatggaggaaactaaaagtttcctacatgtgcatgtacataggactctagactttatttattttcttatttttatctcatgaattaaaatcagatgaacacatctgtaatctaccaatttcttagtccatttatactgctataaaaaaaacgcagactggataattgataaacaattgaaatttatttctcacgtttctgaaggctggaaagtccaaggttaaggtgccgacaggttcatgtctgttgaaggctgctccctgtttccaagatagccccttgttgagatagcctctgaagaggccaaatgctgcgtcctcacatggccacagagaggtaaagaagggacttaccctctcaagcccttttataggttgctgatctcatacatacaagcccactcttatgacttaatcacctgctaaagtccccacctttgaatagtataaagttggtgattatttttcaacataatgaattttagaggacacattcaaaccacagaaaccaaaatggtaagattcagttgaaatttcactatctccatagatctgagggtctttaatctagcaaatattgatatttcatttagaaattttgttgtatacttttttacccttaattttattatttaacgcatttttataatcaaatctgcacagtttagaacatattcatatacagtgtgctgttatttttttcaaacatatgatatctgcctagttcatttgaagcaccttatataattgaaactcaaagtagctgtgctagtatacagtaggtggttgaaaagtgaaaagaatctcttttaagttatttattttcactactatattaaagtgtaaaggcaagggaaacactttaatacatattgtaaaactaaactacttaacagagtaagtgccatatagttaggccagaaatagatccacttacagataaaaatttgatatattgctatattaaatatatagtaaataggaattatgtatctataataaaaagcatattcaataaatggctaagggataagtgtccaaaggaaataatatttatgtcaccataatcaattcactaaatagttaaacacttgaatatttttatactgctggatgtcaaaatttaggaagcagagaaaacacaaagaagaaataaacttcagggaagaaagatataaaaaattgagacatcattttcagcaaatatgaaaaactgtataaatattcattacttaatggattcataaatactggaatatgttaaaacccagaagataaatggacaaagacatgaagtgatcattatgaaaaacacaactatgtaactcctcttgtatttcacattttctttacagaacctattagtaagaataaatctaaaacatgaagaaagttatagggatgtttgtttcaacattatttaaaaccgtcatatcccaaacacctaggggcccatcagtagataaatacttaggtaaattatgtgtgtacacacagactcttatgcaaccactaccaatattagtcattaggaccatgtaagatcgtggcaacatgtgtactgttcaatgaaaattcatcatttaaaacagggaaaacagtataattatagcaaggcaaaagaagaacactcatgaaaaaacaatgaaagtaagtacttcaaaattataaggtgatttgcattatgaagaagagactgtgagtatttttttctcatttttctagtcctcaaatttactgttacatgaacactgcctttcaaatgtgaaaaaacgtttaaggtataaaaagaagaagaagcaaatgtgcttctttagctagaaatactctaaagtacattttacattttttcagcagtagtttcatccattttactagttattatttttcttttattaagacaaagaatattcaacagggggcaaatgcaagcatctgtttggttctcaggattcctacagctcttaaattataaactgagaacttatactatatataaggcaaaatagtttaaaaggaaaattaattctaacaatgcattttaccagtaaaatataaaatagggatgagtgtaaaaatcgaaataaatgaagaaatatgtcagtcataaaatttcaccttggtgtttcaactcaggcaattcctagagggaagagtggcctcctgactccataggaggtataataagtgcatgaccagagactgctgaaaccaataaaaataaccgtcaacccaccacttgtctttgtaatcactccatatcttgatttcccttgcactataaaatagactaaatataggcgagttcaagaaaaaattgatttaaaaaatatggctctttttttctgattagatttcataatttatcagagacaaaatatctctacacttctttgtcatacgaatcaaccttgagatattcacctttcagcatgtaggtgaaattttaaatagtcagtattcatcattgccattagttattgtaaggtatagcttattcctctcattggaaacaaagtgcatttcttacctgacctctgtgattcttaaacaatattcatttgaaaagcttgtagacaccactgaagagtgaaaatatctacctttcttattttcaggatttgatcacagtaaaaatgctttcatttggggagattctacctatatttcttggatcacaatgattctggaatcctaaagagttcagagtttagattgcatatgtcttttcttttttgacttctttcacttttgtagctaacaacttgatcgtaatgactcagtccaaaagaaatatgaacctattagttttagtgatcatgaaaacaaatgcttggtgaatttttttctaaaacatcaaaaaaatttaaattttagaattggaagaggtcttggaaaatgttatctaattctcactcttcacctcactaaaattttgaaaactttaagtgatttcctaaagggacacagctaattagaggcagagttctaacagaaaacccaagtctcttgattcatttccagtgctttaaccaatatattatgttgctatgtaggatagtttaaattctaattttccatggttagttttaaaatacaatcatttttaaaatatactagtaaaacagtttttgctttctaaaaataaccagctctaaaagggatcttttcaagcattatcattattttaataactggtttttaaaactatcaatctgtattagtaaaattttcactcagaaaatttgactacaacaaaaataacactaaaaaaaacccacttctaccactactgtcatcacttaatatggatccttttcaagaaataaaattataaactttaattgaaactttctaaattacttctaactgatcttctaattatatcccattccttaaaataagcagatatttagcaccaataggaaatgcctgtagtgacagtgaaacatggtgtatatgaatcacccatataatgcacataataaaatctttgtgaatcacaatgttccctttattctattcccaagtctctcaattataggcatatctggagctactagtccaaatataattgatttaataatagatagcttaaagcacagtgagatacagtcatccctcagtatctgtggggaatgggttccaggaccccagagataccaaaatcctcagatgctcaaatccgttatacaaaatggtatagtatttgcatataacctaagcatatcctcccctatactttaaatcatccctagattacttataatacctagtataatataaatgctatatcaagagttgttatactgtaattttaaaaatatttttattgttttattgttattttttattcttctttgttcccagtaaatttgattggccattggttgaattgtggatgcagaacctatgggtatggaacttgcagatacagaggccagctattctgaagtgcttttaaaacatcataaactaaatagcagtgagcatattttttgtgttatgttcatattaatacatgctaattttttgaatatataataaacttatgacattttattaatacgaatatttgatgtcccaaaacttctatataaaccagggaaagtttatcgtgacgtatttttttcctaacattatgtatttacattttttttgagtgttgaagaagacattaagatgtttaggagtatttaaactctgcaataacccagttaaaatgaaagctcagaggttttcattttgttacctttattgtcacttgaatatggactattgacagctcaccatttacaagacatgcacaaagacagatttattataatttaggtgttgatcactttggctggagattttctgttattagagtagaatactacatttcaaaccagctatacaagttttttgtttgtattcactgtctccatgaagaataatttgaaacgaaaattgaaggcttctaattttatgcagagtgacagctatgtatttccataaatgtatgagcattttgacatgaaactgttatttctcatccgaagtcataattgttcagcatgaaagtgggccatgagaatgaatgataataataatttgcctttttgagatcatggcattaataagcataattttcagagctgcatataagcaaaaggagtttgcctgtagacagtatgacaagacggttattgggaggagggtatgtgaattgcccacctttgcagccatcttgcctttctgacctttctttctgcgtaactgtagcctctagccagctaccttccactgttttactacaaacagtgacaaagagagcaaaaaagaggtcagtgtaggaattccaaggagttaataccttttactacatagctcaatggcatgaccatttagttgtgacatgtcgtttttaaagtagtctgtttccttttaaaagaatcccgttgtcaagaagtaaaaaggggttttgttgttgttaaatgatgttttaaaatcctgtccaatttatgttaaagaaagtacctatggaggttgagactgaaagacagtgatacatgaaaaggaataaaagaacacagcaaacataaggtctggcaacgaccatgatagttgtttgcctgccaacagcagtaataaggactagttgtaccggttgagaaagctgtttaattcagatgcatccaaaaaatatgcatccttcaaaagagatacggtgcatacatttatactttaagaaacaccactgtgaacttcaatcttgaatgactcaaagaaaacgtttaaattcttcaagcttacagacataagaaagaatgcaataaattgtgggaactggtagagattttgccaaaaataaagggccttctcttttgtgtatgtatgagggtgtgtgtgtgtgtgtgtgtgtgtttaattaggtaaaattatgtaagttcatttaggctctgcagcattttctgatgacccagtaatcattttctgttatcccatttagctgttaagagcaatgaatagaaatctgaaaccaaaagccattccctttaaaattctacatgcattaacttgggttgcaggaggaaattcccttataaaagtgaaggtattaccattaacacagagaactctttcagtcgttcagataataattctgactctcatttctaggacctgtcccttcagttgttttgcagctaatggtcagaggtttgttcagaaccacccacacacacttgtttagtccctgggtgaccaacagaatgcatttatgagaaggttgggccggagaccgcagtgtgtgcctttggtacagagattctctttggtgcaaaatctatctggcctttatagatattgcattagcatcgagcacaaaatgttcaactgcctgactcttgaacccttttccctgacctcaaatgaatgttttctgaagatataaatgtgtgaaaggtggtcatttatataaacctggagaaatacaaggagatagcattgaaagaaaattgttattgcactctgatcttgcaggaaaattgatttattattatgaaataacaaagtactcttaaggctaaaaccttttttgccctacttcaacctgacgaaaaggtttacctcctagttataaacccatccatagcgtggtctctaatggaaaaatccgagagctccttcacacatggcaataggagccagtgctctaataaaagccttcattaaaatatggttggaatctatgtggcatggcaattctcagctacaaattgaaaaagaattggttgcacctgtaatgagagttcaattaagtgatcttggaaaaaagctagaaggaaattaaatattgaatccttcatcattgagtgtttatcttgaagggaataatgtatggactgaagacaagtggagatcagcagacataacctctcctgtgtttattctttatggtgaaggagcttgcccttattcaagcaaggcacttctctatccacatttaattctgtggtaaaataggataatacaaaccacatgtttactacaacatagagatgtcatacaggttgacaggtaatgacagcaaagcactctggacacaatgctaatattgtgcactgttcattatttgaattattgatcatgtgcaacggcctaaataatcaaaatagcaaatatatagcctgatctctcagttcccaagtggaaggattatgggctgataatcatatccccttagattctctttaacctaatgtgatattttgtaagactttcaagctatctgcatagtcagaaaatcattttagatatttaggcagcaaaagcctcttcacagtactgcatttggcaaggtgccatcctaaaatagttcctcttttccatatgtgttatgccctttgcccagtctacctcccttccctttttgcctagtttggcctttattccttcttctaaagtttccaaacccatgttttcctagctgagccatccacaaaccttaaactgtgaggatgatttactcctggccaatgtccaggcccatttgccaacctccctagcacaactctaaaacttaccaaggcagtggatatgagcggccactgctgagggatccttgggacacttctcaaatccaacataatcagatttagaaaggttgggtctttctcatacccggtgttcaaaagaaacctaatgatacaagaaactctccagctctgtcctaatcaagtcacaacaatgcccatcatgcagaaaagacaaaattgcttctaacacactgcctcacaccttgcggtgagtaataaatacttgatgaatgaatatgcaagaaagtgcactaaatggcagaaagtatattccacagccaaggtcacagcaattatgtttctagaagcaggagtcacaggaaaaataacaatcacctgaattactgttctacttaagcacatcattgaaatggttttgtgtatcatggaatcctgatgcgtgagagaagtcatctatctttacaagcatttactcctgttaagtacctattatgtcattaaaacagaaactttgtcacgtatatttaaggttttttttttttttgcatttcccttatttttatgtatttgtatgttaaatcctttgttctgcttgggcctgtgaaaacttattactttataagtctctgtgtgtcatatcctccaatagatcctgccatctctgttctctgtttttattttatgcaactgctttttcagatatgttgtgaccttcgtaaatgtaggttgggaggaacaaaacattattaagattttcctatgtatgttttatatacatcatttccttttaactttcacaatagccctgtaaggtaaggatcagtagccccagtttacagatgagaaaactgagtctcagaaagtagatcacttcttgcaggctaatatgtgtcagcatcatattcagaaccaggaaaagaaggcaaactaaaaaaaaaaaaaaaatgacagttaagaaatgaggaataagagattatattaaactaacatttttagcactacctactggaacactgccatgatatccaattgccagacactcgtggggtttccatccagctctacatccgagttatgattcaggagccactgggcaggaaaatgtgaggacacagaggaagctgactgaagcaggtagacgagaagaggaagtgaggcatgccagagaggcaccgtcataaccccacagttaggttttaacctgacttggaagctatgttgtccctgacagccattgtagtaggtaacaatattgtactatcttggagacttggggaagccttttttccccttttctaatatctaaaattaatctgtattataactatgcatcttctgagcccttgcctcttgtatacctgctaattacattaatatttgagccagcatgagaatcagacagaaaacaggtatctcctatccacacttttgtgagaaatcaggcgcagaaaatcaggggccctctcataggcacctcaaacccagcatatctcaaattgaacatgtttccaacttctagctagttatccctctttttatgaccttcctaactaaagacactcatccatctagtcacccaagccagaaacctggatgtcagccatgggaagacaaagaattgtggtggttaagagcatagcttttgaagtatgtgtattctgagttcagtcaccgaggtttagatttcagctctgatactaacaatgtgacttcgagaaagttactttaccttttgaagtctcagttttttcatcaataaaatggttgtatcaatcatacctttctcatagcactattgtacgggccatatgatataatccaagtaaagagtttaataaaatagcacacacgtattaagacacaggaaaaattagctacactgatgaccatgatgattaatgatgatgcttgactttttcctcaaccatccttcaccctaaaggtcatcaaatcctgtacattctaactaaatactttcagatcttcaccttgtgtctatcactttgtcttaggccctaaataattttttgcataattattattgcatgggctcctaacctgtttttattttttttaacctcttacttaactcacctccctttgtccttcgtgttgccccagaagcataaatacaattttgttttcctctgcttaaaattctgtgatagcttgcctatcatttgtaaatcccaacctcctttttatgtcatcgcaagtcttgcatgtctgcaccctgaatacttatgttacaacatctttggcctcgtgctactcacatcctttattcccattcacctcttcatgccttttttgtgacattaattctaactgaaatgtcctgccagtttgtccaactttcacactttcccttactcactatttcaaatcccatgaagcaccttcacttcctctttcctgccatcccttggggtgagcttgttgctttctcttttatacaacttgggcttggtattgacttccattatagcacttatcacagggtgttacaattattattataatagcacttatcacagggtgttacaattattattatcatcatcaacatcatatagttagtgtagtcctactagaggccaacatcaaacacactacctagcaaaaacctaggtcgaaccaatgaagcaccgtgacttaccaagaggtaaaaggaaggcaaccaagctaattgccaggcataactcatctccagagactcaagttgataggaaaagaatactcattggaagcttgcaagttttcaacctcctgggttggagaaaggagtttctaagtcattcattctcctgtatgatttacataaattgaatcttgcttttctttgatatttattaaagatacagtctcatagatacttcagggtcatatagtatatgagtgttccattgtttccataccaattacctcaaacttaaacatttttaaatgtttaaaataataaatttcttttcttttttttctttttctttttttttttttttgagatagagatttgctctttttgcccaggttggagtgcaatggcaatggcacattattggttcactgcaacctatgcctccagggttcaagtgattctcctgtctaagcttcccaattagctaggattataggtgtgggccaccacgcctggctaattttgtaattttagtagagacagggtttcaccatgttggccaggctggtgtcgaactcctgacctcaagtgatccacccgcctcggcctcccaaagtgctgggattacaggcatgagccccctcactcggccaataaatttattttcttatagttaaataggtaaaaagtctgacacaggtatcactgggctaaaatcagcgtattacaaagactggatttcttactgcaaggtctagggagaatctgtttccttgcttttttggtgccgggagggggggagttgttgatctaataattcagtttcttgtagttgtactactgaggagagtccccagcttctagaggcctcccacattcactttgtatccttccagcctcctctttcctcttgcatctctctgaacacagtccttttaaggactgatatgattagacttgatccatctgagtaccacatctgtaaagtccctttttctatgcaaggtaatatagtcacaggttcttgggagatacttcatgattttattacaaaggcatcaagatgctagcaggtgatgatctctaccaggattgcccggaaaggaaagcaatgaaactaaaacttggggaatcttactgtgaggcaaagagaagccaaaatatggtaaagatttttaaaatatttcctttcagacaccatataacagggtactcagagaactcaacctgaatggagacactcgacttcccagtgtcagagacttttattctatgttaccaggagcctcctagcttccagaaagaccagagaccagtaatcatttggtcctttgaatgatagacagaataattttccccaaagaagatctcacagagaaggaaaacttggcagcttccaaggacccttttttttttcttttttgagacaagagtctcactctgttgcccaggctggagtgtagtggcatgatctcggctcactacaacctctccctcctgggttcaagcgattctcctgtctcagcctcccaagtagctgtgattgtaggcatgtgcccccacacatggctaatttttgtatttttagtagagatgggttttgccgtgttggtcaggctggtctcgaactcctgacctcaggtgatctgcccaccttggcctcccaaagtgctgagattacaggcatgaggcaccgcacctggcctccccacacctggcctcaatgactatacttttcctatcaacttgagtctctggagatgaattatgcctggcaattagcatggttgccttccttttacctcttggtaagtcaccatgctccattggttccactcagatttctgctaggtagtgtgcttgattttggcctctagtaggaatacactagctatgtgatgatgataatgatgcttataattgcaacatcctatgataagtgcttcttaatctgtttccagtttcccaaaagatctgctttgtgaagtcctcatgggggaatcattctgcccatcatacataggaccaaataattaccgtccagctgatccttctgtgagctaggagaatcctgatagtgtagaataaaagtctctctggttctgggaagtagagtctctcctttcaaattgagttctctgagcaccctgttgtgcagtgtctgtgaaaaggctaggaatagacttacatttctcctgtagcagttttagaattgcttgggtgagttcttcatgccctgggaaggcattttactttcatagtgtttatgaacttatttgacatttgttagtttgatcctacaaaatatgagcatctggagcaaagttggtgtatgctttattagcatatattctctgacagtacctttactttttcattctcttctccatcccagtctctggtcacagttctcattcataccatagatgctgacatgcttcattttaaagtgccagccagccctgaaatctccagctgtctcaatgccacctccttatctagcaccactcccatccgctcttctcacccaatcacctttccctcagctagagacctggactctcaattatcatttcattcaaataaattgtctcttccttgccacactcattgttccttttccttgaacttgactgtcaattagtgatcacaaactgccctgattaccacacttactactaaacacatccctcaacacctcactataaactactcttgtttcttattcaacctgtttccggggtcccaaaaggtgttctttgtcagaaccagtgttctttcatccagaagtaagtatctttcttccctttcaaatttagctactttcttcttcaaactctctattccactgatcccatgattgtttacatatgattaaaatcttcaccacatttttcactcttttgctgggcaattaagattccccaagattcactttcactgattttctttccaggcaatcccgctagagatcatcacctgactagcatcttgatgcctctgcaataaaatcataaaatatctactatcttcccaaatatccatcccattaaattaagatagtaaaatttggtatcttcccttgaagaggacattgacatattgctattgccttgtttagttcctataaatatatcattcaacaaacagcctgcactgatgtcctctgcagttttgtagaaccagaaattgagatccaaatatgaatagctaaggttagatgagttgttgagctactaagtgtagtctcagtcagcagtaggcctagcttatcccaatataagcaattttacttttggagtaaaatccaatgacaatttacattttgatctcattatgtctaggttaggtaaaatgttatactgataccctcatttggatgtaaaacaaataaggcattcttgttctaactagtgaaggcaagataaacaatagatatcttataagaggaaagtcctgttcactgaaccagataagctttagggactcagttctacaagtaagccatagatttcttctctccttgtcatgaacatctaccactcatgttacaaatcaatactaatagaatagcatggtgttcttgccccctttagactacatgaatcattgcaaacaatcagatttgcatttgtaaaagccatggtgtactgtaaaagttaacactggaaaaattaaagaattcaaaagccacatgtaaaagaaatgcttttctagattatacttgaattatcatgattcaatagcaaaaaaaaatcctaataaaagtttctgtcttgaaaattagctttcactgacatttataaatggtaatttctttacttaggcatctccctattacttgtaacaattctaaattttgctagtgttaagaccttgaattgtaagttgtcctgaagatgtgctttaaattcaatgtttttgcaatctttcaatcattgagataatttcattttattgtggaaatatacaattttacagaaagtaaacataggaaagagttttgatgttcagtttctcttttagatatcaggaaaaaaatactgcaatttcttagtaccaggcagtgaggtgctgaagccagctcattttggctttaaaaggcaaatcgtgtgcatctcttcccattgtgcattcagagatgtcactgtggttgctagaaatagaccatgtcaaggtattcacaccatagaaatgagtaaatgctccaaatcagggcttttcatcccagagacctggtattaagcattaaccagcatactactggtatggcatgttaacatacacacaacttctataacaatgtagtagcttctagctctggggagccaaatggactgattgttgttgctgttgttgggtgtgtatgttttacagttaactagggacttattcatttctgtagtaaaactgtcactattaactgtgaatccatttttagtagtaggattgtatgctactttgacaaggtaccagctacaaatattccctgtaataaatggagtatcagccacaggatcaacacactttcaaagagacctcataaactacattggattaaagctgtcccaatgactttagacaaactttaaaggaaaaaatgaaattgttttgcggaccattcagatacagctttaagagaacaccaaaacaatagcaataataaaaatgaagtttgatctggggtaaggagttagagttctttccaagaataataaaattatttgaaaatgttaagtgttaaagtaattaagttcagagacaaaatgataaacatgtacatctctggatcttttagaaaaataatacaagcaagaagccagttttattccttcaacttttcctccagtgtaccattcccacctccatcaaactgtgggttctattattttagcaaaggcagaaagctttagaggttttggggtaaatacattttaaaaacctaaaatgggatcttagatagcataaatttgttgaacttgatatagagtcagagcaattaacacattgaaagtttttcaaattagtaaaaaatttttcagactgacttgcattagtcgactatactaaatgtttttaagaaaaatttggaataagcgtagaacattttttaatgaaactttatcattgagaacatagataaaccttggcaattttttaaaccaattctcgttaaatgagtctagctagattaaacaagggcttggcaaactatgaccaataggccaaacctggcctcctagctgatttatacagcccctgagttaagaatgatttttatacatttttaaatggttgagaaaaatcaaaagaatagtatttttgtcatgtgaaagttacaggaaatccaaattttccattaataaagttttattggaacacagtttcacccattcttttacgtgtcatctatgctgccttcaggccacaaaagctgtgttgagtagttatcaaacattatatggcctatgaagcctgaaatatttgctatctgctgctttacagtgtaagtttgcttgcccatggactgaatgacacttatttttaatttggatgttttaattccttttctttaacttgaatcaaattcgagatcaacaattttcttaaggatattaaatagctacatgttaattatgaaacatgtaaacaaagaaataaatgatgcatatgcaatcaactgagttcataagagataatgtgttcagattttcctttttcctttcaatcatctccagccagaggctgttgagcagctggtgaatcttctgcttctcctcaccagaacagagaggacaaaagggcaaaactttggagctattaaaaagagggtagcaaagataatgctcaaaacagagaaaataaaaagaacttataattatattgtgttctatttttgagtgctaaaaacattaatttgtcaaatgtatgctttaaaatgtgccaagttttataaactctgttttgttactacttcattttttaaatactaacaacttccaatgattggaattaactggaccttctcagggcctgaccatagctttgggtgcatctgttacagtagagatgtgaatataccctaatatcattgccctgctgatatgcaaattcaggtaactaaccagaggaaaagaaagtaattatttccagatgaagactggccaaacgtagacagaaattgattttgaaaactcatggatttttttccatgaatccctttaattacttttcttatacagtattactaaatatggttttgaataactctatctccatctctgttctttttagtttttcataagaatgggagcagagaaaaagggaatttaacttccaatttttaataggcaagatttacttaagattatctattcaaaaatcaaatggctttgagttcttcagagtttcaggggaagacggtcatgcaaagtacaaagatccagagagaaacctattaacactgggatggggcaaaatttattttcaccagtagagtaatcctagaatgacagtaaaacaattaaggcttaattatcatttgttcaacattttaccctgatagaacctctggtaggggagcatgtgttatactgacatggcgggaaagaaaactagcaattatgaaatgacgttttcaaggtcacaaaagtgataactaatatagccatgtttaaggccaggtcctctgactggaaactcgtgtcttttggaactgctgtttaagaaaacatcatagagttcaagaaaagcacctaagaatactcttaagacttttttgatcatctaatttaaataatctttacttaatgttatttggcctataaaaagctagaatatagatttattttttctcaccttccaaaaaaatccctttactagtgtttgtcatggaattgagattaataatgcattaggagttcacatatatatgcactccttaatatgtgcatgtgcgtgtaatcctgtaactgcaggaaggagatgaggagtacaattaatacatagacaagtttctgaaaccagtaaataaaacaatagaaatataaatagaatatttgaaaaactagtattttttttgggggggtgtgtgtgtgtgtgtttaaaaacagtggcttggcatttctctatggcatattagatttggataatataaaattacacttaaatctgtttacaatctcattttggagtttattccatttgttagctgccactaaagagtatttcttattttgcttattcagggtatgcatattctgtatgtaagacttcggtatgtatgatccttatttctaagattgcatacaaaatgataaaggattatattttgcaaaactgaagtataaaatagtaatatctctctttgtggtactcaagacatcctgatttgataatttcattttggaaactttattgggaaatgatctgaatttacacagaacacttaatttctttttcgagaacaggccttaaaatgctgttgaattttattgatttgctctgagaatcactgcactgcccttcaagaaatctgagctgaattgaaaggacgtactgcagttgctgtgtcagagtcagagccatttgtctcacaacattacactgtatatattgagacttcagacacattttgcttgtctaaaatacagcttttatatttaagccattttaatggcaagttagtattaaaactgactattggatcttctgatgtggattttattattagtactttgcttggcatccaaaatttggttccctacacagatagcccttgacggaatgttatttgattatccaaatcagtactcacactttttcaagaaaccttgaagaaaatttagtttcccgcactctgccacatcccatactcctaacttcttttagcttgaatactttttctttactttttccagacctcatagtttttccactcctcctggataggatccattaaaaggaggtgagttcacttagaggtcacagcttctgtctgttgtcttgacctttccataggaatacacacatgactggcccatgtcttacttcctcaactggtgaggatttcagaattgacatagaaatagcttatgtttgaaacagaaaatatgatttttaagagagtttatgtaaggattttaaaaatgtgatatcccagagttacaggtcaacctgatttcatatagcaacatttcatgatagttattcttacgtagagtttctctccacaatatggaataatttaaggttacatttatcattacacatgacctttgagtaacctgtggctactcaaaccagtttttaagttggcaagcctctggcaactatatgctaatatttgattgtggttatttcaacagactttatagccttattcttttttattacttagagagaatcatagagtaggcatggaatagtgaattttggtttatttctgggccaagagagaacatgattataattagatgagactataactattctgtgagcccacagcattaagtctagagatcataccaggagcattcatttagcaaaaatgcattttgtgaactactgtgtgccaggcactgttttgatgctagaaacagcatcaaagcgaggcttagtacttgtattaaagaggtctcatggggtgaaacagataaacacaataaaagtaccatgtgtttactgctataatcaaaatgctataggaatttgagggcttaccacccaacttagctttggtgtgtcacagcattctatgcagatgaatagcactgtaaagttctggaaaagtttagcatgaggaagggacttgtgaagtaaacagcagacaggtcagaaaaggcattgagtgttctgttaggaattcatactggggaaaaagggatagcattgatgggctttttggagggtaatggcctcattagatcagatcggcagtaatccaggaggaagactggtgattggatctaaggaaaagggattagcatggggaggagaggatgatcaggagagagaacagaccagactcagctactgactgaatgaagggattgatggaagtggagtactcagggtcaagaatggtgtggacagatgacaagccttttacctttagtcatatatgtgttatgttgaagagtttttgcatggtaaagataatttaatctttgtactttgattatctgaaatatatttatgtaaaacataaacatgtttctctcaattatttaacaagtaatgctctatactactgcattttcctatttgttactagaggtgacagatggaagctgcagattgggaagaagtgattaaacagtgagaataatctattggtgaggccaggcctacatatcaaggtagctgtgctcaaggtacagaatatagaagagagggtaggaaggtatacctgcgggcaaggagctatggagggcctcctgaaacaatgaagcgattgctgaaagctgggacagttagtcttctattttaaagtctcaaatgagagttggtgtcagtctcagccaaattccttgaaatactgtcatatatttcagggagctgtaaggagatcttttattacatcctttcaaatcctgatgtgccctctagaagttggctttaaaatacttgtagtcttttttccccagcacagactcagaaggctcttcttttttttttccatttccaagcagctacaaagtttactgttgaagtagaggtttacttttctaagaaatttttgaaggacttttatattacagtacaatttaaacttttaagaactttgtaatagattcaacttacacgactgtgggctgtcaatttattttattatttgaaaagtcaaactatcaatggcttttggtttgcatataaattcttttgggttccttttgtttcattattgcatgggctttttaaaataaaagaggtatgatgtaaatatctccctttctcattttttaatctctccttttatctctcctttctcctttccaatttcagtttagcaaaaaattactcttgggctagttacatttaaggcattgtgctagctctggaaagacaaacaacataggaagatatctctaggatcaaggggttagaatctctttgtcctggcttctctcttcttaactttcacctctttctattttgcttaatttttcttccttttttttctcctaaatggagtatacttttgcttatatgtgaagataaagggttttttttttttcatttagtttcaagtgcataaccacaaatatgtgataaataggcctattgaatgttcccatttcggtatggcagctggaggaggatatggaataatatcttgagagaaatatccatcctaatgtcttcagaatttcaggggaagagacactcatattcttttctgggtcacttctgtttctaagagggaatgccttagaccagctctgaccatacaaagatatgtttgcatttatgattctgcttgctggtcaacaaagcggtggtgataagatttgacagaaaatgccaacagatacagaacaagaacaagttattttcaggcaggtaaaggaaaagcttacaatagcacacgctgattatacaagactgatgatattgcagtgttccaagggagagggccaacctgccctggctatccaggcccataaagagccttatattgctgcttctgtcctcttcttgaggtgagaatcttatcaaaattttggaaaagctcctttttctagtttcatgggttttaaacctccgtggctcctcctgacaaaattctggctacccgcctgatgcaaagaactggtaacaatttcactatttccctgtctgtttgcctgagttctctttcccatgtggactatcgccatagcagggtagggccttggacctgccagaggtctagtcccacagattccaacttctgttagtttttacagatgaatggcactgcaaactcttgttatttgtttattcttgttttacacactttaaatttgcaacttcagctgaattgttaaaaagactctagagtgaggagagccaaagggtccatattagcttccaaccccaatttgtactgtccacttaaagcaatacgttaagaaagatttcaaggcttcatgctggttcactgagaaagagctctggtccatcatgtattccacagacaagggaagggaataatggcatgcattcctgacatttccttttcctggtctagcaccatcctaaatctttaagagagaagagagacctctcatgtggccctcccttgagcatacactggcctgttggatctggctgtgagttatattcagagacctgccagggacaatggatgtgataagaaatacatcacttggggcatttcaagcaagcacagaaatgtttggtaaaaataacagaagacatggatccagcagcactttccctagcaggtttgcctctataactgcaaaagaagtctcaggacatagcctttccttgaagcaaaatgtctgtcactgaatggtaggatttgtggggttctgacaactcttatctaacagaaataaaaatctatttcatcagcttgtaggtagtccctgaaatttaatcacgggggatgtattcctgtagtatactaggagattgaggtctactgcataaacagaatgtagaattaaagaactcttggaccaagaacagacacaagggcgatggattttaatactattgttttctagttgaggaaacaaaggcaacttaaccaataaattctctttaatttcaaggggaaagagaaccactatttattcactgtagttactgtagattgttttatagattaggaaactgtagagagtttaagtattgtgtttaacatcatgcagctaagttagtgccacagtcagaatttgaatccaactttatctggggcctaagcctgtgtgccctttgcactggatcgtattgctcttttttattagcattttttccatcctttctcctccctgtcccactgacttgctgtatgtatatcttactctactgaaatctgatctcttctactttggatcttagtaagattctgataaactaattgataatttatattaatagttgataaaactcaatgccttatggcctttattgtgtacctactttgggatagtctctaaggatataaaagagatatcacccctgccctgaaaaattccagagtagcactgtgctgccgtctatctaatcaacccatcacatttttgtaaacaaatttgtgataaaattattactatatttttcgcctttcccacgatggaggcaaaacagtgggtgattctttgggctatttcaaatctactttttctataacactatatttctttcccttctgtgtccttttttaaattaaatattaaaaatgttagccaggcatagtaggtgcacccgtaattccagctactcaagaggctgacacaggaggatcacttgagcctgagttccaggctgcagtgtgctatgatcgtgcctatgattagctactgcactccagcatggctaacatagtgagacctcatctttaaacaaacaaacaaaaacaaaaaaaaaaaaaaaaaaagaaagggaagtccacgttactgaggctctctttaattaataaatgcttgaaaaggtctttgtaagcctcaaatacttacaaaataaatggtaaagtatcttcttctatgggtttgggcattttcctgcaagaaacagttgaagatcttcccaatctcccaggcctggtagtcattttaaaacttaaagaagtataattggtgacatgaaatatccacatcttattgttgctggtcaagcttagaaggcaggaaagagtcaaaactcaggaagcctaaagctctgcttcgttataaagaaacgccaccaccagcacttctcacatttcttttggaaagaatatttaagtgtaaggatattttcctcagcaactccttgttattcatatcaaaatgttatgtcaagttgatttcctcttaccgtgaggcatcacttaaaatacctacctatagctatgtccagttagtggagaatacttcatttgttgtatttccaagagtccaggattctacagagaattttttcagagttaagaacaagcactctacttccctatttccctacatttctgtagtagagctgagtcctcttctctcttcttatcacatgtagagagttgttagggactataaagaaatgaggatccaggagaaggcgtatcttagatggctttatctctctctctcttttttttttttttttttttgagttggagtgttgctctgtcgcccagtctgtagtgcaatgacatgatctcagctcactgaaacctctgcctcccaggttcaagcgattctcctgcctcagcctcctgagtagctgggattacaggcatgcttcaccacccccggctaatttttgtattcttagtagagacggggtttcaccatgttggccaggctggtctcgaactcctgacctcaggtgatccacccgcctcagactcccaaagtgctgggattacaggtgtgagccaccacccccggctaatttttgtattcttagtagagacggggtttcaccatgttggccaggctggtctcgaactcctgacctcaggtgatccacatgcctcggcctcccaaagtgctggcattacaggcgtgagccaccacgcccagcagattgctttatctcttttacctttcaatctactgtagagctcaaagagaaaacaggacaacttttataaaaatattgattactgcatgttagttaaaactctaaaaataaggcacaaataagggaccatttataccaaataaactggaaaaaatatgtatttaaatggtaatacctaggctagtttgattgcagtaaaaacatcacacgtatctagtggttcttagcccagaatggtgcattagaaccacctggggagtttttgcaacttaccaataccaaccttccacctctgcctcaaattcttagtgatggagtaaaacaaaggatgctttttgaaagtaatttttataatatctttaaatagccacacaaaaatgtttgcattttcaaacctcacaatctcacttgtggtaagatatctttataaaactggaaattgggaaaaagctgcatgagagaagctcagagttgtttattatatttaaaattttaaacagccaaaatcttgaatgtgcaatatagtaatttctatccccatcaccccacactcactaatataacagcacctagttttaaagtctgtctagtgcagagctgactatgaaatcaggcatggtacagcctacgtgtagcaacatctataactctagtggggctggcaaactcaggggcaattaatactgatgtaattgtggaaattacattaaaaaatagacactgcttataaacaactagaaggaaatagagaaaaataaaaataatttggcttgttgagatgatggcattgcgttatttttctttcattttgaattctgttaacataattttgatgtctataaaaacatttttaatggggactattggcaggctaaagatgtttttagctttattaatttatctaaagattgaaatgtaataacatcaactggccagactcaagtagcttaaacccagtgtcttaagaatcattagtctttccctatcacaaagtatccctctctaccagtgaggtggaaaaatggatcatttttccattactggcaaacatttgtattagaacattgtctcccaagattaacattattcattttaaggaaataactagtatgaattgtattctattagctagtcactaagtcaggaagtccttgcagaacgatgcaaggaaagtaagatttggtttcgggggaggttcagttaagataaaaaaaaagcccagacaatggcatttggcacctagaagagaaaagcaacctgaacttcaatttaaccctgggcttagccatcttttttatgataaattttccccggggacctacactgcagatcattctttatcataggactttcccaaacagaagcatctcatcctttggggctttccctgaaaaaagtttaattcaaatagggatttgtgtgtatcctatgccaggcacagtcacagtccctggtgtcctagaccttacaatttgaaatgaagactcacttgttcaatttccactattgagcaatcagcttgcctggagaagctaatggttgctggtagattatattattttctcacctttcagtggttacatttaagtatggacttctcaagggaagcttcattgcaaccaccctccccacagcatttatttatttatttatttattcatttacttatgtattttttgagatggagtcttgctcttgttgcccaggctggagtgcaatggcatgatctcggctaccgcaacctccacctcccaggttcaagtaattctcctgcctcagcctcctgagtagctgggaatacgggcatgtgccaccacgcccagctaattttgtattttcagtagagacggggtttctccacgttggtcaggctggtctcaaactcctgaccttaggtgttccaccctacttggcctcccaaagtgctggcattacaggcgtgagccatcacacccagcctccacaacatttcttatagtgaaggcatgttaggtcaatgggggagagatttgctaacccaagagtctctaatattaaaccctaaactctcctcagactttattccaggcacttgacactactgggttgttcatgctcagtttctttcttctccttcctgatcgttggtagaagtttcagaggatgcagtgcttctcaatactaatgtgcacacaaatcacctgggatcctgctaaaaatgcagattctgcttcatcagaactgggatggggcttcagattctgcaattataacaagccttttgatgctgctgcttgtgttgtttatctctgtagtatctgttgaatagcttgggaagtaagcttaaccttgaaggacaaggacaggaaaaaaatgaaacttttcctacaacagactggatatcagtgttcattgcccattccagtaatacatatgatcattctaagcctgaaatttgaagttttgctaccattttattttgctttacagtgattctctctttcttcttttctaatttcacacaggataaaataggaataattaagtaatccctttatatagcttgtattttctagtatcctttgatttagatctatacaaggtatgcagatttttcaactatattctactaaagttcttacgattctaaaatcactaaattttaataagtaatatataatgctcacagcaaatgtgtgcttccttgaggaaaagagaaacaaaattattttggtaataatgtagcataaaaatctccatttggagtgagagacttgattttaagattgagctgttttgatctcattgtaactgtggccattttcttatcttctccaagtgttcttcgtcatccataaaatgggtatgataactatatcagagggtatcggaaagtaaaaaggaaaacaaattatttgaaatgctttgggaactgaagacactttaaatagctgctaattattaattattcattacattttcgtgtaccttgcctgaaatcacaatgttttattgcatttcacacacaaatatttatgaatattactaaatgtaggtataagagactaaatttgtgaaaaatctcctaaactcactgtacttgcagaaagaaaacaaactgttataatatccaaagagaatttattaagaaagcaatcccccaaacaataaaaatgtactaatttttgaaaaataattgtttaagctgttacaagcgccagtgctttttatagctaatattcttttctctagctttgctaaatttagtagtttatctcaattattaagtgacagtaatatgtaagtatctaagaggtgaaataaatctacgttaaccttgtatagaacggtttctaaaacaatgatcaaactttatgagaatgcaaaaatactccttaaatattgtaatcatccagaaacactgacacacatgtctaatgagtcaaaaatattaatttcctttttctctccttcaatatatgtaaatgttagcaagcctgatgaaaggttgaatcagagattagctcaaaactgtcaaggagaatatcaaaacgacaccttctggggcatgtaggcaaaccaaatgcttagtggagacaggctaatttatcatagtgcagttgcgatggcaacaatagttcttggtgccatgtgacccaaagcagtttctgttgactggctctaactgactgtcagttcagcaaaggttccactgtttgcagtgaaaaggaagagagagcattgatacttgttgaaaaggcataataataatagtgtatctcaaaccatgaaagcatccctttgtttcctcgaagtttatttttatgctggctaaaaggatccctctaatttttgttacacaaagaccccttatttattcacagattaaatatgtgtccctctgtttactaagaattctatctatgccgatagagttgcaaacaacaagaatttaaatctttcaggataataataatgttgtatttacaatgtgctaaattttttacagaactttttctagtatatttcataagatcacaagaaatctggttgtatgaaatataagccagtaactaaattctcctgcatataattttttcaaatgcaaaacatagagcctgacagtgttcccctctgatccgaagagagcatgagatctttaagaaaggtagacaataagtattcactttattcttcttgtctccttttcactgttattttcattgatgagcaagtaacaagggccatggagatagtcacactctttgattcaacaattccactcccgggattttatcttggggaaacctcactaaagaaatagttctatgacatagaggagaaagaatgagatttggagtcagatatgaatttcaaatcctggttctgccactcgctcactgactgcccttggggaagtatttttcctctatgagcttcgagttttctcatttgtaaaacagacttcagagtatccaccctgaacagtgttcaggggccttataaatcatatgtgctaagtgtctggtatatgccccatgtatctaccagagctctcagtatgtggcgtttctcaatgcagtatcatctctaaaaacattggaaaaacaatccgcattcctagaattagaaaaatgagttagtaaactgtataaatgaggtgtatcaacagaattaagcatgatctaataatcatttaaaattttgatgaaaaaacgtgactatgggagaaattttatgatataataaaaataatactattacaaaaagcacaagtaaaattatggactttataatattctatcactgtataaaatacacatgtctgaagattgtaactggctagacgaaaatactatagaaagtatgattacaagtgattactgtgttaatattgatccctcctttaaggtacttcactgtcctttccattaaaaatataaggaaagaaaacagtatagaggttggagtggtgagaggaatgccttcaatggctcacaccaccaacaacagcgactagaatgcatttaaaatccctctttctcttccacttaagaatacccattcaccccaagtccatgggaggcagaggcaaagttaactaaatatggctctgcaaacacttttgtgcatgttcttggtattccctgaccagtactgcctcaaggaaaaaacagaaaaacatttataagaaagaatccatgtgtggaaggattctaaattacacaccaaagaaagagtaagtggaagaaaagtgggaggttgagagcagtttgcaagattgattaaaaggtgtggttcgcctttggaatgcatttgtgttcaaatttgagatttagatgtttgataccctggcatgtgggaatagcagctataagtcttttccataggattagaagttcattataacctggaactaatggccacaggaactaagagccaaaggattttctagctgagtctttttaagtggcagttgagcagttcactgagggccatgttcagtgctgacagcccaggaacgagtgaagaaggcagataacaaggcattgacaggggcagctgggtaagtctctcagtgaatgctgacatgctttcctctctcaacatcccagctaaactggctagtgtccaggtactattatctactctggcaaggacaggccacatttcacttcatgcaaaaagtatgtcgagcagaagaactcaggaacagccaaagaaaagtgcttgattctttattacactcttcttacctcaactgctctgctcctaactataaggtgttcttaatttaccagtctctgttaaagagtattgctgttttaaagcagaaaaacatacactaaaaaagatagaaaatatagactgaaaatccatcttgttggtcttcatggaaattctgttagtcattattagggttccctacccaagtcaaaatcacactgcaccgcaggaaacttgtatagcatactcaaaacaaggaaatgacatctaaactccagtctagtgtgctcgcaactggcatcttcattagcaagtcaaagtgatctcatgaaattgaaatttggttgctctgtgcttccttacaatacacagttgatatatttgggctgtggttctgcctccctaggtactccaacagccatctctctttgaggtctcaccattctctagcatgtggctgagttcccattgttgttttagtgacagaagtatcccctcccccacatccttaaagaaatcattattgaatctgaaggaagcctctgccccactacaacctctcacattcactttgcctcttcttcaaagggtttaggcttttgtttcacaaaagccagcaagacttacaggctctgcctggtttgtggtcagccttatacttccctggagaaaatgaagcatgtgaagcatggaggctacttgaatggccaaaaggaaaaggagaaaatagaggagaaacacacacacacacatatataatgagccttaatgaatatatgtatgtgtgtatatatacacatacatctatacatacacacacacacacacacacatatgtatatatttgatgaagacttacatcgtcaagctctgggaccaagtacaaggtagagaattcgtagagtatgtgtgtggtggcaggggatggggttactatgtaaaagtgaaagccccaaggcacagggacactgaaacaggaagagactaaaaccaacatgaatcaataaagacaaaatcaccaggttgagcggagtaacgatttgagtttcctgatataggctcttcacactaacactaggtcagctctaaacatcactgattgctaaatcaataactgttacaagatttttgttttactttgttttaagttaaaagagtgtcatactttgtgtggtggtgttccttagaagatgtgcctgtacttgaatggagcacaagattttattttcaacggcgaataatccttgcggtttttaaaacaattgctgcaattacaaatagcattaattatgacaatgttttctttttaatcatttacaccttcagttagacttgggctcttaagattagctggttggagcaacatattaacaggaccaagatcacaggcgtggatatcttggggccagctacgctgactctatttcatgattatggattgtacttctaacctcagcctgccagtttttaaatgcattcttctggtctcaaggggtattttgtaagaacacatgaacaaatcgatgaaaatcgatttcctattggaaaaaactcagattttatgacctacatctcatgagtaaccagcccctttgcatatgagaaacaattaattaattcattttcaaatggagctgtctacaaggatgtcagggcaaaacaaatttacattaaaaacattgtttactcttgacagatcagtagactgaagtctatatctgcaggaagaaaatgtattgctcttgaataatatccaattaagcttttcagcattttccaagagcattcaagaaggaaaacatatcccttatcaaggattctttgccttataactaaccaggtaacttctagaatcattctcactattgctgatacaatctattcaaaataatatcgtgaagaacgccgattttatctgtaatctatacggatactgttgtgagttaaagtaagtttgctagaaatagtcgtgggaacccacagttttagaggctcacattctataatcgttcttgtcatgggctagtcccttattcagacattgaatagcctttttctttccagaaaaccatggtacttatatttttgtcttcttttattttcaaggaccatgtagcttttttttcatatttatgctcatatgcaaagcctatactagtctttcttattattttctaatttttatttttttagattatagtagcattttaggctgaatcaggattgtgtgagaaaagtagcagggtttagatcgtgaactttaatgtggcgctccaaacaggccttgcctttactgcagtgggttaacatgagcatgttttactcctctgagcctcagtttttacatttgtgaaatataggtactgatcccctatatcttaggtttcttgtgagaatgagattagataagcatgttatataaactagcacagtgttagcatgtagcacatagtaaaagttagtatgattatgatatcttacgatgatcatcaaataatgaggagtttaagttcagttgcctttcagctaccctactattgctgagtttaatgagtgacctctaatggagtacagagcccaaaacacaattggtaaaacattatctatggcatactacaaatattttgctcattcattcactcattcatttattgatcaccctaagtggaaggactggaaacaagaatataagctctagcttaaggaaatagataggagaggcacattattgcaatatagcctaattataatattttatatcaaataatttagatacaggtaaaagttctttgtaaatgttgtcataataataattaggactacatgaaagccattagatatggtgcccttccagatagcaatttcagtagaatgactcttctaatgctatttttatttattataatacctaaagagatacatattccagtgaggcttatacaaacaacatgaaaatttcagatgaggccacctttttataaaagtgcttaaatttgatcagactggaatataggatgcgtgttctagtttatccataaagataccctaatctgaagttaaggattccttgagtcttgctgaatactgagagcaaatctaaaatgccttaattagtaaaatttttaaaaagtaagaacaaattgaaattttctggatggtttcctgtgattggaccaaactgttgaaggaagcagaaagtagaaaagcagacttgttttgtgtaaatgtgggtgttttgttttgttttccaacttcagactacaattgctgaataagctagtttccagcctactattcaatcaagtgagaataacatagaaagggaagaaggcacacattgcttaaaaactacttctagcaagaaaatctgaatcagtgcattccaaagtcaagttgataaactatataatggaaattagtgacaaatttagattaaagatctaatttgcagaatctgattttgcttcactgtatgagaagggatttcatggattttataataaaggaagattacaaagagacaataatctcttggattactttatactttctctggattgatactttatcacgggtattggaatcagacacataagaaactaaattgactataattttagacaaaccttgtaagtcttagttacttcttttgtaaaaatgggaacattaatatgtataaaatatttgatagtgattggcataacaccaggaacataatcaatattcattacatatgagtttaattttgcctaaatttttaatacagatactgatacttttcttaagaaaatagcaaaaccagaacttagattgaatacaaaagtagattttactaaaacaagagaaaagtaaacatatccttctttgcctctatatttttctaagccctgacctagaatagctagtccttagtcccctagtgatagttatatcaattactccctagtcaggaagatgtctaagccaaaggtaaggcagaaattctggagaaattagccatcagcagacacgatgtctaactgcctccacctgattgagaattctcatatccatgacacgatgaaatattatcagctgaacttaggaagggcgctctgaaattcttacaaagcaacattgtgtgtgtgtgtgtgtgtgtgtgtgtgttggcctttatctggatttattgttgatgaatggcttgattttaaatcaacaggctatggttcaaaccatttcacttcctttcagtttgtccatttgtaagttaaacttttaaattcagtcccttttctgtaaaactgcagtaagaacacgtacctctaaggctgttttatgaattaaataagataatgtatgtaagatggttatcatattggcacatattaagtattcagtcaattatagtacttgttcttattatttattaatagaagtaatgcattcgttacttattaatatcttccaaagcttgaactttgtagttctttaaacgtatttatgtgaaatcttaactgtgcttacttaatgcttcattaagtgttgcaacatgaaatgacctcactattattaagtatcattacagttctctgtagcttgctacacatctacaaaaggtatcaaacaccggaattttaaaatgcatagaatgggccgggcgcggtggctcacacctgtaatcccagcactttggggggccgaggcaggcagatcacgaggtcaggagtttgagaccaacctgaccaacatagtgaaactctatctactaaaaatacaaagattagcgccatgcggcagcgtgtgcctgtagtcccagctactcgggaggctgaggcaggagaatcacttgaacctgggaggtggaggttgcagtgagctgaaaccacaccattgcactccagcctgggtgacagtgagactccatctcaaaaaaaaaaaaaaaaaaaagaaatacatatgtgtgtgtgtgtgtgtgtgtgtgtgtgtgtgtgtgtgtgtgtatatatatatattgcatagaatggtaacgtcttctagtccatttattgcctttattgagtgtatcagtttcccattgctgttgtaacaaattaccacatatttagtgttataaaacaacataaatttattattttatagtcctaaaatcagtgtgtctacaggattgcattacatttggtggctctagtagagaatctattttcttgccttttctatcttctaggggctacctgcattccttggctagttcctctgctggttttgaataaactagcagtccagcatgttcagatttcaatttctgtctctgattttgcttcagtcaccacatcttttatcctgattctcactctcctacctctctccttttcttacaaggactcctgtgattatattgagtccacttggataatccaggataatctctatatctcaagatccttaacttaatcatatctgcaaaatctgacaaatgtatttgtaacgtaacatattcaagattctggagattaagactcagacatctttgggaggccattttgtatctgctacagagaatatgaaggaaaaagctgtttatccccttgaggacataaaggacatattaaggaaaagattcaagtttactgttgttcatattttactttacaagcatatttcaaagaggacagagcagaaaaaaattttcttgggtttttaccatatgacagaatccatgtgagataatttacacaatttcattaaattgtctaagccacactcactttattaggaaggttccattagccacatttcacagaagaggaaacaggactcctagaaaaatttgtccaaaatcatccagctaatggtagagttaagaatttgaaataagcctggccaattccaaaatccacactcttaactaggtcatgctctgtctataactcattgtatcttagctagaacagtttaaaagaattcctaaaatatggataaaatatttaaggatttctatattatattaaatggctaattgtacattttactcatgtttttatcttctgttgaactaaaaatgaaaaacatgcaaacaaaaaatgttctagtagatatatagctattaaatatgcacagttttgctatagagaagactcatttttctttcttaataaataatagacatttttctaaaagttttataaatcttaacatatatgcaatcaatatttaaaatattaacatggatactgaagagctttgtacttaatttaatcaaaggagaatgctgggatgctattttttaaaaaaatattttagtcataggactttagattgcaaactgcccagagcagggttgagagagacattgagaaaaaaggagcaaacctagtatcttgagaaactgaaaattctaatgttgatcttcaggctgaaagggcagactagatacagatactctgaggccacttatttgagatagaaataaaaaaggcttggattatctcttatggttatcaagtgttctagcctactactagactagattactgcatatgaagtaccaaataagtggccctttggattgaatgattcattgactcctaaagcaggtgtgttagaaagaaagcacaaatgtaaacgttatattgccattgactgtgctcataaaataatgaaaactatgataatataatttgttttcttcagatttgggccatatcttgtatcacatcatataagaaaaatagaagacacagtctggcacaaagtttactcaaatgtcacaggtgcagattgttcttggttgaagggacagatgctaccataacacctaccaacctgctagttcggctattttcatcttcagccaccttcaagcatgtgagaatgcatatgagtcatcagacttgctgttaacttcctctgaagctcaaagtttaagagtcagtagctcataacactctatttaaggttcacaacccctggttcaacctctaggttttaaacattggagccacctgctgaaggagaaaagattggtgaataatagaagacttaagtgctccaggtctttcaacctgtcaatcagaacttttcagttcttagcttgtttaggtagagagagatagaaacagagagagagagagaaagggagagagaatgtttgaaaatcactgttctagaaccttgtagctggctgataaatgtatacatatgtttaaaatgagaagcttatagtttcaaattttgaatcataaattcaaggaacacaatataaacaacgaattggaattcagcatatgtgtttcaatttcaagatcttttgttgacttacttatccaacttactttttaagatgcctttatgttttggggatttaaatgagttaaacctcaaaaatcctccaaagcaatttggaatttacaggaagttcatagcaatagatttcactcgaatttggtccttaatatatatatgtaatatatattacatattatatatacaatatatatgtagtatatataatatatatactatgcatgtataatatatggtatatatatgtagtatatataatatatagcattattatacatttaatatatattatatatttctactatatattatatatagtggaaaataattcaattgattttagtaatctattgtttcatttgtagtaatttattttttctgtgttcaagttcagttcatacaaggaatgcatttacacgtaaaaaaatggttttctttcctttctctaaaggcttcatttatactgttttaattgtgatcaaatctcatttattttaccctaggaaaatattatttctcagcaactcaaatttaattaaatttattaatttaactttttatttcagttaagagattatcaagatatttttccaacaagattattttaccctcattgaaggaaacagttaacatgtgtatgagttctttgacttctcccaagtcgtacagctaatgagtgttaaaacttgaaatgagctgaaccctcctagcaacgagtatgtattctcatcaggatgttccttcttctacgtataaaacctttgaaaatacggttatcagaaattgacatcatgaagaattaagtggtgttgatcattgctaattgtagtagttggggctatttgaatcactggctgactgaaacagacccttagggcatgcttattctaacttgccactcattttctaagcagaaggtttttctttgtgccactctgaatacattataccaacagctacagcagagcccaattcagggccttagcaacccagggtggtgctacataattcctaagctttacctaatgtcttttggtggtggtggtgtttcttagttatttgctactttaatcagtttctaaataatgttttaaggaaacagcctcattgatccaggctaatacaactgcacatattaacgaataatatagaaatctatatttttttatgacttggaattttaaaatttgtataaagaactaaatatttatgtttttatgtgtttgatcaatttttattaataaatgtttcttgaactttaaatagaaagaataaggctaatataagttatttgccaagcactgtggaagaaaaagacacaaatatagtttagacagtataccggtagctgcatgtatactacaaaaatgtgaagagaattatatataatgttaactttgctaagaaatatagctcaaatttttaaaaagctgtttctcatcatgcatctgaacatatttgttcacattctgtttttcctaggaaataaaaacattaaatattatgtttcataaaactattatactttcataaaattatttaaaatttcatcccaaatgagttttgggtacattttttcaagctggttatttatattaattttacacacttcaagaactgcagatttatcttctcagaatggaggagatggaagatttttggtaaggattattgataaaaagaagcttaagctctttattagaaacagttaactactttggcttctattctaatgccatgtgtcgtctctggaaagcaatttccccaactgatagaataatattttaatggagtagtgtttgttaggtgaactgacatagcaggtagactgcttggggttaaattccacgagcaattccattaaactctttattcttcagtttcttcacctgaaaatgggaagagaaattgagtccacttcataagcctgttctgagatttgaataagttaatgcatgaaaagcttttgtaataatgactggcacatacatactatataattattatcatcatcgtcattattgtaacttcatatcacatttcatcaacattttttcagcaatcttacctacaaagccaaaaggtaagatacctaatctaatagtttcgaactttatttgactatatttcatatttttaagtctatgagtcttaaaagtgaagaggaaataggaagctaagaggtggaaaaaagtcagtttactaccatggttgctagggtctgtgggaaaggcagcagagataggagcctgagtagagggtctgttttgtggtaattgttttcttcgtaaacttctggaacttcaaaaggactttccaaaagtttcagaatcagcatttctaaaggaattgagatctgcatcttgaatggtcatacataccccaccctaaaatgaattggccagaatgaattgcctgccacagagagctattacactgtattccttttcttcttccctctttagaagggcacttcataaagaatggtgtacatctctctcttcctatagtttactgatcctgtgatttaaaaattgctggtgtgggttaaacatcttccaagacaaagaaattttgagaaaatattcttagagttacctgaatgatgtatgacataatctccctctcacatctcattaaattttcagtataaatctgataaataaattgaaacaaaaaatccttagatcattaagtaaagaaaatatttaaaatattggtgattgtatttagaaaaagaatggctgagtaaaaactccttttacaagtcagttaattttcatttctttcttttcaacaaaattgaaggtgatgataattgagttgtcagctgagagatcattaacagtaatttttatcatagatatctacatgatttttggcatataacttggaaaaagttcaaataattgaatggcattttttagaataaaacttcttccattctcatttactttatgtgaattttctcaaaactgacatctataaaaataaaactaagcataaaatctatgtttaatattaccttatagcaatacaaaaaattcagccatgactacaaaaactgattggagaaacagagatcatccatctcattaaggactgaattcccaatacatttaaaaacatttgtttagtaatcatcaaatgtatttatttatttggatcaagtgcatatcaataataattttacaaaaacctgaaagagatatattaacaattttgccatcacaggaatttttttaaatttaaatttctatttatatacatattttcattgcacaaaattttaagacctgataaaggtctctcaaacgtgaaaaatgtatttcattaaaatacagtattatggagaaggtgaaataaaagtccaaagacagaaagaaacaatgcaaaatcttttaactgtgcagggctttttgatgcattctattttgtaatgtatgatagtaggtcttaaattgatgtggccttcagagtcaattaggtatgcctgtagtccagcactttcagaggccaaagtatgagaatcccttgagcccaggatgtcaaggctgcagtgagccatagtcaccccactgcaattcagcctaggcaacagagtataaccctgtctcaaaaaaaaaaataaaaataaaaataaaaattcaattagatacaaataaaagagtcaaaacaatttttataacatgccaatatttactgtatgttgggaattatatatttttaaatgttaaacttatgagaagccatttaagtgacatagttcttaaaatattcttttagaaggtatatgggtaaaaatatatataaaccactaacttgaaccctttcaaagatcatctggttctaagatggcatgattattttgaaaatgaaatatttacttggtatatttactaacattttacttaaattttaatctagaattccttagaaatatttacagtattacctttaaaaaccaattttgagttttttggttttgcctatggatattttctttggcatcttgatattctttctaaaagttaataaaagaaataataacacagaaacattgaaacacaaaatggatcaaacctatttttttcttttggtgggggaagaagatgagaagataaaatgcaggaatattaattaaaacaccacttagtgtactagaaattcacatttgtagatgttagtaatgttatccatttttaagtacttaattaaaaagtgacattttagaaagctgtacctggataatgaaaataagccactgaggatcttttggggatgttggtattttgattcaagttttggactaataacagtttgaggaaaaaaaatagttcatttaaagaattcagagagtaggaaccttctgacaaatgagctcaatccatgggagaaataagagaagaatataccactgcagctgctgtttttatttcaccaattcagaataattagaatgtcatctacctggacccagtatagagtagtaacaattactattgcccagatgttttctttacctgcctccctcacagaaccattgtgccactttctgctaacctgggagctggaagaatacaatccaattgctgggtgtggaaccaggacagaaaggaagagcctgctcccagagcaaaggccagggagcctgtctgcagagtaggggaagataagattggatatcttttcccaaaaagtggatctgttgacaaacatatatgtaagtgtattctaagaagattaattatttaaaagtagaccagagataaaaattataaatatatatattcatagcttaaagaataataatgaatcagcacccagattaagaaatagaacattacagtacctttaaaaagttgattattttaaaaataaaatctatgtcattgttctgatttctctcactccaattagaaagcaaagattttcaaaaagcatacatgccattcaaaacttctttagctgtcattcattcttatttttagtgctgtcattttcattagaatcttggtatactaaaaattctaagatcttactataatctaattctatttttaaaaaaattcagtgactaaaaaatgaaatacatttagattttcaggtctaaagattttttttaaaatacttttttattaactttaaatagtatttttttttctgttttcatgttatctaaggacaaagataactgtatcaaaaaagactaccactcttaacaatttaaaataactcttaaggactattaaaagaactatctctattctggaaaagataattttactaattatgatttaagtatactatgaaatctcaaaaacgtctaagtctccaactctagtttctctaaataatacttttttatttcatcattttccctaaccacaaaagtcaagtataactcgcagcttgccatagagaatcaagttcacctaagtggtttgctgagtcccatggtctaatcccaatcttacttcccactaaattctgagaataatctgcttccaacaaacctaccggtgtatacatccatgtatttatcattctctactatttattcaaattctctccactttacaatgttctttatctaggcaagagcacagtgaatctcgtttcttttacctcacgagattttcattacctgtagctatcttatatcgcaccttgtaatgttccatgtttacgtggcatcatgctccatgaaggcaggaaatgcatccatccaagttagaaacttttagaaactctgtttgcgagtgggtggggaaagtgcagggaagtattttcagtcctgatgttaacataaaccttaacccacccattgttaaccatacctttaggcaattcagtaccaccttcaaagttataggactattaactgctttattgcctgtaatgatcttggtagagtgtaactggaaagccaattgagtctttcttaccactttctcttttatccagatgtggcaaatgatttttttctccccatgatcagcaaacttctcattccttttctgaacaccttctgagttatgaattgcctttttttcctttctttttctttcttttgaaatggagtttcactcttgtcacccaggctggagtgcagtggcatgatctcggctcactgcaacctacacctcccgggttcaagggattctcctgcctcagcctcctgagtagctgggattacaggtgcatgtctccacgcctggctaatttttgtatttttagtagagatggggtttcaccatgttggtcaggctggtctcaaactcctgacctcgtgatccatccaccttggcctcccaaaatgctggattacaggcatgagccgccatgcccagccaaattgcctcattttttagtatttaaaagtgtagagtttagcctaatatctaagccaaagtctctcatctagtgtgaatcctccccttctaactcagtcatgacataggctcagaaacttaagggagggatggggacacaattagtctctcctcctgctcttcctggctactatacacttcttcccattcactgctcaggctacttctggctgtttccaaagtgtaagaggaagatggggagtaaagttagaaagacctccctggaaagttagcatttgcacatttttcaagagtggcctcattttaggattggaggagacaagggggacattgttctcccactctcaactgccgctccagaaaacacacacacacacacgtacacacagatacagaaacacacatacatacatacatgtacattcacaaacaggtatgctggtgtgtcacagaaacaggctttcttccttctgaacccgagagcagctgcagagggccctgtgatccctgtagcatgcttcttcagtgatagggagaggggctccaagagtccttacttctctgaagacctggttgtgtccggcacagtgctttttatgtaggaattgtagaacacccctctgagtagttgaaattccctaacattcagggttgcacacacattttctgaaatacaagtgtagctagatctccattatttgtttttattaccatgaccaaaaagagttattgtgattattcttaacaactttaatattaaacttctgattttacaacctaagttgtgagttacctattgttaatcttataaattggctagtgttatttatatatggaaacccagactcggaaaattaatttgtccagggtcacacacttttaagtgacagagtcttctgatcctctgttcttggggatcaccacatagcctctttggtaactttcctttttgcctcgtgagtgacaggagcctcaactgtgtggtacattatcttctgtgatcatgacaaagcacttgaacttttcgagtcttaagtatcttatctcttaaacaaaataatcttaaaaatacttgcctcaaagatttattgggataactaagatctgtaatacttggagataggaactatgtcacatagtgcatgacacatgaaaggcacttaatattcattgaattgaattaaatctcacagatttaaataaaaggcctttgccttaatgttcaactttgtatttggtatgaggtctctctgtctcccttcaattaaatgatatttagaggtatgctcacaatagattagacatagttaatttttttttttttttttttgagatagagtctctctgttgcccaggctggagtacaatggcacgatctcggctccctgcaacctctgcctcctgggttcaagagattctcctgcctcagcctccccagtaatggattacaggcatgtgccaccatgtctggctaattttttgtatttttagtagagatggggtttcaccatgttgactaggctggtgttgaactgctgacctcaagtgattcacctgcctaggccttccaaagtgctggattacaggcatgagccaccatgcctggcctgacatagttaatttttgagaggatgaaaatttaaaaaggaaaggtcgattattataaatcctattcttgtagaatgctgtatttaagaacctctaaattttttagtgaaataggttctatgtatccaatccaaaggtcttatatcaactggaaaaattagatatattccatttaatatgtgttcaatatacaaaacttacatgaagttcttacttttccctgatttgaaaggagcaaagcgctccttgcctaattcaattgctcaggatggcttcagatggaagaaaaacttgtaaccattgcaggatgatcagctatcttcttgtcatcaggggcttacaatctgagcacgatatggttggtgtcatttattttgcattcttgcatcttttttctttcttgaaaataaccagctaagttgtatgttcaccttaaagaaattcaaaggatattgcaggttgtcagatttgcccacacaatatctgaagtcagaccacacacagagagttttaattggagttaccttttgctgagtggataggtgttatgtgactttagattctgtagttacaatggaatattttataaatgatcactgtcatttccaaaaaaaaaaaaaaaggaggaaagaaaccaacttaaaatttcccaaatattttctgagagaaacaaatctccttattaaagtgtatgtctacccaataagcttttttttttctttttttctttttttctttttttttttctttttgagacagagttttgctcttgttgcccaggctggagtgcaatggcacgatcttggctcaccgcaacttctgcctctcgggttcaaatgattcttctgcctcagcctcccgagtagctgggattatgggcatgtgccaccacgcccagctaattttgtgtttttagtagagatagggtttctccatgttggtcaggctggtctcgaactcccaacctcaggtggatccgcctgcctcagcctcccaagttctgggattataggcataagccaccacgcctggccaagcttcttcaaataaattccttcctacaacttttttctgatgacacctgatggcaaaaaaacaaaaacaaaacaaaaaactagtaggtgctagtcacggtgagaagagaatatttatctcagcatctccacttgatgcttttataaatgatgaatgttttagcttggaaattccgtacctactgggagatttatactttaatatcatttatcaaaaatgtaaatcgcatattattccaggttggggatgattattctaattattgttatttattattttttagcaccatcagtgctgcaccaggtaactctggcaaaaaatgttcaagttagaggaggaactgttattttcatatttcctaagcaacatcaatttgtatggctaacattttagcaataaaaagcaaaatgtaaaactgcagcccgctgtgaagggaagtctacacattgaatgaacactgcagggacatactcataaatattcattaaacagggtttcattgaaaatgaaatttaagtacttaaggtaatgtaatacaagtaggtgaaaagctatttcaccctagctaagaaaccaggatagactgagataatctaagaaagaaggatagagtttagaggatgtcttttgtaccccaaaatacgaattaagaaaatgaagtgttaattcaattgtcatattcatcctggtgcttcggaagtccagtcttcataataaaagagaacacagtgtcttttaaacaccctataattatgtgaattagggaggagatttgaaggtctagagagttctcttggagtaggtaatgaaatacagtctccaggagatagaattgttcaagaagtcagggtggcctgtttaaaatctgtgtggcctccagtaagtcactaagctctctgatgttgtttcttacctataaagagaaaatagtactacctcctcactcacagtctttttaagaaaagagagtgtgtgtatatttagaagtattttgtaaactataaagcaccatgaaactatccattattgtaatttgctagtattcatttcagtacatttatggagcctaatctcaatctctatgattgcttagttatattgacatttttacattcattgcttctattagaaactcagtcaataaattttgaatgaaaacctatgattttccaagcatcactctaggggctctggaggaaccaataaacaaaacaaaatgagaggctccaccttcatggagcctatgtcctattcaggggaagtcaataagaagctaacatcataaatatataaaaattaaaatgttagtgggtgagaagtgctttgaagaaaaaacaaagcatagaggtggcatagtagcataaggaacatggagggttacagggtggagggggcttgggtccctattttcaaatagattggtcatggaaggcttcaatgaggaaagatcatttaaagacaggttttgaagtaagctagaaagttaagtcttgtggctatctaggaaagagcattccaggcagaagaaatcgtaattgcaaaggccctgtggcagaagtgtgtcctggatattgaaggaacagcaataactgagggattgaaaagtgaatgagagaaagagtgagtagaaatagagtcagagagtaggaagccaaattctgttagatcattgaagaattttaccttgcctgggtagaaggaaggaaatcactagagagttttgagaggaaatgtgaaaagatttgacctatatttaactgcatcattctggcttctgtgtggagttaggtgaccagttaagagactattgtaataatccaagtgagagaaaatggtgaattgggaaggggtagtagcattaagagtagtaagaagcactgagagtataaattatcttggaaggtacagccaaaataatcttttcacagtttggatgagagatgcgtcagaaaaaagcagaattaagatgactttaaggtgtttttctgttttgttttgttttaattttttttctgttttgttttgttttgttttgttttgttttccagagcaaatggaaggattgggtttccattactgaaagataagagttattttatttgttctgttttcttctttcaatgcatttgtgtctaggtgagcatgtgggtacacaggatcaatcttaaatgagctatttggttatttttttcagttatttgtaatcagttgtcctgtttccactgtgatcaagttaaaaatggtactgtttcaaattgtcttgtgtcattgtggcaatagtttagttttcagttttttccttaagttgcttcataagaaataaattaatctataactcctctttcatatcgtgttatcactaagcttgagttatatagggaaatgttctgatatgattaattcaaggatgctgaagagcaatgagttgtgtgtaagcagaaaacaaaccagtacttaactaggacatctgtctatgagagagaaaggaggtgcacattatttaaaaaaaaaaaaaaagtgtggtaggatttgtctgcaaattaaatctggagaatagaaagaaagaaattagctttaatactattgctcaggagaattgttcagatagtaacagcacctacagtgactgagaagttagggtgtgtaaccagattctttgtggaatgactaaaatgttctttctttgctaatcttgatgagagtgatggtttcatcaaatttcttagaggctaaagagaattaaagtgttcagccctcttgaaggctgtttggctgggtgacttgctgagtgccagggaatagctgatttgcatatatgaagagtcagttagatgtgactcatcccagacactggctgccccaggaggtgctgtattatagcttagctcatgtgtaagtgtaagaatatctgccacagttcttttggcataagccatctgaaattaagaaatattaatttatgtataaaggtaatggggtggtgggtaaggatgggatttattggaagatactcaaagaatcacaagaagtcctaaacaagcaaactctgagacaggcaacagaaaagctcagaaaaccttaagagaaagtaggagaggcctcagtgaagtgtgaaaaatgttattttgagagtcattaagtaattgaatgggaaaaataggtgtcaatatgaaagagataagaaggcaaacaaactattcagaagggcacctccggtgaaacactagaagctcagagaatggcaggagagaggaggtagaaaagtaatgattacaaagcctcattgtggagagaagggctgattcccaccactagatcttcaaaagataaatatgagcctccactagtgggagactttacaataagaaccatttcagtcaaggccagaacttcaaaggatctgtggattaagggagtttgatgactacagatggggattctagagagagtgtaataaaagtgtaagaaaaatggccagaggggtatctatcttggttgacaattaaagatagcaggtatctgagacacagtttatttagcttgccgcaaatggcaagttattcagatccctggtacttgggaagaccccaaggattttgagaggagtcagatttgacatagttcttccttctggtcttttctatttcctctttcagaaacatatgatgaaatgataatgactatcagataaatcaactgagctttcttctgatattttatttactttcccctaatttagacacaaatcccattaggcagtgactaggttatttctttgttctgaataacatcaagcaaattctcaatgtacttcataaatgttaatctcacatgtatctctcaacctcaaaggttcagtttggtttgggtaatttttttcttaagatatctgtcagatcacagtcctttgtattaatatatattataagtgaataaggatgttctattaaataataataaagaaatattcctctcattgaaggagaaatgtttcaacacctaaatgatacacagtgctattagtattaggagaggtgcaaaagacactgtattgctttgcaaaactgtataatatcattagagaaaaaccatatgtgcaataaaataactacatgtaaatgaactttaaataacatctaacaattttccagaatcattaaaaaagttggggtgttttgcattctgtggcaggtaaaaaaacacgaatatctaagttacaataataataataatgtactattatagtatataatactatatagtattaatattagtagtagttttaatattatactaatattatttaataataaaccattattatgttataataataaaataattgatatctaacttgtttatttcattttgttttatgaagcggttgcaagaaaaagtgaataatgacgtcaatagtaaacatttgcatttgaattatcagcaaatatttttattgactgcatgcaaaccacaggttacattaatattaggataaaactcaaatggtgactttttatatggaggataagaattactttgagtaaatatacacttatcattgggcttcttagctttctggccttttctcaagacagaggtcacatttcacactttatcttcccctgatcttttacaccctgaaaaaccgtattctgtaaataagaagcagtttgttattttcttttatgagtattctcaaagtattttctcagaaaacctcttgatgaatccatctttatcacaaaattagcctttaggtaagaattaaatcacaaggcaagttgaggccatacctttgtcactcacatgtcactatttaaatatctgatgcagctgatttaaaaacccgataatatctctttaaagacataatatattatgtatgcctgtggcaaatttcttaataaaagagtctctatcctagtattttgtttcaaaaatttattgcaaccttgtgaggtaggtattattatttccattatacagatgaggaaagtaagtcttaatggttacaatgtctgtcccagaccactccattatttacaagcaaagctgctttttcagaccaatcattgctcttaaattctgtgctatgttcccatcttctgggagttctggaatctttctcttccttattattcccactgccttagttcaggccctcatcattttgcatcaaatccaacctggttttttagcaagcaaagcctatcacaattttgcccacgtcagttaatttacagttaaactatctgggggttataaaggttaagggacctgcctaaggttatacagctaaaaatatcagagatgaagtttagcggcagcttagtgaatgaaaggtacaattcttggttaaaatcttgtaatgagaattaataaagtctaatctaaaactttccttttatgtagtccagcatgaaaatatggacttttttttactgccctgcatgtcagtagatactggttttattggagcccaggagaaacaaaaaatccagtaatgacactcttccacaaagttagccaacttctagaatcttgaagttcaaagtgacaggttccatttgtcatgagaatatacagtctacacacacacacacacacacacacacacactctctctctctctctctctctctctctctgtctctctctgccttactgttaaattgattcagaccaataaaaatccactaaaaccagaaattagattttggatagactagtgtgttttggttttattttgtgtgtatgtatttttgaatcttttaaaccaattgttagtgaaagaaacaatgtttagcaaccaaggattaaaaattactagaatttgtaaactaagagaaaatattgaattatatcatgagggaagttgatagctaatacagattttgagacaccaaagacctactgctccccatggacagtgtgaagcctacagcaaaagctgttctgagcaagttaaaagttcttaagcacattttcaaggataatacctcatggagaatattgaattagttcccaaaattttcataggcatggattctgttgtgcaaagttgtcattcttttataaagacctttggatttgcacattaagtctttttttttttcatagatcttatgtaatggttctcacaaaattgacataaaataagtggttggtttctgtattgtgtttatatgtttcaaacatttattctagttttgtagtttataaattcagtctctacatctgctttctccttaagggcaccatttttcatcttaagcatggccatgtagatgcctacctcctacacttcttcataagtaccatgcattttatgtttattacagtgtgtttaatttgcattattccagatccttacaccacgggtttagaaatttcaggtcaataaacactacaagaagtatttctctcatgtattctagcattataagggtaatttacatctaagcagtgtgacaccattgtgaatttgcttggatggctaggattacaatggcagatggcaacccttggacgttattactgcagtttactgcagtattttcacaagtttttacattaaaattctcaactgaaagggtgccacaagattgaagataggacctttagaatgaactaacttgcataagcattcattaattactgtattgattctatcattttttaggtcctcaaggtatatgtcttatttagttgtaacacactgttacaacattatagccggaaacggcagacttccttgcatcagtttttcacctgaaaattggtgcttttgcttcagcattcatcattatgtgttaggcagtaagtatatttaaaaattagagaattttgaattgacagtggttttattgtatctgtattgggttaacatttttattttcactatttagaaatacaagaaaataaaacaggcttcttccttaactaaagtagcatgtaaaaagcatataaaactcatttgaacacagggatatatgtatacacagaaacacaatgaaagttttctaaattaactaaaatgtcaaattatggaactaataactttccttcttccatccccctcagcttcctctgatcccacactataggtcccagagcattcagtgagcaaccagaccaaaaagatgtttagaaatgtgaccaaaattaggattcactggctctgagtaagaatatgagctattaattatgcgtacataaacttcagctaatgaactctgtgatgatattagctgcataggtacttttttttcttcattataaactggatttcagattactgagcttatgaaataattcacccatcaatgagaggtgttgagatatatacaaatagaacaaagattatagctcagagaacaaattaatatactttatgaacttcactagtggctcaaattgggagattagatttatcattgagtccaggaaatgatgatacttcaaagaataggtgtaacttgatcaaatctttatattgcaagttatttattactactgagaattaaaaatctgaactttgtgaatttttaaaattaattgcaatggaaaacattagacaggacttgtatgcaggagaaaacatataatctgcagcttatctatgccatatcccttagtaagtgatggttagagataaattactaatagctactaatcacttgacaagtgattttatttatgtcatctgtaacatctttgcattatatctctgcaaaatgttggggttttgtaaaaatgtgattaacgcaaaataagatagtagaagcaaatgtctttcatcaaaaaatgcaaggcaatttctctggtcaattatgtatgaagatatacattagtgtttacattttcaaagttaaccctagatgctccattaacatttcaaaatttaaaatgtaatatttgtaaatgtgacccaataatgtagttgttctgatgttaaaaacaatccatctgggtttatattaagtacatataacacttataacaataaacataaataggccattatgttatcaaatacttatggagcacctattaattgtcaaacactgggaatacaaagatgattaaaagagggtccttttcttcaaggagctcactttctagcatggaaaacagaaattgcatcatattttgagtgtggttgagtagtcactaatgctattcacaagaattgcagttctcctcttttcaggctcggagtagaatgatactttccagtgcctcaaagttaggtatggccattcgaattgttttagaggataaaacgtgagcaagtgcccctccatagcagaaaatgtaagagccagagcatgactcagcatgtttatttttccctttactgttgatgctgagtactgaagcatttatttgccatggaaacatagtcttggtggctgagttactagaatgagcagaggcctttcagtgatctgcagtgaacatgcataatgaccaataaatgtatatttgttgtattaaaccactgagattttggagttctttgctactgcagtgtgacttagcccgtgttgacatatactgctatcacatacaaaatgtcaaggaggtgcaaaggaaaaacttctaagcatactgctcaagcttgtaatagataggatcaaatgagtaattaatcattaatttggcttctctaatactatagcttgacaagaggactagaacaaacaccctccagattagaggaggcccttagcccccctcttttctactctgcttcttatctgatcagctcctacagtatgaagtaccgagaaaaggcatcaactcagtggctcccagcatcagtgatttatgacagatgtccttagtggcaagagcaggatttagggatggtgatctatagcccacacaacattctaccagctaactgagtcagagatataatttggggtgaaataagtaaatcaatgctttccaaaccgagcttgtcaacacaatgaccagaggaacctattttaaaaaattgaaaaaaatattttaaagtatgactgaacacatgagaaaaaatgcaagccatagcaaaaggttacatgatataaagcacacatctctttctttagctagcctgtaacacttactccaaaaatcaattaatgtacgtagttttcgcatgcttccagaaatatgtaatatgtgtgtatatatgtatagccctaaaatttcagctagaaatgtttatctaacggagttctcctgagtagagctcaactgtgctggactcaaccatcaacattgattttccatgttcttatcccttcaactgaaaagaatcaagttaaatctgtagggaatgaaaactaaacagctctttacatgaagttccatgtcctattgcatttatctcgtgggttaaaatcattcattgatcgctaatcacctgtggttgtttacacacaacaggttccctggacagcacaaaaccacaaggaggattatacataccacaggaaacaatcaataaaaaaggcacataatgatcttcctgagaggaaactgaaagattttccctttgtgacagtctgtatatgtgtgataggattgtcaaaacagacataagggtttccagctggcaggaaaatgtttttaacatttggttttcatatccacttttcttgtctcactataataatattaaaaatgaaaaaaatcatttcaaaatttcttttaatagagaattcaatgcttgttttgcttttctgcccaaataataatgaaacaagccttttatctcctttggaatattactgggttttgtttttgtttttgttttgcctcgctgatgcctaaaatatctaatcaagagtccatttttgttatccaaaagaagttgaatgacattagtttaggattctaaaaattgatttaatgcacttttaattcaaaaatgatcactcggtcttaaacaaaaatcacattgtgtataatccactaaaaatactaaaacttatgtttcaggcactggactagaaacaaactaaaaccttgaatgaaattaaaactattctttttaaattttacactcaaatagttatagctttttttttttttttttttttttttgagatggagtctcgctcttgttgccgaggctggagtgcagtggcacgatctctgctcactgcaacctccgcctcctgggttcaagcgattctcctgcctcagcctcctgaatagctgggattacaggcatgcaccaccacgcccagctaatttttgtatttttaggagaggcagggtttctccatgttggtcaggctggtctcgaacccctgacctcaggtgatctgcctgcctcggcctcccaaagcactgggattacaggcatgagctaccatgcccggcctcaaatagttatatcttgtaggttcctggtctacaatatatacctagttctcatttgaggaaataatggaactctttaactcaatcaacaccagtttatctttcctcattttctttcaaagcctttaatatttatataaaactacagatttgatatgtgtcattcggaaaaactgtcctgaacaaattcaatttagaaataaatctttccctccaagtgccaaaacaagaatgaaggagtctgacccatctgagaacatttgcacatagggggacagaatatcaaaaatcctttgagatcttctaataatcctatcctgttatatcctgatttcataaatttgccttacaatttctcccccagtgatatttgatagttttatatttctcataagtagttaaagatgactgaatatctacgtgcatttgcctatgacgtattcttagaactagccaactgcttattgttataaatttcatactagtaaatacttttactatattttataaatactaactgtgcattatttagtggtcaccatttactttccccacttctgaaacttcatgattcttaccccattttccataattaaagaaagaaaagttttaaatgttacgcttggtacagttttataaagggacttctgtgtagctttcgtggattagttatgaagagaaaacaggtgagagttctctaattgtgtaaatgtgtaaactctttgagagtgaatgtcaatatctacatgccagatagttttgcttgctgctccaattatccgaagatcatagtacagaatcataatttgctcttcaaaccattcaggccttccagaacaccacctgaaattaaatcttctgcttgtgcatggcttataaaaattgaatggcagttcattttcacaacacgtgacaaacacaaaggaaattatgaattaattttaaaccttgcttagcagagtcttatcaaactgatggcaccctttgtcttactgaagtcaggcatcagagctgatatgcttaattagaatcaggcatcactaaatgttttagagtgactgttcagatcatcctattggactcccaggccttccagtggttggaagcctaaaacaaggcaattgactcaaaaggttgactggatttgactttcacttccatgcattaccttaacctcatcaaaacgcattattatgctggatgttcaaataaacaaaagcaaagacttttgagggcttttttagataggtggatggagactgagatagatagataatagatcaattaaaaatatgtatatatatagtgtgtatatatatataaatactatatatttgtagaaaaactgtgttataggaaaacaaactgaagttacaactaactgtccttctgcaattattcaggaactaactatgcatttgatgaattatttagattttagcctttcccattttggccatttccctattcatcacatgccatcatgagcttctaattaacaccaaaccataaatacatgtccattatccatcttaaaaacatcctgcttatgaagaagtgacatccacagatgctatggggcactggctgtttactcctagttacaatgctgacaccgagagatgtccactattgatgctcccttcttatttactgctaagttcttgtgtttggaatatttttccagggaaacatcatggtcaggaatattggtggttgggggtgtgtgtgtgtgtgtgtgtgtgtgtgtgtgtatgtgtgtgtgtgtgtatgtgtatatataatatgtgtatatatatatacacatgtgcatatatacatacatagtgaagcactgcctatattctgggcatcttataataattgctgtactgttttagaaccaagcactatctatggtaggtcaggtataggtcacatctacttaattaatttataaaagtaaccagaagagcaccccattctaatagtgttggcttgaagcaggatcataagtgtaaacttgcagtgtatcattcagtgacgactgacctagtagccattataggatgaaaacgaggtacctcagcctagttcaggtcattgtgacatggttcagattttaccagcatgtatcctgagctcagaatagcgccaaaaagagttgaaaatgtggcatcaacttcatagttcaaggtttagtttcaacgttttctttttgctttggaggaaaaaacagtttttattccctaagaccaaaatgcaaccaaaaaagaacaaaatacagtgaaaaggtatgtgaaactttctgatgcctatgagaaaagttgtatttgttatcccttttttcatagttaatgacagcttcaaatattaccttccatgactgactaaatcttccactgaaataataatattcatgacaaccagggaagtgaaagatacagacctgtatgttaatggtaaaactgcattttcacatattaatttaattaaacatacaatttatttactctttattctctttttggactgacagtgtaacatattggtagtcctaaaagtaatgaaggacagatcagatgcagtggttcacacctgtaatcccagcactttgcgaggctgagataggtgtattgcttgagaccaggagtctgagaccctcctgagaaacatggcaaaaccccatctttacaaaaaatataaaaaattagttgggcatggtggcacatgcttgtgatcccagctactcaggaggctgaagttggagggtcatctgagccctgggaggtagaggctgtagtgaactgtaatggcaccactgcactccagcctgggggacagaagaccctgtctcaaaaacaaaaaaaaataatgaagggtataaaaatatatttttcctttgtgagcactttaatattaattactttttaaataggaccttatatatttctctaattattgcaaccccaacattgtccttgtgggggcaagtattctttctttggatttcagaaccaaacagctcttaaggcttcagggcagcccctacaactctcacctagaaaacaagtgagttcaggaaagcacctaagtctataactcagcttcaatgaaagtacatgcacagtgaattacctctgagctgtttcctctttgttaggtaatggcgagtctggtccccttgaattgggtaacatattgtgtcatctactttgttagagtgctctaagacttgataatgaatcaatgattgaagcttttggaggaattcggcttcttggttcgtgggaggaggggtaggtctgtgtttttgtgttttacaggcaaattttcttccctgccattttattttgcacatctcttagcattattgctgaaatgtgagaacagcatttaggaagcctaacaaagcttcccaagtgtgaagctgtgacattttgttattctagaaccacttcagaaagcaacgttgtatttctacttaacatttaatgttttgcagctgctaaagaattatttacaaagtagtaaaacagagaaaaagcaatcatttcccaacatcattagtaacaaatatgtttgcttatattttctaaagaagtgacaagaaatgcagataatgagtgactatttgacagacatgtacaaatgtgccagccaatattagacaaagaaaaatacaaaaacaaggaactgaaacgttttataatctttttgttataaatgtcattttaaatgtccagttaatattatgggtgtgtgtgtgtgtgtgtgtgtgtgtgtgtgtgtgtgttttgtccctatgcaaggaggattagaaagcttcccgaaaggaggcattgtatcaccttcctcattttataatataaggtgtactcgtattttagtttatggtaattcccaattgagcctatttaagaatgaatcacaaacatacatgtggagaaaaaaatgccatattaaaaaaggagagaaattaaatttctctctgaagctttgtttacatgggcaacatgaagtcaatagaaaccatctctgcagcatttacttgatgctctatgttagaaataaatagagaaactgggaggggcaaccttctctggccctggaaaagttgactggatgaaatgttaccagtcagttatccctctcctaaacctaggatgtttgccaccaagggtatagtctgactggcaaggctaagaaggaatggaaatatgattcaagctagaaaaaaggatgattccaatcaagtctcttaataacttctcctatcatcaactcaggttcaactggaaagtgtgaaactcctctctaaggcttttactttttcccatcatgcctagctttttgagtacatctttgctcctttctggtctgataatttaatgctgggtatattaactatgtaatttgtagactgttagctccttgaaggaaatggtcatgccaaattcacatggggtgtacagagttggtattcagtaatcatgatttgtataaatggatgtgtaataaagagaagagttttaaccaaaaattgtatttgttctgtctggctaggattctttgggtaactttatatttgacaaactttgatggtgaagagaaaatgagatggaggtcacttactgaataatttggacctttaagccccctttacctggacttaaatggaaatttgattggattgctttcttccaatctgggcttcatttgacctgatttgaaagtcaataacatggtttgatagaaggactttaatctatgcctcatctgcttgatttcagaagtctttggaaaatctgaaaaaggtgggtgttttccgtcatgcctggtctccctttagagggggtggtgggaacaggaaccaaaaactctgctctctggtgatgttggttacatctgtgcagctatcagtgtttcctcctacacctctatcctaacaaatacattttttgatgtgggtgtaaacctaatttccctgtgcataatgctagtgcctctggagtgtgcagagctggctggaatgtgctctaagtggtttgggaataaaggcttttcttgtcattatttgcagtctgtagtattcagctgccaacccatgccatattatttgtgtgatgcttggtgacagtctgtgttgagttttagctatgatttttgacataatttaatgagctggaatgccattttcccctgtaagaaatatgtacatattttcaatgccagtgaaaagttgtttattttatacatgtattatttttctgaatccagaatgtctactcttaacaaatattaacattatatgttcagtatgtaaaatgtacttttttccccactcgcatttatgagaggtttagtcttcagtataattgaaggaagaaaatgtacctacctggttgcacaagggtttgcttctttcctactcttcctaattagcttttaacaagctgtcaatcttccactctatatgttgcatttgtaaagaaaggacaaggatgagttgcaatctccctgtgaaaatagactgtgcttcttaaggcaggtatctccaggctgtcagggtagggcttagccctacaactttgagtcaaatacaatatgatttttgcctggtgccataaactgatgctgagcatatgtttatgtgtctgtgccatctgcccttttccttagagatgtcatcagctttttcctcacagactcactttaacacaacaggaaaaggcccacctaatacttttccttttgttaaattagagtttagaaatgcaaattatttttttctaataaaagaagtaatacacgttcagtgtgaaggatgtaattcacaaaaatttacccaataaaccaaaatcacttcttaatcaatcatgcagagataaccaatttaatattttaatgcatttctttgggcatttagataatgatttgtgtttggttgtgtgtgtgtgtatgtgtgtgtgtacaaatatttgttttcttcataggaaggttgcattttacatattatttttgtagcatgtatttttatttagcaatagtttatgaacatttcctttgtcaatagtattgtttacagcactatttttaatatcactctagcatgaggcaatacagtaatttacttaaccctctattaatggatgtttaggttatttttcagtttttgctgttcataaattatctctgtgcggttcacctcatgtttttagtatagatacctagccatgatattattggatcaaacactatgtacatgttggatcttttatatcgattgcaaactgccctaccgaaagattaactcatcttgtacttccgctagcagagaatgaaagtctcttcctattcactgtcctctactcagtgggactctcattatctttaaccattgccaatatgtccattgaaatatggaatcttgtttctttaatttacactggcgagaataaatgcttgtcatatgtttaatggtcatttcattgagacaagaaaacgcaacttcagtagcatcatagtatcatgtttaagtgagggctctagggcatcagaaaacctggtcctccacaatgcttcacccaattcatgtggactgggaattgccttcacttgtctgtgtaatgtagtgagcagtggaaacaaaatcacagattgttatgattaactatctagcagttgttaggatttttttttttttttttttgagacagagtttcactcttgttgcccaggctggggtgcaatggcgtgatctcggctcaccgcaacctctgcctcccgggttcaaacgattcttgccaccacgcctggctaattttgcatttttagtagagacagggtttctccatgttgatcaggctggtctcaaactccttacctccggtgatctgcccgcttcagcctcccaaagtgctgggattacaggtgttagccaccacgactggctcagttgttaggattaatcaagtcttaacatacaatagtgataagaacaataataatggcctgaacatctccatagtacttactgtatgccaggcactgtccttagcactttgtatattttaactcttttactgtattatgaagctatatataaagctcttagcataatgcttgtcaggtagtgaactctcaatacatattaaccgttattttttaaataattacgcttttctcataacgtgctgccaaacatgcacatggattaattttatggatgaaaaataattttatcaaaacatcttcaaatcatcaacattaaattcctttaaaatatacaatacaggcatgaaatatcatgaacattcacttagaatttatttttagcttaataaaattaaagataaaattataagaatggatgtttaagaataggtttttaagtagtataattattattgaactatcaaatgccaatatcccttttcatactaatagccatacttggaatatacaaattaagtatagagttaagcaaatatctagtcaattggagtaatagagggactttatttgataattaaaaaataaatgatttcttcatctcactcaatggtagtacctgttgctgtaagaggtcaagcaactgaatggtaaaatagctaaccatgttcatttgcttcttaatggcctgatatttggcttcaagtgaagatgagtgtctgttttctaaagttagcatcaacatacagggttctgtgatacaatgtgggagacagcacagaggtgtagctatgaacacatattttattgttagaaaacctatcttcaaaccacaggtttcctttttagagttggttggcactgggtatgttagttaaattctccaaattttaatttctttatttatataatgagattatttacctcagagcctaatgtgagaattaaatgaaataagaaatgtcaagcacatagcacagggtcaagaacacaaggcatgtaactaagctgttagctgttgattttatcattacggcagagacaatgccagattatccaacatgtgttttgttgatttgcaagacctgactttgaagtatctgcaggacaaaaaaagttgagacggccaaaagacacataggttgtttggtctgaaactcagaggaaagaccagagtttgagaaataatttgtcctctgtagaagggtgagtaaatggacagggatagaagttttaggagaaagattgcccctgaaaaggtgagaggcaacagagtctaggacaaaggaagaggacacattccatagacagggagaagaacatctatgccatagtaacaggaagatagacacaagatgggtacacacagttgcatgaatatttacgtgatatttgtctcaaactgttctgaaactccagtacctgtgcttatgactgttaaacattaatgctttccttcctgattattcctaaagttttattttcgaatgattccatgattggacattatacttgattatgataaactcaaatttagtggcaacccagacagactttagataaagtgaagagaattggggaaattaataatatattttaaataattattttaacatgcagaagataaaatttagtaaatttaaaaaaataatattttatatcctcaaaaaagtttgccctatttgcagacacctctcttcactaaatttttttttaactatggtcaacctatgtaaaaatatattaactcataaatagaaacagctaaacaagataatcagagtaaatgagaatttagaaaaatagctctcagcacattctttctgaacacacagttctctttatataaaaatagcatgttttagatgccttttattatacttgcaaatctcaaggtgtaaatatatttttctgaatatattccttaatatttcaataattggctgcaaaaaggggctttatgtatgatgcagcctttagtcatttttctctcctagcagcagtgatacatttaagaaagataaaacttcttaatctacagagtggaaaagagcaaaactgtaaataagacataattagaaagatgtatcttcttacgtgatttggggcattttgcaagtccttcctctgcttatttatattttcagaaaaattcccctaatagccaatgcataattgtcaatttatagactctggggtaaaagaggcatctggattgtgcttttgagaccttgtctttactactttcagactgaatgtgatgaattgttaaataatcttcagttagtaaaaccaagccttaaaaaatgaaggcatcctataaacattcagtttgaaaatactaaaaagtatctgtataatattatgtcagaaagtgaaacatgacactgtcgtaattctaaaatgaaaattaaatagaaccagaatttatacaaatttattaccgtgagtttaccagtgttgctggagtttaagatgtcagaggaggaaatcattatgtctggcattgctggatcaattacctttatggcttctaataaattttgtcttctgattttgatggatatttaatcatctgcttctggagagatttccatttatatacctggaaaatgcttcaactgagtacttattaactgttagcaatagatatagttctgaaagatagatatagttctgtggttactgtgacttaaacaaacattgggaccacacgatcactttataatgagatttagtatccttttgtagttaagaaaaataaaaaatttggtaaaattattgtttttctttattatctataaatgcttcaaagtagttaataagagtaatttatactaaaactttaaactattgaacaaatggaactgttggtaaatactttgaaattttgtttctgtgaatgtaaaactttcattcagccaagtttgttttagctcatgtataaatattatgtaagtatttgctgacataaaaatatatttactaggaactataaaatttattttcacatttacaaaaaatatggtatcagatgcttatgtgtatgctggaactttattgttattactaggttggtgcaaaagtcatggcagttttgccattactttcaatggcaagcgctgaactaacaaatacgtatgtttatgtgcaaaggagagtttaagaaaatatactgatgttcaaacttgttctaaaaaggtcctaaacaactgggtgtggtggctcatgcctgtaatccgagcactttgggaggcctaggtgggtggatcacctgaggtcaggagttcaagaacagcctggccaatgtggcgaaaccctgtctctactaaaaatacaaaaattagccgggtgtggtggtgcacacctataatcccagctactcgggaggctgaagcagaattgctccaacccaggagcagatgtcgcggtgagccaagattgcgccattacactccagccttggcgacagagtaagacttcgtctcaaaaaaaaaaaaaaggtcctaaataatacaaaataaatatgttattaattttatttatttatttgtttatttatttgagatggactcttgctctgttgcccaggctagagtgcagtggcgtgatcttggctcactacaacctccgtctcccgggttcaagcgtttctcctgactcagcctctcgaataggtgggactacaggagtgcgccaccatgcctggctaattttagtatttttagcagagatggggtttcaccatgttggccaggctggtctcgaactcctgaccttagatgatccatctgcctcggcctcccagagtgctgggattacaggccagagccaccatgtctggcctgttattaattatacaaatagagttttagcacaactctttttccacctaactggaaaaaatgaaaatgaagaaaattttctttggaaaattatttggtagtctttcagtttgttcaaatttgtctaatccatgcatatgtcatctgataaaatcagactccggttaagacctgtgttcaacctttttagcaattttgattagtatattaataactctgaagccacaaattggtctaccttatatcttctttttcctattagatgtaacctttctaagagcaggtatcattcttttttttttttttctttgttttgagacggagtcttgctctgtcgcccaggctggagtgcagtggtgcgatcttggctcactgcaacctcttccttccaggttcaagtgattctcctgcctcagcctcctgagtagctgggattacaggcatggatcaccatgcccagctaatttttgtatttttagtagagatggagtttcaccatgttggtcaggctggtctcgaactcctgacctcgtgttctgcacacctcgacctcccaaagtgctgggattacagccatgagccactgcgccaggccgagaccaggtatcattcttatctctgtatcctatataatacgtcttagtgtcctccaaatagtaaaatcaacatttcatgtatgtatatcccataccattcttgcaaattttaatgtgtgccttgcatattcacataattttattatggcttagtgttaaaccattttggttagatttttcacaacataacttatgcatagtgcaataaaagtacatgtctatgaacaaaggcatactgttgagaacatttaatattgcacctgatattgtagccagcattatttccctttcttttcataaggacaccatttttatgtgaggggtgggatgcaggtaggaaaaacactttgttccattcatcagtctatatacttccgacatagcaaacttcctgcaggtctgtagatgagcatgtggcacaggtctgttcaatcagtccagtcaatcccataaagataggtttaaagatgggcatatttcccgataagagccaacaagtctggaatcccagacttcagtctctccggagtcactgagatgaagaatgtgtgcctggagctgctagcagtcttgttgccctccagaagagagctgttgcctaagaatgtacacaagaggtgagacaaggaatagtcttcgtgacattttttttattcctgaatcttgtcagattttactctagtgctatcctggatttttcagttatagaagctaacaaatggccttatttttgcttaagcttgcttgaattgtatctataacccttgcaacttaaagaagtctgattaatagagtcgtctgtactttggttatttcatctacgaagcaagggactggaatagatagctgtttcatgatttccctttcagaaatcagtctatatgtacaacagcatgaacttaattacagagatcccatatgtttattacatcaggataaactgaaaatgtttattattttccttcattttatttttttatcttactactagtttttttaagtggttaaaatttaccttttttttttttttttgagacagagttttcactcttgtcacccagggtggagtgcagtggcacaatctcagctcactgcaacctccacctcccaagttcaagcgattctcctgcctcagccttccaagtagctgggattacaggcacacaacacccacaccaggctaatttttgtatctttagtagagacggggtttcaccatgctgtccaggctggtcttgaactcctgacctcaagtgatccacccaccttggcctcccaaagtgctggtattacaggcgtgagccaccgtgctcagccctaaaatttacttttaacctctatatctttccatgattactctgctgtttatcagcagtcagagtagcttagaattatctatttaaaaattactaataaaaggcaagtaattgtatttaaacatgtaagtgactgtcagagaaaagaattcacatttataaatcaggttattatattaggttctcttatctaattcttaccaaatcttgttatcattacataagttgtttttcaaaaagatgaactttgtttaaacaaaaaataatacttattgattttcttgcagaaaaagcttcatgaaaaagaaaaaaaggtattgttatgtttctgagttaagctctgttcaattttagagctgcttgttatccaactgggcactaaactaaggtgaccatttatcctgattaatggtagacagtcctggactgcctgaggccattttatttatttatttatatacttacttacttatttatttacttatttatttattgagaccagagtctcactttgtcacccaggctagagtgcagtggcactatcatggctcactgcagcctcaacctcctgggcttaagtgatcctcccacctcagcctcccaagtagctgggactacaggcatgcaccacgtctggctaattttttatagataaaaggactcaatatgttgtccaggctggtcttgaactcctggactcaagctatcctcccaccttggcctcccaggtgctggggttacaggtttgagccactgtacctgactcatttctatttatatctgctttcctgatgtaattgctaatggtcccccattttactatcaaaagtattccaattatgagaaaaattatgtgctcatcccaggtatggccaccaaagatgttctaaagttaaatgataaaggaaaatgatatagtgatgaacttgtaacactttgacaataaatgaggtatctgagagacattttaccactacaaatggtaaatatggaaataatttgtaaaatcagtaaaaatgtaaaatattatcatcagtctactgtaacttatcgacaagaaaaaatgaaaaaaaaatgcgtatgtttattgctgaatttatctgtaccactaaccctcaatgaactattcttcagaaatagcaatcaagcctgacccaggaatagtaaatggcttatgtatatctatgcattctatagcaaaactctgtgctaaatgaagcacagatgtaatcatctacatcagtagtcaccactaagaaaatctttctaaattttaaatcttgagggaagtgtaaaaggttattattattattatcattatcattgaagtgcgtagaagtgtaactgctgtcattgggaaacctgcatttgaaatttatagaaaatttgctttgcaagataaatttcatttctagcttcctgaataaactgttaggttgaagtggaatcagcatttcacaatgtctgccaaccatttcaaatgtcacttcttgagttgcttcttcccatatcccaccttcttcttgcatattctttcagtagaaccaatgtacttctgaggcaataagagaagtaatcactgattaggtagaactgactattgctcacacggtcactaaactaaggtttagacacagaggacaaactgaaaccaaggttgctctttccaaactctcctttttagtttattttcatcattttatgtagagtatcttaaatagcaacataaacatacatatatatgcacacatacaggaatagtgcattagctcataaatatgagaattagtcattgaatatggaaataatactgagtacttgcaaaatgcatgaaatctccattaggtatcaacaggtcgtagagagggaattggcaattttttttttcagtctagggccaggtagtaaaagtttttggctttgtggatcatatgattttggctacaactatttgactctgccattgtagcacaaaagctgccacagacaaaacattaacaaatgagtgtggctgtgtttccataaaaacctttattcatgaacacagaaatttgatattcatagaattatcataagtcagaaataaaattctttttttgaaatgtttcagccacttataatataaaaatcattcatccttggctcataggccgtgcaaaaataagtcaatgggcaaaatttggtatgtgaaccatcttttgctgatgccgctcatagagcattaatactgttctctctcagggagaaaaaaataaagaattgtgtgtggcatttagcaaaggttcccaaatgtgctttaagatgcatgtaatgttgttaaaatgaggtgccatatttttccccttacaaaatacagattattagagtgctaggaaagtgctatgaaaacaacagtttctaattttacataaagagtccatggtaaatacacctccagaacaatgctttgttatacagagatatgatgtcagtttcatgtatagccagcttccttgccaatcaaataatactatagataggtgtgacattatgtctgggcataatcagttttgactgataggttggaatctaaacaagaatataaacaagaaactggagaataattgcttgacttaaacttcagataaaaatagttgaagaagactaatattactaacatatgaatgtattagaaattatctaaaaattgtttcttctttaactgccaagatgtaatctaatgatgagagaaaggaccttggaaatttctattattatttaatttattgtttagtcaaatgggtcattttaaatagatcactattgcaaatataagtatttttggtacaattagaggtcattccgaatacacaagaatacatatagtttaacgtgaaaaaataaattataatctgatgccaattattagcaaaaaatataattaatgttatattcctactagagaatacattttttaaaatacaaaactttatacaataagctttcgtagagcttatatagatcttcaattatgttaatattcaagtacccaaatttgataaggcagagtttaaatgtttcattgcatcatgtggtttgtccaagcctgtctttttaaaataaataaatcaagcagagagatgcaaagggacttatttaaggttacacagcaaattagcagtgaatcaagacaagaatacagccttttcctattacaatattatataaccaaaggaagcaagagaagtctagcttgtgaacagaggaaataagaatgtttgaaattgaccaaaaggtttttctttattgttgtaatctccttcctcctctttcccttcctcttcctccttcttcccttatctcttcttcctttataagctagttatatgttattctgggaaaaaatattatttgtagttattgctatcatgaaaaataaaattttatgtgtcctaaatttaattatattttatgaaacattaactctgacatgatgtggtaaccatcatgtaggcaggacttcactggggactcttcccctttctgccctggtgcctgtttgcttcctgccactgtatggttgagtatttctgaagtcctaaatacacttaaagttgtggcttttatgtatggatatgatagttttctttaaagagttgtcagtgtaaacgttctaaatagaacaaagcataatgatactggtcatgattgaaactttttgttgataaatagcattaaatataatcttcccactcatgattcctaagaaagattagtaaaatcctacatagtaaacagctcacagacttctatagagatgggaaaatttatttttcccactgatgagaacatatggaggattttcttttcttcagagaactcacagtttccaactgagttggattttttttaaaaatgagttaataacattgtgaacattataaaatggtgattttaggcatgtatgaaaagctatcaataacaaaaatagagatatatctacagaattatgatgcatattataatatagcaaaaaaatttggagggtaaagtgatttaatgagaattagatactatttaagataaattttaaatatcttagtggtaaaagtatatgtctttctgagaaaatcaaatgtgtttatttgcctggataagttgtttatccagacaaatattaatcaacactaattaattactatctatattagggcaaaagggcaatattatgaacattttcttccccaaacagctgctcaaattctgcagatcataatgcagatataaatagcatagctcattatattttagatagctggagtctattaggcacttttgaaaattattattttgctctgcctatttttctctcatgggttacaactaaatactgacatgtaaaagaaacattatttaaagctagttttcccccaatatccattctccccttcttgaagaacctgagatttttagcccagaataacagctatattatttagactcctaaacaataatttttaggcagctaaacaatcatttcgagagatatcagcattatttagacctactgggtcatggcagaaaatgctatgtgctccttacgggttggactcttaagagaaggaatacaccttactaatagtttctgctccctcctatggtcctgaatgtagatttggtagtgtcatgagattcttggggtgttgcttcaccagccagaaacctccgtagccagtgacgcctttgcctcggttttgcttgggcctgctgggctccttctgcccactcagcctggcaggctgtgctcagcttgtgctactggcctggatcccacacctgccaagatgagttaagtgtggaacagcaaggggtgtgtgagtgagtgagtgttgggtccagccactgcacacagccaggcacaccagatgctggctccctgtgaggctgcagctggaccagatatactgcaagcagcttccacagttggcaccagaagcttggagacaccaagaactgcagagccccaaacaaggtgtcacagccctggcttggggagctcctaggtctgggatccccaaagggctgtagcttttctctcctttccttcttgtcacccgcaacatagcgagcaaggggcatgtttcagccctgttacttacagctcttttagccccaccatttggcagattccaagttcctgtctgacatcccggaaaaacgaagtacatggacaagtggaggttgagcaaggtaaagaggagctttactgcgtgacagaatagctcaggagggagacccgcagtgggtagctcatctccactggcagggtatcctgatgagtgttcagctttcaacaactggagaccctggagtgggtagctcctctccgtggctgattgtccactcatttactcagctctcagcagggaggagaccctggagtgggtagctcctctccacagtgaggtcatcccattttctccttgaatctgacagtctggggtttttatgggcttcagaggggaggaagggtgagctgattgctccaagggcagccatgggttggaaaaagcactgtaagttcccactctggtctgtgagactggcagcctggcccccaagattcaggccttccccagcttgaaggtagggcttcactagggactctcccctttctgccctggtgcctgtttgcctcctgccattgttcatggcacccaggctgttcatgctgagagatgcctgcaggccagtgttgagctgccctcagcacccccttggcctctctcccatgctcattggtgcccaaagtctggagggggcctaggcagcagggggttgtcacgtcagtactgccctgagcatgcacgcacctggccgggttgtgacagtgccctagctcagcctcgactttgctctgagatcaaagcaagtgtcaggagcagggagaggccaggcagtggaagcaggcactttggaccctgcaagggaagggggcaccttcccaggccctcgagagtgcagagatgcctgggtctgcagctgtggcttgggtggctgcagctgtgcccaggagggcaggacacctgcctacttccagcctccaagagcacagggatgcccgggtccacagtcacagcttcagtggttgcagctgcacttggaagggctgggctcctacctgctctgtggagcccacagccccaactgctccttcccactgcagccagtgtttttgcagtggctgctccagaagggctgctgctgctatcagtagtgagacatatttatcaaaccagaagcaggaaacacctagggatggcagagtaacaagagaaaaggagtctatgtctcccatgcctggagtcaccataggaatcctggactaacaatgcttatgttgatacatgagaaagaaataaacctttggcttcttgtaccctaactttcaaattttgttacttatcaagagaaccatatagttttttcccattatctaataatatgaggaattacataaacattgaataaaatattcaaagcatgaatcttttgcattcttgataaaagctctgcttggtcaactttgcaatagattcaatttgttactatgtcatttaatttaagttatttacatcatatgcaaaagtgctattagtctgaaatttttaatttattttttaaatgttttggtatcacagttttgctagatttataaaataattttcagaatcttccatattttctatgctcctacataatttatatgtcaggtaaatattggtttttggaaaactttaaggaaattgcttttaaaccactatggcctaaatattttcacccacttttccgttgttatataattgttgatattcctaggcttccttcttttttgtttaatcaaccatatatttttagaaaatcattatactgagatttgtatatcagattacacagatttgtatatgacattcgaaaacattttctcagattttggatcttctttctcattcttaatatagtgctcttcagttttgtgtattactttttccttggcattacataagacagaagtttatctatttaattgtctttgtcaaataatctccactgacttttcttctttacagtgtattcattacttcctacaatacgggctctctttttgcttttcttgttttgtgtttttcttttcttgaattgattggttagttcacttatttgtagggtttttttgcttaacaagaaaaatatttgcagataaaaattttagtttctgattaaacctttgatcgtgctaaaaatgtttgatatatattattcccactgttatttttctactaatatctaagtggaatttttgtttctcctttgctccaatgtaactttggggagttctttttcttttaaattttagagatttgtagagggttacaattatattactaatttcaattgttaaattattggattcagaatatgtggcttaagacgtatctaccattgaagatttattcgggttatttggtgcctaacactataattttaaaaaattttgcataaaattttaaaacagatataggataatcatttaaatataaactatacaaagaaaaatatgtttcctatatctattaatcttatttttcagattcttgaaatccttgtctgttaaatatttaagttaaaatagataggaagacaacttattttttttttcagtcctctaatatttctgtccatctacactggaagttctaaagggtttatctttatatagttaaatataagattattcattttgcaagtgtttatgtctgatctacctttaatatatactttacagattatcaatgatgcaactttaatatctgaaatactacttaaatttatactattgagatccctgttttcacattgaatttgagtaacatatctttatctgtctttttgcatttaattttcttgttagtcattctttaggtgtggttttatgaatagcatttagatttggttttctagaccaatgtgataatctaccttccaattttttgtgttattttgctatttcctatgtatactttactttcctcggaaacatgaagtatagaatataaaatatacagtatatgttttttccagcccatctcttgacctcctgccccattccttcttgcttttttctcctcttagacctattggctctgtatgaaggtaggtaaataaaacggtagaaacaattgtaggaggaccttaaaaaatcaatacccagaacatacgctgaggacatctagcagagcttggttttggggacatgttgaatttacttccaattttactaattacaatgtattataatttgattcttctttcatcccagggatgatttaagagtgctgtgaaaatattgtttatgcatatggattattttttgaaaagattataaagaagtcatatattcattggaatatatggatatgtaactagttcatttttgtaaactacttaagatgaaattagtgaaggacatgaggcataggtgttaagtataaagtgggtataactctgtgtaatcttaaagaaaaaccatatgagaagacagaagactcagggtacctcaaaaatgtggatgggtgcccttatgcaaatgaggaaggttagaccttgaatgtcagatatgaggattcaagcttctaatgattcttcctctttttttcttattataatcaattaataacattacctcacataagctaccctgagttagagaagcttttatcaaccacttctaccttaaactttaacagggaggtctctcctgcctactcagctctccccacaaaaataactctggactaatttgtcccccatgggtgtcttcttcctcaagctatcttttctgcttcctgcttcttaactttgtgctggtctctaagtagaaagtggaaaggagatgaaaaaaaacaataagccaagttttgaaaagtcttctttttacttcatggacctttgttactgagaagagagttaaaaaaattaatttggtttttgaaaatcaaacacaagacaaggagtatacaacaaagtgaaatttgaaatatatatatttttagtctgccttcatcaaaagttggcaggatttccttccacagtctggcaatttgtgagttaagcttagcctgcatattaggtgagttttattattttctattgtcttcagacgcattttgaaagtcatattaggaagaggttaaataggaagtgtctttgtcaaacatcaccttaagttggaagccccattaagagggaattttactctctcttttataatataatgcattaggtcaaacatctttttcaagctgggcttagttaccccaaatgtgtgtttggtagatactctaccatggactgtcacattttattcaaagctttcaacatgaacattttatttttgccttttaccagaaaacacttgaacatagttgtgaattctaaaacaagtgttacattgagtcaaatatttcctaacttagtcatttgttattttgaattggagatttagttcccaaaattaaagttctgaaaggataaagaatttacgatgtaataagctaggaaattctctattaatataaaggcatgttatttccattaactaacaaatatgttcttggatttgacccaataactacaaagttatccttctgatacagaatagcctaagggtgctttctaattaaaattttgaaagttgatgctcaatataccttatctgtctgcaattctaaattaagctgggatctattatattgagttagtctataatcttttctttcactggtatgtagcagttgaagaaatgctaatttagtaaatcagatcaagttcaatcctaaactattattacgatagcaaataaagttagttgtagttatggtcgagttgcaatttatggaacctcataatcttactagtaataaaaataataattccaacaataataatatgctaccatttattacactcttgctgtgttccaggcctttaaaatgcattatctcatctgacttatgctacaactataagaaggaattatcacatcaattccatagtaaaagcagctgaggtgagaaaataggatggttttcaataacaaagcaatgggcgccagggggtgttgagtaattggatggaaggtgcaatccaaaaagaggattcattaaagagcttctaaaatcttataataacatttattttaggttttaaaattgccttagtagcagacatgtgcctcagatgacatggaaagatggagcaaaacgcataagaaaataaaaatcataaatttcacttcacaggttacattttacatgagtgggaaatttccagaatctgcctacccgttctatgtacggatctggaattcaggagggaggtctgactgagttataattttggaaatcatcagtatgtgatagaagttgaagtctgaggtatggataagacattttaaaagctttgtggactgagaagaaaaaaggacaaaggatatgatttgtggaatttggatattcaaaaagcaataaaaatgagaaataatagtataattaggacaggatgttatcatcaaaactaataaagattatatgaggtaaagaatagctgaaaatgttgaattatgttgtcaagcaatacaaagttcaaaaggtgtctaattggcttgccaattagtcagctacagacacccattcctggtgaacagaggtgggcagacttggaattcagttttctagtgcattcaggagtaaatggtaggtgggtaggtgaggaagtgaatgaaaattctataaaagcatgggtgtgcagagattaagaggtcggtagctagaaatcaagaaaacagttttatcagagagactacaacacatttatctctgcacaggagtgaatggtaggtaggtaggtgaggaagtgaatggaaagtgtaaaagccaggatgtgccagagattaaaagatcagtagctagaatcaagagaagacttttattaaggaaacttaaacacatcctatgtgtggagagagagagaagattgagacgtagggcagacagatgatatgacagtgatgcttgaaggaagtccattgcataaatctcaacaagatgtcctggaagggctgccacagatgatagtgcagggcagtgagtggaggggtgaaagacaacacaaagtcgtgcagttcatcttgttaccatactgaaattacacattgtccgtgatagaaaggtccttagggttatctactgcaacatgcagctgttatatttgtgcatattcaggaaagtgaaggacttgcctagggtcagataataactacatagggacagaggcaagaccgggattttgttctgatttgtaattcaatgttctttctggtacaccaggaaacacagactcaagcttatactttctggtgatagaatatcaaagcagttcttaacagcatcctgagtattgaattcaccttttattgaggtgaaggctagaaaaactaatttttcttgctttctaaacttgccctactcctgaaatctgtatgaatcaaatgtaattttgacttctaatttttaataatggttcttccaaaatggattaaaaatggtagatgtatggcagtttgattttgcatgatagatttatatatttatgttctcaaatctaagtaactatcatatttttgaaactatataccaatattcttgaaaaacaagcacggaaaataaacattttcaggtacgagtacatgaggatgggattggaaatcacatggatcagtaaggagatctgggattttgtggtagctgttcagatatgagatcttcaaagctgttttgagtaaaaatattcacagttataagtagctatgcagcacaattctgaatagtggtattctgaaattttgatttatatttcagtcattgttttccaaattttggttcccgagttgcttataggtatttttttaataaagaagtctgtggccaaattttgccatgctttcactgtatcctttcctacccctacttgaaaattataatgcagagttaaagatctaaataatcctacagagtagaagatccaaagaaatctaagaactccagttaccttgttgaatccatgttttccaaacttgtttaaccacaaagcagggttttgttttgttttcctttttttcccctagaacatttattattagtaatattattattattatttgagacagagtctcaccccatcacccagactagagtgtagtagtgtgatcttggctcactgcaggctccacctcccgggttcaagagattctcatgcttcagcctctgtagtagctgggattacaggcgtgtgccaccaggcccggcttttttttttttttttaagtagagacagaatttcaccatgctggccagaatggtctcgaactactgacctccctgatccacccgcctcagcttcccaaagtgataggattacagacgtgagccacccaacgcgctggcccattcctaaaacatttattatcatctcaaaggtaaaagtgtcccacaattgggagagaattttctcgactggattttctctttttcaggatcttttattcagtatccaaatttttaagacacctgttgaacacaagtacttatctttctctgaaataaaggtgcatttgccacactaaaggagctaagagctaaacagctaaagagaaaaaagggcatgttttgctatagtacctatacattctatcaatactaacattgtaaaacataatttttcagtatataaatatacatattttatattatatacatctgtttgtgtgtacattttgtgggacaggtgttagcagtacaaatatctatcttttaaccaggcttgttggtattttgggaacgtctaaattttgtatagctcattggtatttaccttgccttctttataagaatgaaagattttaactttggttagcaccaactgatattcaaaataagtattatttccgtaataatttggtttattgtccctttctgtaacaatagagccaatgaccagttgcctaaaatctctccttcccatgcttaatattaaacatttggtccagtaaaaagtccacagctctgcctttcaaagcttacttcagcacactcctcttacaggtggtggtatgttttcctaagtccaaaaagaatctgacatgtgactaatctaaagatgccaagagagattttcttttgttttgatttgaaatactattgtgaagtagaaggtcaatcttgaaggggctagcattagaaacatgttactgtgtcatctaacaaaggacataaagataattgaacaataaactaagaaagtacatgaattatttgtgccacctattttttaattgcataaaacaatatggaaaactgtagatatcggtttaagaatattcagatgccccggctagtcactgaaagcacatacacatttcttacactgactccatccgccttggattgccagacttagtgataagtggacttgataagttgtgatgcctgcttaatcagcagtatccaccttgatagtctgacatatttagaaataccaaagttgaataaagcataatataaaaatagacaaaattttttcttaaaatagcatcattgtagttcattgcactcttggtaatagaccttgggaaaatccccaaactgaaagtggtttgctgaaccaggatgtattttgcaaggtaagtgtacaccctatgacatgaaccaagtttttaggtttattcaaagagaaaggtctataaatgatgacaatgttcaaatatctttagtagttgaattggagactaaaatctggaaaaaattcatatagtttgtggaacagtttcaccaactttgcctgtgagtcatacttaacatctaacgataagacaaggtcagcaacagcaggatcccaggacatcggcatggaagtcaagctcactgaaattcagatttactgggctagacatgtatggaagatggatatcagcagggtggcgaagcagctgacagactagctgaaatggagtgattgtaagcacagtgggcaaaagaagtactctaaggcctttaagcagtgtggcataacttccgactggtggacagtgatagcagcaaacagaccatgctggtgcacagcaatcggaatttgtgtggctcccttcaagtgactgtgctacgcaaactctaggactcttgcttgaactgtaataaggtagctgtatagagatgtgtaatggtatgctttccttttgaaatagatgtagctaggtctttattgcattgatttgaacacaactaatatttctactaaaaaagaattcttgtcaaaatctatcccttagtgtcctcacaggtgatttttcactcctaagttacgccaaactatcctgtaacctctctttatattttcacattactatataatttagcttctcagaaatgtttatttagtttctgttttctttggcatgttctctataatttttacttcttattttcaaggtctactatgattctcaatccttctgaaatgcatttcatcccgtttccttctgctttattctgtctctgaacttatcagttcaatgagcctttactttcacaggagctaagaaacaaataagaagagatccaatgaatacatattatgtgatttatcctcattgctatttctttatatatttcatttttcttttttagaaatttgacataaagcttagccctagcatgaagtcttcccaaaccagtgaagtcaattagaacatattcaagtttaattttatcccattaagcaaactggatttcagggcctttgagctttgatggtagctgacgcgtgttccagtaacttacaattcaaatgcgactgtagagtttgctgtagttttgaactttatctctgaaaggttgtgtggttcagacttgtgtgtttttcttttctaaattataataaagtgtaaaatttcattttaagagtcctacaatccttgaaaacatcgtggggtttttcaattgtagagatttagaatagatcttatgatttatgtatttctcaagtccataacacctgatcttgtttagttactatcaagaacatcttttcaccctgtagaaaaggaatattttaaagaatgacttaattttgaactgttattttatcttccatacaagctatttgattactggagttttgcctttcagaaataattaaacctaattttaaaaacaactgattatgggatatatctgtatctatatttatttctatatctatatctatccctcaaccaattatagtcctatagaatatttagcagttctaaaaaatgagtcaatgaccatttttgcttttttgacaaaaatactggatgaggcttataattaagtgtgttaatcagaaaaaaaatactttatagcaagaatatatataatgaatgccttattgagtcctaagctttctggaaaattatcacagaataaattttgatgtgtccaccttctctaacaccccacaattactgaaaataatctttttttttttttttttttttttttttttgagatggagccttcctctgtcgcccaggctggagtgcaatggcgcaatctcagctcactgcaacctctgcctcccaggttcatgtaattcttctgcctcagcttcctgagcagctgagattacagatgcatgtgccaccatgcctagctaatttttgtatttttagtagagacggggttttaccatgttggccaggctggtctcaaactcctgacctcaaatgatccgcccacctcaacctcccaaagtgctgagattacagagatgagccactgcgcccagcctaaaaaccatctttaacattaccagattgttacttggatgagaaaagaatatgcaagaagatttaaaaaaaaaaatttgttactgttaacttgttgattattttattttgtttatttttatattttacttattgtctaaaaaaagacttaaggatgagttcaacatcaaaatgtgacccaaacaaagggaaccagaaataaattataaggtgttttgattttccttcagttaaggccataaggacaatatgccacatgatatgattttacttatttgataaaggagtgaatgccagttcatttggagaaacagattatttcctagtactaaattctaaataaaatctatcatataaatttctacaaagggtattaaagtaacataattagctaggtattttataggaaaaagaaaaattattttaatattcatatattacccattcataaacactaaaaattaaatatcgctagtaaatatagtgggcactatccagaatttagataatttagatactaaattaatacattgacaacatatataaaactagagcaaggtttggcctgcccattgagaagtctatctcaaatatccttgacttacgtgagcttgtttcaggattaaggtatagtcagttcagggctggattctatgatgactatctggaatgccaatattctatgctgttgaaagcaatccatattctttaaatctaatataagtctatggcagaacttacatttattatgaaaatctggaaacttgatttttattgtcactactttcatacagaagggtgcctctgcgtagaatcaaaattgctaccaaaaaagagttttgactcattccaagtaattgcccactaatttatttgaaattgcagatttctgcatggagaagatatttgggcttaaaaaaaaaaaagatctaaccacaaaataaaacatttaattgcctatttttattatataactgtaatatttttaagtgaactctatactagttcacttatatgcacttgatatgcattaagtatgtgcatatcaagtgttgcatttctgatagttacagtttcttttttaacttctttcatatattttaacatctaaaagagtaaaattaagattggcattttcccaatgcaaaaccatttaaacaagtcctttagtctattgtgcacttacgatgtgataaccacagtccttgttgctaaagactaacaaagcatttgtttagtggagggtgaaacaagtaaacattagtgaagactagtaatattttgtggtaaatgcagtgagagaaaatgtacagggtgcgttgtgaaaacaggacaatcgcctcattggcctgagtcccgaaggccatttagttgttaatcaggtgaagggcattttagctagaaggaatggcaatttaaggagtattgaatccaaatgccggaagttcagtgtggctgcagtccagatgttttatgggtaggtaggagtagattaagtaggaagggatgtggaagccagatgatgaagggctttgcttacaataaaaaaaaaagttggattttatccagagtgttaaggcatgaattaaagcttgaggatttatagaaggggtagattccagagctattagaagaacacagtatagcatagtggctaaaaggagctgcctaaatctgagcttaaatctaggccttgtcaactaagagttgtgtgacttgtgcatgttatttaacctataaacctaagtgtccttatctgcaaaatacttgcctggtacatcgttactgtgcagtaaagagtagctggtgctgctgattctggttgctacttgcacttcttaaaaagtggacttgaagactgaatactggcagtaatggaggagtagggtgctactggagaattcactagaaatataggaagaagaatgggtttggattttggtgttttagacgtgttaaatttgaaacagaaagtggaaatccaatggaatccatactagtttgtgagctgtcagcaatgttgtatggaaagatgaaaccgtgagttaatgacaaaactgcctacatggaggagatagacaagaagatgtcaagggtgaaaaactgcgtgcattcactattatttgaaaattatgtggaaaaataaaataaaatccctgaacgagaaagagggaatcataaagggatataagagaaaatggtgttacaaaagtcaaagaaagatttccaggaaataaattgtttataatactgattgccaatgagatgtcggttgtgataatgctagaaaatattcacaagaaggagccactggaagtcactgtcaatgttcagagaggaaaagggaaaatcaagtttcagtggaataggaagtgattgagacaaaaagaaatggagagtctagagatttgtctgaaaaggagagacagaggatgatgatgatgatgatgctgagaggagagctcaaggactttttagttttaatctgagcatattatcacattgcatgcaggaaaagagctgattaaggagaatatgtacacaagaaaatggggaataactttgtaatagaaattttagttaaaaatttccccccaaacactgagaaacagtatatatgaaatgctaaagtaaggcatcaaaccactaagatgactgaattgttgatttaggtttcttgggcttcctcgggaccattacgtgggttccttgcagtcacaaggcatgaaggactggttcctaactcataccaaaaagccaatacttgtgtacatataaaaagtgactttctagaatgtgtcagggccaaggatatgtaaggattacctttgaaccagatagggactacaactgagaactgttatacagtcattctgactctggccttaggctactggcctaagcagcaagtggactgcttaggccagtaatgagataaagaagactatggggagtggactccaggaaaccaggagtcacacaagtgcaactcacagcatgggaggtcaatggaaagtacccagctgaggagcagcttctgaagagcccacagaaggccccaagaaagagccagttttaagcatataacaggactacggggcataaagcctcttaaaaagaacattaacaaagtaagaatatcccacatttcttttcctaatgggagaggagagagtaagaaattaagactaccacattccccttcctgaaggcaggaaacctgcctgcctgcagcgggagaagcttcagcttggagaagagtttagagttttgattattctttagggctggcttactactttatgatttattatatgtaatttaaagtgattaggtttttctactacctgcaaatgaccagaaaagtcatgagactgcttagagctctacaatggtggtagaatgaatgcaaaggcgcagaagaacatagaaataaataatgtacaaatcacacttatttggcattctggcacatttggttcagtaagttcccaaagaagtgtgagtggatagaatccacatttaggaaaattgaccttgaatagcacactttcacaaatgtggaagagaaagagataaaaatgagaaaagataatgataaaatttagttggaggaaagagctaaaagaacagaaataaatgaggagaaatttgacttgatgagccttttctgtgggaattgatgagcttccattctgtgagttaagagtcctggtgaggcagtgattagattggaagattaaaaattgagagaggtttggaatgaaacagagtagttgttctcaaagtgtggtccccaggctagtagcatcaacatctcctgcaaaattgttatacatccaactccttaagtctcaaccagacttcctgaatcagaaactctaggggtggagcccaacaatctgtattttaacaaaccctcctgatgattctcctgcacactgtagagtctaagaaccactgttaagagtttagtgatttaaagcacacgttctgtgtttaaatcacagcactgccgcttattgtcttttgcaaattactaatatttaacctctccttgtctcagtttcttcatctgtaaaatgaggataactagcaataacatactcatagtattcttgtaaagtctatatgacccaatgcactggaagtctttagaacaatctctagcatattgaaataataattaacaaatgtgtattatcattgtgggaaaatggaataaatttctaagtatacatataagaaaattgtagttctgattagtctagtgggctgtactttgtgacaattgcccgcttagtagccaagactctttgttttagtcccttgccacaagcctgtccgcccaggagtcctgttgtcttttctttttctgcaccatcttcagcagcataaggctattttgatgaatgaaatggaggaaaggaggaagaataaaccaagaagcaaagtaatgtgtgcagggaaatccatgttgaattagtcaagctctgaaggagtttcgaataaatatatgataacaaatttttgaggaataaaattatgtggttttttttttggaaacactttaaatgtttctttgagaaataatgctaggaagccacatcaaatatagtagcctggtaaaagacaaattctgtgttatctagagaatttggtttccagtgcatttgaaagaaatgtctaattaaattgattatattttcatttacttagatctatatggcttcattatcaagtatttaatgatattttccaagacccaaataatttgatagtaataatgttggctacacagacgagccatggtagttttatgcttattattagtgataaaaccacattcaaaagtatactatttgtgtttttctggttacaccctaataggctgaaaatatgtaataaaataccctaatgactacaccttgagaactaaaccctattctaattgctttgatgcatgggctagcaggataattgattgacactaagaccactcagtaaacagccagctaacagaattagattaatgaaaacatatggtaattacaactgtgcagaacaacttgaaatctacaacgtagcctcaggataaataatcaaaagtctgatcaaagagcaattaaagttaataaaagtctcattgtgcatttaggattaagaagggctgaaagatgaaactgtaaagttttagaagggtatttgatgaaagatttacttcattccaaaaaaaaaaaaaggttttgttattctggagtaataattgaatttttgaaaaaggaaattctcatatgttttttcaacattgcttaagaaacatttattttaggactcttcatactacattggtatttttataacacacatttacttttacttaaataagtaagtccttgaactttgactcattcattcttctaacaaataattattaatcacttactatatataagtctccaaagagaacatcattgagaaaaggtaaaacagtcacaaatcctgacctttactattttagtctagtggagaactaaaatatgttttttaaaaatttgtgatttgaggtgggaagaggtagaaaagatttttagaaacatatgaataaaatatttgaacaattaaaaggaagaagtgattacttttgggggggtgcttcaaagaaagctttaagattccttcctgagtcttttaagtttgaagaatttgttacatatgttggcaaagataggaatgttttgctttacagtacttcctacagcaggccctattttctgttttgtcagtcctagcatatagtctttataattgaaagcatatatttgattttatagtcttattgtcttatttcctagatggatgaaactagaagtaaagccatgggtcataaatcataaatattaggctttcaagtcttactttgattcaagagccaataacccttttctcacatgccaccctgaatatttattattacattcaatgagttcaaaatacagtagtgacccaaggacacaccagtctagagacagagagaagattggcttaattgtgttcacatgtttctagggctggggtctgtggcagtgtcagcatcgtggaaatggattgtaaccacttttgtaagatgtgcacgtttacacttacagttgtctttaggtaaagtaattgtctcttcttggatgccttgggctaagtacaatctagtttatgtatcaccaatttggggcttcagggaaaatagggagtgagttcacctggatatttttgagtagtctcaacactggggatctcttccaaatctctcctctttgcccttcactcctatctgccacctccctttctaatcaatgaagagtggttgattggggaagggagctctgggaaggagagaatgacaagacaagaattattatatcagaaaaagttgacagtttggtgctgtgcaaaccgagggataatattgatcacagaacaaaaatgcaattgattttcaaggaaggtgaataccttaatactaaaacttcaaagtgtaatcgttctttgaagtatataaagatgagtatagaatctcttttaaaagatgagaaaattgagattcagacagggtatgtgacattacccaagattgcatggcatgggtgagaaattatcttgagataatactttccaattccttttttagtgcattttttactcagaccaagaatgcccagatcttcactgagcaccctatcaactccctcccacactatcattttcttgccccactcattgccctttatcatatttttggtggcatttttatgttcctgttattatatgattgattttctcatgtgtgagattatttagtttctttccactagaaacgaagtttcttgagggcagtcatatgtcttgttcactaatgtttctaaatctgattaccactgctgtaccttcagcacctaatatagcattggtagatctgcaatatatatttactaactgactatttatctactatacaaagtgggctaggtggttataaatcagagtaatcccaactgagtgatatgcactgtgtacaattggagttgtggagataacataaatattctacaactctacattcagggtttttattacgttattcaactatgttgcaaaatgtattgctctcctcctttcctgaaaaatgtccatttaaactacaccacaaaattttgcatatatttttgtaagacatttattgatccaaggtattcttaagtattggctataggataaactattctacaggcttaacaacacagactagctaagtacaagattccattctataccctggggagtacaacaatgaatgtactatggtccctggctttgggtagctaatagcctaattgcgtgtaaaactcattgggagtaacaggatcagaattttggagctattacagacaatgtactgatgaagatgtgggtcagcatattttagtgatttaaccaatcaagctggaggtaatagtagagctggaactgaaacccagattctctggttctcagtcagcatttttcccctaagtgtttatgagttctagttattatttttgctgattaactaccatgaataaatgtgtcttaccatgagcttgtttctctgattgtcttcatttcattttgtttttctgggctatgttgaagagcatgattctacaagccaatgattctttccctggcatctgcccttaaggagtctatgacctttcatgtttcttagctgtcatttcctcatgcacacattggcagttctatccatctttcctcacagatactttctaacctcttaataatttgatatttttagcctcttgccaatttactcagtgtgtatattttcacttcactgacttgtatctaggttcaaactcaaccttttaagcactacagaaaaaaatggactcagtcattcatttttcattcattatttcattttacaaatatgaatgcctaccatgtgccaggcacaatgctaagtgcagcagatagaattgtgagcaaatagtcaaagtacttcttttataaagactactgaagtggaggaaaaagatacacacacacacacgcacacacacacacacgcacacacacacacaccatttcaactgtgacaaatgctgcaatagaaagatattcatcctatgtgaacctatgataggaatatttgacattgccaagtaggtcagaaaagacttctctgagaaaataactttcagttgaaatctgtagtatgaccagatggcagttaagcaaataggagggggaaacatgtcttaaatgggagtggggatgggggaagggcacgtgcataaacactgtaatgtgagggatcatggcgaaggacagacaaaagacaagtgtaattgtaggtagagtacaaaaagtgaagggcaactttatctgagttgacaaggcgggtagaagttggaatctgcaggatcatgtacaatacgttaaggagtttcttaagccccaaagaaaaggtagtcactgaagattttaagcaggaattaacaatttttatactagaagacagaggttccaaggatgacttcaacaagccggcttgtgatcctggaagtctagtggtgctatttattgacctagaaaaaaaaatggacaaagcacaaactctgggagagtgagggaaggaaaatcgtgcattcattttggaccatgttaagttggagatgcctttaagatacccaagatgagatgtaaagtaggcagttcattaaactaatttggaactcaaaagagtattatggcctagagatataactgtatgactcagttgtgactagatgataattgaatctgtgagcttggatgagatcacttcgggagaaaacatcaagtgagaaaaggagagagagctgaggagcaaccttagaggaatgtcaacattttgtggcttgagggtaatgagaatggcaatagagtagtagggagaggcaaggtaacaacaggaaaacgaggagagaattgtcttgaagccaaggggagagaaaatatcaatgatgtcagtgtttatgagagataaggaaaagataataggtcatgactaccttgtttcacaaggaacaaataaatggttttattgattcagggaatagtaatgtctagcatcagtctgacttcatttaagccttcatcatcagacagtgccactaaggaccaaatgtctcttcctttctgcctcctttggcattggctctgtctttacttgtgacaaattggataggagataagtaattatgtaattatatattggtgtaaccactaagatgaataataaagagaaagagcagttttggagggaaatttttagtttagttatgggcatgctaagtttgcaagatatgcgaagatccaagtgcagatgttgagtacgtagataaaattaaagaaactggtaaatgaagtcatgaatgttcatggaagtacctatgaaaacaaagaaggataagggggcttagcatctggaattgagagacttcagtatttaaggagtgggtccacatggaatagtcaattaataaggaccaaaagtagcagtcaagaagaagaaaaatcaaaagaatgtgatgtcattaaagccaagggaagaaaagcattcaagaaagcagtggtcaacctttgtcaaatattcctgagaatcgagtaaaatgaggccgggcatggtggctcatacctgtaatcccagcattttgagaggcctaggtgggtggatcacttgaggtcagaagttcgagaccagcctggctaacatggtgaaaccccttctctaattaaaaaaaaaaaaaaaaaaaaaaaattagccacttgtggcagacatctgtaatcccacctaatcaggaggctgaggcacaagaatcacttgaaccctggaggcagagattgcagcgagccaagatcatgctaccacactccagcctggatgacagagtaagattctgtctcaaaaaaaaaaaattgaatcaagaatgagtaaaatatctattttaatgagcaactgagtacattggtgatcttgtctggagctgtttcactgatacactaaggacaaaggaggtaagtagtgggaagggggattaagtcagattagagtaaattgaggagtgaatggggaagcaagaactgtggagggcttggttagcaaagtagataactctcccacaagaacagattgtaaagagaaatagatagagcaatagctaaaggaaaaagtgggataccaagaggtgactttgtttgatgagaaacacctgggcatgttaaaggatgataggaataatccaaggaatagggaaatattaaagatacataaaatgaagtattaataagtgggaaagaatgaaatttagagtacatgttttacaaggtgagcacaaggtgaaagttgattattaagtgtaagagcttattaaaataatggctaatgggctctagattgaagagaaaaggtgtgaggataagaagggaaaatgggtaagaggtaaaaagaagtgacaatgtgaagacaccaatgagactgacaacagctatggttagtgtaattgagcaccagtgtgtaaagtatgatctggtataacattaatagcatatgctaagcctggtatgcagtgcagaatttttcaagattaccagtcttctgaaggttactggatggatacattattttcctgtatatccatagtatttttgtgtcattattctagtcctatcaccatatcgtgttattgactgcttgtgcatgtatccagatgagtagattgtgagcccctagagcatgtctttgagcctaccaaagtgttttatatataagaatactcaacatgttcaatggattgtggtaaaattttccatctggcaccttatcaataactgtatttatatctctgtggttaatcttcagctcccaaatggtaacagtagcatgcacttgcttccattctcatcttctggattgaaacatgacgtattaagaacctgaaggttttgaagtagcatggtgtttcccttgtttaaatctacttactcaatacaaatacactgggttgtaccagccacttatgcctcttggacaaaattaagtcactgaaaaacaaatttgaaaaattattctaaagcattaacatataaactccccattaaaaatattatgtattaaataaagagcaaaaaatgtatacactgaacaaaagtaacattatcttaatgtatgttctttttaagtttacttcatgttattttcagtttccattcatattttccgttatttaatcatagtatatataaaatattatagcttatttcactcttcattaaatcgtaaaattattccatgttgctatatagtcttttatgtctatcatttttaatgactgcagaaaatgtcactgggttgatgcatgataatatacatggccattccccttttgtttgacatttagtttatttctattttttcctcattataatagtttaacgaacatctttgggaatatagttctttcttgttggattgtttccttaggatacatacctatgagtgggattactgatcaaaatataaagacacacatgaaagttgatatgttttcaaaaaaaacattgtataatgacacggtatcagtgcttcaaactcatctcatctttgccagcatcaggtataaaaatttttactttaatatatatagaacagcacctctattttaatgtacttgggcaggggtgggaattatttcaaactcatgtgactaatcctccaaaatttgagtactatgattgacccatttatattttgaggaatattagttatatcttatccatttgaattttcttttggagaaattaatactttgtaatttgatcctttgatccatattttttcagtccagactttcccaattattttagttcagttatttttattacatacaattctacataaaatattttcttacataaatttataccaaatcctaataatagctatatgtcagaataaattagtagctgaggctgtgggcactggagtcacaagaaacttgatttgaagcccaactctgcctctctaattgtcctcctggtgacataatcctctgggcttcctcatgtgggaataagaataacaacagcatgacagttgtgtgaggactacatataaagtatttaaacattgtgcttaacaatattcagctatttgttgatttagattatcagccaacccaggataactgattttattttatttttctcatcctcctgtagattcaccaaattttcaaattgatagtatttgggtggtttcacagcagacataaaacacagaatggtaaaatgtttagtaagaatattgaccaaataaatttccgtatgaagttggtttagctggaagtgctggaagagttgaggtcatggctcacaggtatcactgatgtaacacgtaactccaactatttctatattacattaaagcagggatcccattttatctggtacattacatttgttgtttaatagcattggctgaatatgtcttctatttcttgtattgctatgtaaggccatgttgtgatacgctgtttaattttgctggggttgtatttttatatttgtatatagagaaatatcttatacctatataatagtgtttcctctttgtgtagtataattcttcatattcatcatgataccaagtatattttcttacatataatcatattctaacaataacacacatatttatactttaccatttaaaaattcattttactaattttcattttctctttaatatatgttgcctaacttaagtaatatgtgtatgagtgttataatctagcaatcaacttccaagctgctttcttttttcttcaagtgaaatgattttaacagctgatattttttattatatttatgatttttgaagtacactagctgtcacatttgaaaaaaatctgttttgatattaaactcaaacatttgaggaatagaaaacatatagtatccttaatttatgagcaaggaaactaagatgtcgcagcattaattgacattttgtatggtcttatgaatataagatgaaatgactagggctagaacttaggtctctaaccatcagctttattctaaccattaacgtgtgcctttctttggtttggtataaatattaactccaggacagaagcacttttgtttctgaggattaaaagaaaatacttaattctgttgagaaacataccaggaagctttatctaaaataatagataaaaaagtaattggataatttatattttaatatttaattattacatatttgctttttcttgagacaaagagaaagaataaggctgactaaaaaacaggaggaaacaatggaactctcctagcctctctagcattctaacttcaccatgtgttattaaatgcttggtccatagaaatacagaccttatagataaggagccagagtatatcacggacgtaataaatttagaataagggcagttaactctataaggtgaaggattattgatcattctggagaatataaaagtttaagaatgaaaagcagtgaatggattgatggtcacagctaagtacactctgtgtcaatttctgagtcaaactttttgtcatattggttaggttgatccagttttcctttctgtggctgctgctgtgagtttcagtgaagacagtgcagacatgtaccagaaacatttaagtgccttttgattgtagtttacagtaaaacatatcaggcccaaatttagggtcttgtgttacattgtggctaaaaaagttttgttgtgtgccaacatgaagcatctccatacccaggtccctatcttagaaaaggtaccaatcattagacaaatgagtagaatgtggatagtcatctaaagatcatagatagaatgagtatgatagagttccacattttttctcataaaaaacatttttattccatttcattctttttctctcaaggaaaaaatactaatatagaataattaagtttaaaaatacaagttttcgagttcttctgttttttcttcattattttgggtaagttatcatgtttctcataagtattgttaattttcttttagttcaccttcatatttgaagggcagcacattacttagtcttacttgggcactgtcaattgccatgtactagtcaatgccaaatgtcaaatgccataagctagaagtaacttgtaattatttgcagatagcataactccaggatacccttttctttaattttccctaatcagttattgagttggatatatgggctgtaagtaaaggagtactgatcccactgtgctcaggaaatgcttctggtcgagtccagcagacacccaaaggattagtgcagaatttccttaaacattttccatcctgaatcagagacatgtgtatccttgtttgaaaggcagattcctgagtccatcccagacctactgaatcacaatctctggggctggattccaggaacctaacctcagtgcttgtctctctacctactccttgatccttatgctccagcctcttgtagtctctgactcgtgcccagtatgtctccattagaaagccatgcacagctcttcctttgcctggatctcttattttccaactttctcatgaatggttccccctcattcaggtctcagttcaagtgtcaccttcacggagcagacttcataaactccccaagctaaagcaacccccatcctcaccataacattttctatcacattaatatgttttattttttaatgtttagtgtctgtcactttttactaaaattgaaactccactagcacaatagcttttctctgtcttattcgctgatatatttgcagaaggcactccaatacatacttgtggattaactaactgaatttttaaacaaaaattcaggtggctgtcacatgccctcaaatttggcaccacagggctagaggatgtctcaggacgactagcatatgtttctcaattaaaagcaaaacaatgtgatgccccaggtgattttaattatctggttaagtggctcttctccgaggcaaatcaaatctaaggaaacctccaagagtacttaggtatatcaagaaaccctgtgacaatgtgaaagttcgctgagctgggatggggaccatagctttggctcctgcttctgctggcttattatgtattttccttgggccaaataatcaaagattatggacttcagagttttgttgagatgctttacttctaggggcctacatatctgcatatctaaaataagagaatgagactagattaatatttcccatactaggttctacaaaatgctaattcattgagacctaaacattgactccctagaaataatgcaagatatttcaaacgctcatatggtcaaaaaattcaaattattctgtctctttctgtcttggagattcaaattactatgtctctttcttaattggagattcacaatgcatatttgcagtgctaaaatactaacaaacttccaggaaataaatttgttcacacttatttaacccaacatttatcaaacttatctaatcacagcatttgttttatcctgtacaaactatgaagtagtattccacaaaattcagcatgagaagtgctgaactagattatctcaatgctatcttgtggttctgagggttaaaaattgcctgttgccagctgggtgcagtggctcacatccgtaatcccagcactttgggaggctgaggcaggtggatcacaacgtcaggagttcgagaccagcctagtcaatatggtgaaaccctgtgtctactaaaaatacaaaaactagccaggtgtggtggcgtgtgcctgtagtcccagctactcaggaggctgaggcaggagaattgctttaacccaggaggtggaggttgcagtgaactgagatagtgccactgcactccagcctgggcaatagagggagactgtctcaaaaacaaacaacaaacaaaaattgcctggtgccaaacttcaaggatgtttgctatctcttctgctctagaagctctgtaatcccaatggggctggcttcacatctgcaaaatagagaattatgacgatttgaaactccactagcacaataacatttctctgtcttattcactgctatatttgtgaaatagagaattatgacaatttgaacctttttgctttcaatgctgaaatcactggtcagcattccctaggcttggagtcattctgtgtgagatcaacccctttttattagagcctgtacctaccaccttctcactccatccaggcaagtcctgggtctcaaaagctatgcaaattctaagggattcaggccaagagaacttttatcttggtagcaggaacccattctagtgccaggagagagactaacagaaagcattttggttttgtctatagaaaatatgcattgagtaaacaatacaaggaattttaaaagcttctctttgaccatcactggcacaatattgccgtacatcaggtaatttaaatgattctgcaccagaaagttcatgtacccctgaagtcatacattttgtaataaagtatttttaaaaaagaaactattgtgtgggtgcactgattaacgcctgtaatcccagcactttgggaggcgcaagcgggtggatcacttgaggtcaggagttcgagaccagcctggccaacatggcaaaaccccgcctctactaaaaatacaaaaattagctgggcttggttgtgcatgcctgtaatcccagctactatggaggctgaggcaggagaatcgcttgaacctggaaggtggaggttgcagtgagctgagatggtgccactgaactccagcctgggcaacagagagagactccatctcaaaaacaaaaacaatttaaaaaaaagaaagaaactattaagatctgctgtgatttgaattatagttccctcaagactcacatgttgtaatcctaatgcccagtacttcaccgtgtgactttatttgtaaatagagtcattgcagatgtaattagttaagtcgacatgaagtcatacgggagtagagtggatccataatccaatatgactggtatccatataaaaaaggggaaatttgggccagacacggtggctcacgcctgtaatcccaacactttgggaggccaaggtgggcggatcacgaggtcaggagtttgagacaaggctgaccaacatggtgaaaccacgtctctactagaaatacaaaaattagctgggcatggtggtgcgtgcctgtaatcccagctactcaagaggctgaggggaaggagaatcgctcaaacccaggaggcagaggttgcagtgagccgagatcgggccactgcactccagcctaggcaacagagcaagactccatctcaaaaaaatagtaaataaataataaataaaaaggatggggggaaatttggacaccaagacagacatgcaccaagggaagataatataaagatacacaggaagaagatgaccaagaaggaactaaccttgcctaccaacaccttaatttcacacttctaacctccacaaatgtgagataataaatttctgttctttaggctgcccgcttcaggtgctttgtttcagcagccctagcaaactaatacagcgtctagatgctggaatcaagtctctgggtcctgcatagaaatctattcaattgccagctaaattcctccttccagactaccaaatgtttgagtagactcgggacacgacagagcaggacagtgaacaatcttcctcagaccactttatttagttcttgtgccctagagtagctggtttatctcaagtcttggagcagatttcttaatgacattttggtgaatcttcctttactgttctagtgtattttgtttcagccataataagcagagactggaagaaattacaaatatttggaaagataaaaggcaatgaaattactttgaaacccactttgtacagccctgtaagcttgaccaggcaacattttgggcaaaactgcctagatttttaaagtggatgttagaaacaggtaatatagaaaattgaagtgaatcttccctgaaattactgctaccattaccactcttctttgaagaccagtctaatgcaatttatacctcttcagcctaacactaagaggtcagagctttaaaatggcacttgtaacaaagggaagagtcaaattgttcttgtcactaattagttcagatgttatttcaaattcactttggctctgttattgactcaagaaatcaagatctgaggaaatcaactgtgagaatgttacaaacagggaaaattaggtcaccatttatgttttgcagctagaaaaggaattcattgcccatgtttaacttctatttggcactaatctcaatataagagggttgacaaaaatctgaaaataattataatgtgaaaaataataaggcttgaatccaaaactttgtgaaaattagagccacttttttctctgtttatagtttctatctcttttgatccagcttaccatagaataataatatcatcatccacaacaccacaattatcaccattaacttcattttcaccaataaaagtcactcggtacccttctgaaactgtgcaaaggcaatgcctaaacccagttctgccctgtagttatttttagttgtattgagaatatgccatactgtggttcagttggacttagcaaatgacttaattctttttggcatttttcggtaagggagacttacttctgaattctcacttgtattgacaactaatgaaatggtcagttgtagtcatggctttactgtcaaatattccaaatgcctttccttatcaatggcaatattttaaagtgtattctcattttattaaagctagtagtttggtactctgatcatattacttgaacaatataaagatgcatagctacattttgggaaaactcgccttttttctatcacccaaaataaaaagattctcaattacagaatatgcccacttttaaaatgtagcttcatatacaggagtacatttcttatttaattttcaaatatataatatatttggggacacaaaggccagtgtaaacaagaacaagtccatgaaatacaacccgtctataatctaatagccctagtcaggggactagaattggggcctaaagccattttacttgtctttatataagaagagttacaacaaaaaccagaccattgtttaaatgctttttctttgtatagatacaggttttgtgtgtgttagatacaagctcattctaccaaaatagatgaaggtacaaagtttttcattctttcttctactatgtttatgtcatcaacaatcctttgttaataatctgatttttttaagggtttcctatagccactacttttagtccatttcaggatgcatgaaggaagatagcaggttgctcagaccttaacaggaagaatagggtggcaaggccctaccttttaagcacgaggctgcctatcatgacttctaaggaatactgtttgtcccaagaattattaataatgcctcctgaaagaatagctatgcaggcagaaattaaccttctctcttctactttttttgctccctgcttaacttcccaaaattccatacacaaatagctatttttttaatctccaaatattttttatctagtactttcttcaattgaatggattgatcctactttttcttattaaatgtccacttcttattcttcttgtctttaataccactactctctcctaaacaccttatcaacctccctgccatctctacttaccatcactgtgatattatttaatcccctctcaaccttgttctctctttttctgttgaccaatccacttttgttttacatacttaggatgctgaaggaaagataaggtaggagagaacagctagcagattgagaataattttgatgagttgacacttaatttggtaaattcaccagactttggctcagctaatttcattctgtcacatctctcaaggttgtcactcattaactaagcccacagagctcaagggataaggcagttgttatctctgaatgagaaacctgacagtcacatcaactgataaaacagcatcagcatgacttacacattccttaccattgggcaaatctacatgggaaatcgcatgcttgtactcagaacaatctaagtcagttttttaaaaagaagtaatccttagctaagagaccttgaaaaactcttgtccactataaagataactttgaccacagaataataatactccaaatctttggccaaaatttcctctcccatgggcaacacttgaatgtggaaagtcagggtttatttttctttctgatgtttctttttctatacttccatgtctgagaagcctcctttaggattaatatatttttaaaaaattctgatgatgcagtgaatcaagtatagtccaatctaggagtctcctgtaatgttaatatgactttgtaaatctctgatctcactcactataatagatggtgttcaacaaaagtaatagaaaatcttattcacagtggcttaaactaaaaggacatttacaaagaagactcatgggttgcagtcttaccgcaggtgcatcaagtagcttaattatgtaatcaaagaccttctcctcccacccttccttttccccgtgctcagcattttggcttcggtgttgatgactgtcatagcttcatgtcctcagagaacagcacacaaaccaagaagggagggaaggggccaaaagcctctctcatctcagagcactctcttatcagagccatttttgcactcaagctcttccttcccagtttacttctctgtgggcatacctggatcaccagctcacttacagacagatagaagaataaggttggcatattggctcagaataatcatgatccatcctcagcagctagacacattgttttgggtagggatggatgatgttgttgccttagtaagcaagaagtgggaatggctgttaaatagacaatcaacagatattatcacaccatactctgttgggtgattataatagtcttaggctttacccaaaatctattgatcaggcatctctggtgttgaggatcttcatgtaaaaccaaaggagaattggtttgcaagtacttagggtgctaggcaacctcaccattttccccatgtactgcttacagtacctttctcaatcaaaaagttctctacaaattctgtttgttgactattttctttattctcctaatcttgattgaagacacttacaaaagggtaagccaatagtacctcatagagaaatacattttgtttgatgcaaacatacttaagcttgcaacttatttgaaattttttgcaaatgagcatgcaaattttatattactatatcacttgcgtaacaattccagttaacaatcatctatctttttaaagttttatttttcagagggtcttaatctattttaaatatcatttgatgcagccagtatcctgaaaattgtttattggcaacttgattattccataattataatggcagttctagcagtatgtgccttcttcagataatgtcatcataatttaaagagaaaattagtaaacaacccacagctgttttggtatgaaatgtgcatgcgtagttatgaatattcatattcataaatattttatcctaatgaaagatattaattctatattttaaaagaaacaattgtaatgggtattagaatataaaactacttgttaagattgtgtttcattttcttattaaaacattttttctaaacattttaataaactttatttttatagaagttttaaactcacatcaaaatttagcagaaggaacagagatttcccatatacccccatacatgcagagcttctccagttatcaacatttcccacagagttgtacctttattacaattgatgaaccgatattgacacattattatcacacaaagtccatagtttatattagggttcacttttggtgttgtacattccttgagtttcaacaaatgtatgacatatatccagtctgctaatatcatatagggtaccttcactgccataaaaatcctgtttgtgccacctgtttaccccttcattctgccaatagattgatttttgaaatgttaaaaaaccttaataattgatataatttaatagaaaatacctttacaatcaataaaaacatattatctatatgacttttataccttttagaaattttatatgatttagtattcctcacttaatatgaatatattcaatgacaaaacattgtgtgacaaattttataattcattgaaaacctctagagcagggctgtcaaattaaattttctgtgatgaaagaaatgttctatatcttccctgtcgaatagaatgttactagccacacgtgtctattgagcacttgatatgtggtttgtgtaaccagggaatagatttctcaattttatcaagttttaattaatttaaatttaaagagtcatatctggcttgttctactatattggatatcacagatttagaaggaagtacaaagtaggagaaagaatacttcttctttcatacctcattgaaggctccgtatgctccttctcagaatatggagatgctctttaataaaatagtctgcaaacatcaggacacagaagaattatctggagaacttgtgtttttttgttgttgttgttgtttgtttgtttgttttttgacggagtcttgctctgtcccccaggctggagtgcaatggcgcgatcttggctcactgcaacctctgcctcctgtgttctagcgattctcgttctagcaattctcctgcctcagcctcctgagtagcttggattacaggtgccagccaccatgtccggctaatttttgtatttttagtagagatggggtttcactatgttggtcaatctggtctcgaactcctgacctcaggtgatccacctgcctcggcctcccaaaggagaattggttttacgtgaagatctctagaataatgactttcaaacatatttgcctttttgcccacaattcatagtaagaaacagatttattgttacccgcacacacacataatatatgtatattattcataagtatacatatatttttatgtgaactctgatcctttaaattacattttactttatttcatttttcaaaatctggtagtgatccactaaaatgtgtcaggactcaattgaaaaaacagtgtgctcaatagccataattgaagctgcacacaggactctagggcagagatacagaaagaacaaattgagaaagtcttttttttactccacccctttcccatggctaagaaatgtctgattcaacaaagtcaccaatggctctttttttctcttaaatgattcaagaataaactacatatttatgttgtaactgccttaaaaatcaaacataaatgtcccatgaaagaattatttttataagtaaaataggcttatctttttaaagtatgatgttgattttgtccaaaaatagatgttgtggtgacttttcatgctgaactgtaagtgagtagttttaaggcactctagggtatgtaatgttagtttttaatgtattctttcatttttatagacccagaaaagacaagaagatattaagagcacacatatagtctataagtctgttcattgtatgaacctaaatatttattacagactcttatgccaaataatacagcaatatttgtgtttatttgtttaaaagtaacctggaaaagatttccgtttacaacaatcttagtctactttttttctcctgttggaatggatcttaattttatccatgtgggttacgaatctgaagcaattaaaattaatgattgtgtggcgtaatagtacaagaggctatttaatccctgggggataaatggttcttcattattatttattatcctcctgtttcttgttaaaatatgtaaataaatagaagagggacagcttacaggcattttcattatttttttatgtcaccgggacacagtttaatactctcgttatgcgtggtctatacacagttggaattctgtattcagtgatataacagcttcatagaaatgtcttaaatgtgttgtggaagcatgtaaaccatcttaaagatcaatgcctcatgggtttatttgtgtgtggccaaagcaaatcaccaatgtagttgttcatgttgccatttgcagtttgtaaaagacatgccatgtgtgcactaaatagtgcattttcggctagctgtatttgtagcacaatgtcagattgaatttggagatatgattcactctctttgttccagagcagatacaaattatcatggcatgaagtaaatagagctactagtggttaggtcagatgttaagaatgatgtgtgtgtttctttgtgtccctaagaatgctatggtaacttttggtcagtagatggagttgcaggtcccagacatgtttgttttcttttggatactttggccttattcaaaacagaatatagatagaaagatagctagatagatgatagatagatagatagatagatagatagatagatagatagttcaggagccaactaacagtaattcagtttttccattcattaatttaataatgaagtacatatatatagtgtgtgtatatatatataaatggtatatatgtatatagtattgtgtatatatatattttcctccaccctgcacaaaaacaaaatgtatacatacatgcatttggtatgtgtttgtgtatttatatacatatacacacacatatatgtatatgagtgtgtgtgtgtgtatgtgtgtatatatatagtaactaggaacccaatttaaggcaaattctttgtcgtctcatattatcgtaagtaaatattccagatcaatcaatataagtagattgccataaaggattttgaatgtttaacttttatggaaaaataacctaaagttgaaaaatataaagtttaatacttcacttaaaaattgtaaaatacagggtctcactctgtcacccaggttggagtgcagtggcgtgatcacaactcactgcagccttgacctcccaggctcaagtgatcctactgcctctgcctcctgagcagctgagactacaagagtgcaccaccatgcctggctaattttgtattttggggggttttgccatgttgcccagactggtctcaaactcgctcaggctatctgcctgcctcagcccctcaaagtgcggggataacaggcacgagccactgtgcccagcaagtactggtggataattctcagtgagattttcttttgtatgaaaattttttattttaaccttgagaaaagcaaaaaaaaaaaaaaaaaaaaaaaaaaagagagagagagagcctaattagtaatgcattagctctattttaaaacctattaaaatttagttctttgtcttacatctgatggcaaaattttaagctcatgcgtgattcatgcctctcttactgtgaaacattttgtttagcaaagatccaggcaaaattaggtgacagcattaatcctttatttctctctactagcgtctaattttttgactttaggttagaactgagcacatgtgctttggctgaaggctactgatatttttgtttttaaacttctgaacagtttttggaacaccatgagcattttacaaatgtcagataattacagtactacaaagtgtaaggcaagaccaacaccaacagcgttctagaagaaatgtttgaaactttacccttgcaaagaggaaacataaggagaaggatgaaagctaatggagttaagcaccaaaccctcaaaaactagtagatatataaaaaaaatggttgtcagtgtaagtttctatttgtctcccattctttacacacctgattttgtgaattttcttgtaccaaagaattcatttttcctgctgctagtttcttaaaaattatccagcctgctagcccgaggtttgcaatgtttgcttgcatatgagagaaataaactaaagctggttaagccaagaaacgttttatccagagattattcaggtgtcttgaaacctaagagccaaaattcaattgttccaaaggaagaaactagagccaggggcctcaagcctagtgaactatttgccatctctgctccctgcttctctctgtccacctgcctcattctcgtctctgtagactggctttctttccttcacagggacatggaagaaaacatggccactcctcagttcttgagttatatgttacaaatccagctgcataaagggggagtaaatgaatctctatgaatcctaatcccaaatttttaaaaaggagactgagctgaaataggtcaagtgctgatcctagtccaatcaaatatgtcaagatggtatcccactgtacaaatgactacagaaaactttctgccctgagtgaagagggaattagggaaaaagtattgtgaattgatcagtcactccaaaatgccccaattagtgttagactttttttgttttttttttctttttctttcattcttttttttttttctttccttttatttttagctttttttagagacaggatctcactctgttgcccaggctggagtacagtggctccatcctggctcactgtagtcttgaactcctgggctcaagtgatcctcttgcctcagtttcccaagcatctgggactcccggtgcacataccatactcggctaatttttaaattttttgtagagacagtgtctcagtatgttgcccaggctactctcaaactcctggctttaagctatccttctgcctcttcctctgaaagtgctgggattataggtgtaagccactgcacccaacccttgtgttttgtttttaaccataacaatcactttagtttgttttaaaatatcaacaaatatttattgaaagctcaaaaacagtagagtatcagtctaagcattaatgtatttctttgttgccatttttcaaaattacaagtaagcttcaaaattatgaatggtgccagatagaaaactcctaattcctgcttctattcagtggtggtaactcagcatctataatttacataatggtttcttgttagtccacatgtttaaaattacgtctattttaagatccttgctgtatatatagtgcaaggacatgctgttttcctgaatcagtgcttcccaaactgtctggtgcctcagattgacctggagaatttgttaaagcacagattgccgactcacacccagagtttctgaaccagttagtctggagtggagcctcaagaatgtgcctttaccagtaagttacgatttggtgctgagaatgctagtcctggaccacaatttgagaaaccattgccttaaataaaattaaattgaacttctccaaggttggccagtgaaataaggctttccatgttaaagtcttagttgtaaccactgccctcctgaagttgatcttccctgaagagaccgttttacacactaacaccaacactctccacaacactggcctcaccaagtacgcttgaacatttcaaatcaattcataatttttacctttgttctgagaactacactttggactacttcagactatgtaaacaagggatcactctgaatcaaggggaaattataaagaagagaatatgcaacaaagtaatctgaattacaaactttgtgttatgttttattttctggcaggggaggtggttggggaacaccataagagatgacttctagactatcaatgagactttatgtggaggacaccaggaatttccttggcaaaaccactttaacagggcgtaatataaatcccaaatctatacaagacaatgttttttaaatagtggtttgtgacatattagtgagtgagtaaatcaatttagtgggttatgtcttttttttaatattaaatagaatggaaaatagcagaataattcttaggccaattattatactgtgaaacatgttatacaatataggtcatggtcataaaaatttagagcaaactacattcaataattttttgaagtggatgagataataattattaattatttttgaaacataattatcttggaatgggacttcagtacacttttgtgcaaaatggtgatgatggaggaacaatgttcccaccacacccattctacagccagactagagataatttatcaaacagaggaggcaccagacatccatattaattgatccatattaattgactaggattctgcatctttcaaatatttcaaaactcattgcacttttgagctggatggaacatccagaatcattttttaaggtgacttttaaaatacgtttacagaattctaagagtcttaatgagatttccagggctcatagtccctagtcctgtttgaattaaagctctttatcaaattgattctaagtcttgttgatggtatttactgagctctgactgtgttcccggcaatattcataatcatcccatgaggaaggtagtattatcaccccatttttcagttgagtaaacaaaggcatagtgagtttaagtaaattgctaaggttccagattatattcttaaccattacactataattctcacagcaaaactaccgcagagctcaaaacacacccacttaaaaaatatccttatttattctagccacttaatttaaaagggcttttacaccttactgaagtaaaatactagaaccagattctagtattttggttctagtatctagaaccaatacatcagattcagggctagaattgtgatcttcagtttgtttaatattattcgcattcaacaagcatttgagcaagatcttgcccattgtcagtacactgggcaacatcaatacgagtttctgtatggactgagccatacttgagattagccaaggagatggctatggctaaccttcacagtctgcaaaacctcctggcaggccctcttgttcttactgttttatgaaggagaaaagtaaagcccaacaaggatacatagctcttcgtgtgttacctgttagtgagggtcacaggcagcctttccatcctagacaacctgctttcaaagcagtcattctgttcacctcatccattgctgtttcgttggccaggttccccattgccatattactttgggaatcagaacatcctacttcaagggaagcttttccattcacatggaatttatccaagcttacaacacactgttacaactttaggaggaaacttccattttctttgagtgtttaagtagaggaggtaattcgtaatgttctgacttcccttcagcatgtggctcaaataaattaagaagaaacaataaaatgtaccttcaatgtcaggattcacttgattatgtgtatcaaataaaaaacatcacttttattaaagcccaaattatgatactttcatctcttccttgcccactaggaatttaattgcctagaattcagttgtttcagtcttcaaaacattgccatgtgttaagaattaagtctacttacactgctttcttctcaggaggcaataaaatgtatgagactttattctcataagtctacttgcactgttttattctcatgagggagtcactccctgttctatgactgctcctttcaggataccagtggtcatgctgattccagttatctcaaagctatcaacccctgaaatattggtgtgattcggagctctgcacattattcacttacatgcaccctccaacttcatgctgaatgccatcacttgggtctgaaagtgttattacccattatagtctaataaacatccttttcaaataattccttcacctgctcatcttcagtgtctaaactcttagccgtagtcgcacacaccaacaaaggaaacacacttacttctataaggatcagcaataatcttcaggcatagagcatgctttctccaacttagaaacttttctctacaggagttagtatctctagaaggacagtgaaactctagatgctccataaaataacctctttgttacttgacagaacagatgagctccttagagctacaattgaataaaagtctcatccattttcaaagaagatgactgcttatattctcataatagaaggtcttcttggtggttttcccagaacacaagaacaatttgccccaaaatgatttcaaggagttttcaagaaagctttgagatgatattttttttttccaacttctactcagcaaggctttaaaaattctaggactgaatttcatttgaagtacttggtcataaataacattagaggagttctaggaaatgattttacctttgatacctctaaatatatgttgtaaaaaaccagaaatataatttcaaccgtacatcttgtaataatgggaaaattgctgagacttagatgatacaaataatggaagtttcatagaatatgtttggaaaaaaatactgacctttattctccaaccaccacttcatttttaacaaagtcctaataacattttgggaagctacttcttcatttgcctgcaggaacaatttgtaagacaaaggcatcagtttcctttctagttataccacattttgcccaaagctggtattacccagtgtgaccattattttattcacaaaagtagcttcaattgacctttcaattgaaagattctaaagacctgaatccacccttgaagagtgaaaacatgttactaataagtaaactgggcaaaacatttcaaagtacaacagcattttcaaaagaagagtaaaaatttgcgttaaacaatgtagtaactgcctgaatttctagagtcattaatttgaagaaataacaaacaggtttttttttttctggtataactagatcttgcaaagcccatcaaagcaaagaatcataataaggagttacgtggtggataccttaaacattttattattttgaaacaggcaagtacatattattgtaccaatctttgatgcaagactgagtattttcgtttgtgacttggtccactgatgatggttcctctccttgtttctcatctataataccctgactacagatttccaggttccatttttttagtgtaaaaccttaaagaaaatttctcatcaggaatttctatttataatttttgcaccttcacatccaatttacagcaacttgaatttttccgtaacatttaacttagttttcatagcaaatgctctattcacattcgttttcatctttataagaaataattaatttatatatgtaacaaattcaactggcataaacaatgtcaggaatagttttcgcaagcagacaactccaggtatggaggcaaggtgagttgatgaatcagagcgaatcctaccttcttttggattctgtaggtattgaaaagcagtcagtaggttttaaaaaggtaacagagagccatagttaatccaggaagttgagtaaatcaaggttagttaataaaattttagtattttaattaagaaattatctttgcatcttgtgtaatgtgaaatgtataaagcatcaaatgtgaaagtcacacaatgagggcaagaaggctttaccatcctttgctggaggatggtaaagatgaattcatgaggttagttgaacttaagtaatggatagatttaaatacatacatgaaatgaagagagaaaaggtaagacttgacttcttcattgtgacaacatgtccatatccagacatgtgtcagattagcagtgggccagaattaaattctgctgagtgggcagatgggtggacactggtcttctcctgactttctctgaatcccaggttatcccgggagcccagtcaaggactccatgtgtattgtctatggtgtggtactccagctgagtgcacactgcctgttccccacccacctccacagacaattcaattctactttgcatgttgggtgcaaatgaaagatttaattgtacagagaatgcatcagcaaaagacttttgaaaaaacattctaaaatatttttcatggagagaaagggaagaacagatgagagcaaaattgaaatgggtttttgaattgcaaagctaaaattttctggtttaatttcaaaggtctgaggtgaccagaaaagtgttgggcttgcaagacagactaaacactgagagggtcagcgagagggagattaaatgacaactcagtactagagttagaaacagatttttttctttgaaaaaaaaaaatcagaaaattgggaatagaagtaagttttggataagaaacataaactcacctttagatccatttaatttggtcaatattaattcagcacctactctgtgtcaggaattgaagttaagtcattatgtgataaacttccagaatgcttgcagtcttgagaaaagatcagtaactaaaagtctacaaagtaaaatgtattgtaggggttaagaggatagtcccctgagtcaaaagcagacatatattggtttatattctgcacccatgcatctctgaccttgtttcctcatcaatagagtaatatgtacctcattactatattttgaggattaaataaaacagataatccatgtacaacagttagctgagtatctggcatatggaaagcattggttaatatgatgatggtggtggtgacaaggaaatgggatgatgatgatgatgtacagcagtggtcctcaatgtaattttgcttgttaggggacatttgccaatttctggagatggttcatgtaaaaacatcttataatgtacagaataacctccaaacaaataattttccagtcccaaatgaccatagagctgcacttcggaaactctgatgtagaaagaaatgctatgacatggataaaaagatgccatagaaatatgggagtcatggatgaaagtaggaaaagttaaggtaacagaatcacctagacagatttaaaaaaaaaaaaaaaaacaagattagggccctactcaaaggcatgagactcttatggggaaggaggttgaaatcagtatttttttaattttgagatggagtcttgctctgttgcccaggctggagtgcagtggcacgatctcagctcagtgcagcctccgcctcctcggttcaagtgattctcctgcctcagccgcctgagtagttgggattacagttgcccaccaccatgcccggctgatttttgtatttttagtagagatagggtttcaccatgttggccaggctggtctcaaactcctgaactcaagtgatccaccctcctcggcctcccaaactgccgggattataggtgtgagccaccatgctcggattaaaatcagtattttttaacacttaaaatgttaagtgaatcatttttacttaatgacttgtaatcagtaattactgtaatccatattttttaacacttccgggaatcagtcttttttttctttaatacttctcagatgattctagtggtaccacaagttgagaactgctgcccctcatgaaatagctaataggtagaacaatgtatgaaattgacctttagtttgtatctcttggaaactgacaaatgttaaaaaccacagtgaatttctagtgaaatttttttgcctggcaaagaagtcattctatagcaccccctgggggaaaaaaaaatggagggaaaagtggaggtagtagtaaaacagactggtgctgctccaatttctcttatttgtgactttgttagggtcaggcagctgcaagctattcattgcaagtagaaattcttttatacttgtaagtgaagattttaagctaggtcaggataaagtcgtgagtagtccatttatccatcaattgtcaatgctttagcagagagaaattagagaagtatatagatgacttcaaaggcatgcagaaaagagttgagaatcataccaaaggaagatagcagaaagttgaggatgagtgaggctgggtggcaatgagttaactagaaacaagcttatctttgttcagagagaatctcacactttgaggtggaggagctggaaaaaaagaaggaataatagtgtttaaaaggaataatagtgacattattcagaagaataatatcagaggggctatggacttgcaagaaagtgactattgcaaaggttattttctttttatgaaaataacttatttcactttacctgatatatttggcaggcattatttgaatttaattgatagcttcactgaagcaaagttattaaatccttgtcagttaatgagtggtccatggaccagtagcattagtatcacctgggagattgccggaaatacataatatgaggcccgctaaaatacgtaggtgtattgtacacacattaaaatttagaagcacttttgtaaattatggagtcaagatatacattcaaaccaaatgatctgtggaaactctttatttcatattctaaatcctgcttagcctgaaaacaagtttaaaagattttaattcaatagatatatttttctacaagaataagaaagaatttttaaaaactctaacatatctctctctgtatatttcggtgtacaaataggatttgtttttattttaaagaaagatggaaaattagactcttgaggaaaggacctttatctattttatctgcaaatcctaaatgattagatgccttcccctgggttaatatgataaggactggtatttttttgcaattgaatgtatcgaaataataataattttcaatgcaaaactcagatttcagaagtactgtagtctataatcaaagattatatgtgatatgtaacgcatttaatcagatttgtttgatgaaagcgtactctatagtggtatctattttgcatgaaatcacagaatcttaatgctggaataaactttataagtgagttaaaataatccacatgcagttctgcaatttctttttccatgtctgtggattgggttttgtttttcagtgtcacttaaaatatggttctctgaattgaatcgagcatcagatccacaagcagtgatcacttccagtgatctggaatctgaacttcaatttgtgtagcccaaagattcctgttagctttgttattactacatctttattaacattagttagaatcatttaaaaattatattattaatacaaactatcagataatttcccatgaattcttgctaataggattctctacaaaactaggcttacacaattgatattttgaaagtaaaagcctgtttgtcaagttatccgttgtgtagatttatagtagcttgttagtatttgtcaagataattttgaatcttgattcggtcacttcttgcaacagctatcattccatgttgtgtagtatcttcaaattttatatatctttttttatccttaagtaactgacccaaatggtcaaacccaaggttgtgctctgctaaaacaaaaacattcttggactctcatttactaatatagtaattctatttaacgaaattagataaatgtggaagaagaatctctgtggatctatgttggcttctttttagttggttattttctgaatgcaaagatgataatttggtaagcaattggaaaaacaatatttcttcttaaactttaaaatggaatagaaattatcaaaatgtaaaagcatcagattagcatctattgtttaaacagagtaaaatgttatatagagagagaggatgaagggtggccaggtacagttactgggagagtcataacaatgtcttaaattacgttcgtgttaaatctcaatcataacatcattttactataaaatagattttatttaattaacttctgattttacaagttatatctttattacttctgcaggaaatgataaaagcctctaaagattatttgatatatttaagataacaagtccgtctgggtcaaatccagtaattaatatttccctaatgaaaataaaatgaagatttcttcttattaaatagtattatatgctatcttcatttattaatgtgactttgcctcttcaatgtaccttttatccaaggatataatagtcttataatttgatctctgtttcattgatgaacaaactgggatatcagaggtgtaatgattttccttgaattgtatgtcccattaattatgaaggtagttttattataatctatgacctctaatatcaaatgtttagttccattccttataaagttgctgatgatccctttaagtgttactaattggaaaatccataatttctgggacctcgtgtgtattgcttcccattgtatctctagattctaatgtaagtgcctggcatgtagtaggtgttcaataaatattcattaaatgaatgtaccaatgaaatgtaatatatatgactctgtcatgtaggaaatccctgctattgttaagttcaaatacataaactatacttactctgtcaacttgttcctgtcctatttcttgtgatgagtactcagcataagccctctgctgcatctgtgctgatctcagtttacacaatcccacaaccccttacgagcagacacaatactgtgttcatgcatgcagttgctaaggtttttcttgccaccttaattgaactttttttttttttaccacaaaactaaatttatatagagaaataaaagaagagcacttaatatatgtattcctgagtgaggtgcctggggtctcttttatttactagctatgtaacagtagataaaatatgtcgtctatctgtgtcctgtttttcccgtctgtatgatggggattatatctacctcattagatttgtaaaaattaaatgatcaaatagttaacaaagttatctttattcttacattttctactatatttaagaccttgtttatgtactgtacttctctctactactatacggtcaaactgccctctcctgcctctgccttcaccccctccaaacctaacaggactatttgataaggttatacattcatcccctcattgcctaacataatggtctttctcagagtttactcttctcaatctctctgccccataaatagttataaagaccctattactgactgtaaaaactcccttctccaatttcttggctcactccaggactttcctacttctctagactcaatttctattttccagacttctatttgtattcttttccaaagaaatctcactcttttgtggccatcagtatatagtcattgatcacaagaataagtaagttttcatcttactgtttttctgtccctcattcaagagttattcattatgtgtcacattttcttccacacgtatccctgtctttctatccgtactgacattctttttaaccgggtcacctgctgtgtgcatttgaaaagatctatccaatctcttcctcagtcctgtacacttgacacacaaacatgatctttctaaatcagagctcgaattctctgtccctctcctacttacaatttttcagtttattttagtcgccaaccaacctatattttattctatctattcatctagtaatagacctcaattgtggacaaaaattcatatgttgaagccctaacccccagtacttcagaatgtatttggagagagggcctttgaagaagtaattaagttaaaatgaggctgttagggtgtgccctaatccaatctgactgcattcttataagaagaggagattaaggccaggcatgggggctcctgcttgtaaccccagcactctgggaggccgaggtaggtggatcagttggggtcaggagttcgaaaccagcctggctacatggtgaaacctcatctctactaaaaatacaaaaattagctgagggtggtggcaggttcctgtaatcccagctacttgggaggctgaggcaggagaattacttgaacccaagtgggagagattgcagtgagctgagattgcaccattgcactgcagccagtgtgacagaccaagacttcatctcaaaaataaaaaaataaaaagacaagattcagacacacagagagacactagggatgcatgcacgcagaggaaagaccatgcggagcacagtaagacggtgaccatctgcaagccaagaagagaggcctcaagagaaaccaaacctgtcaacaccttgatctaggatttctggcctcctgaacagagagaaaatacattttttgttgcttaagccatccagtctgtgctgtggtatgtttttatggaagccctagcaaattcatacatacttcttctgtcctttatggtcccatgctttaatgaaaacatgttattattttccattctgtgctttcaatcacacctttttctcattctcaaatgctgcaactctcctatcaataaacagtcttctcaaaaccacattgcctgaatctttcctgactgtgacttcccatagtactctgttgcatcctcctttatggaaatatttagtttatatccttaggatgggttatagccaatgatgtacaaacttatatccccagctaggagataattttcttgatagcagaaaccagatctaacgagacatgcatatttagcagactgcactggatgaaataagcccaatatagtgaaatgataactacttttttatgttctcaaggtttacatatgtaatcccactaatactgtaaaccttagcaggagtcatgttttatcacagtgcatatctgaacatgcagttagaattatacattgtatacacacacacatttaccacacacattgacttgtgagcttgcacaaacatgatgaggctggatagaggtgtagcaattgtgaattgctgagttcttcaaagtgagtacattggttttgctgacccagaccagtctaagtgtgtgtgtgtgtgtgtgtgtgtgtgtgtgtgttgtgagtggggatggggagaagctactgtggtgttttgcagaaggatgtatttgccctaagaatgaactctcagaagagctctgtatccattagcttttgctggcttatgctgtggtaataacctccaaatctatattcttgcaacagcaaagtttgtggtttagctgtgcctctgttccatttcttcttcatttctgccaggcaaatgccaggtagaggaaaaagattaatagaaagatctcacaatatctcttaaaactcctgctcagatgtggcatatgtcactactgctcacatcccactagccaaagcatgttacgtaggcaaacctgctgtcattgagatgggaataatatccaacccgtcccccccaccccccgcccacggaggagctctgtatcaataggcacttaattttgaggaaaatacatgaaaattaaggcagctaaagaaaactcctgagttcccattgcttcccagcccaccatttcctccctgtgttctcttctgtttttttctcacctatgtccttgccttaaacacaaagcaagagtacctcactcttggctctgcaggcaggtactcaggtttgcttgtatagtaagccccttactgaaagaggagaacatgtcctgagtgtgttcaaaatactgatcctcactctacagctcagactgtgctttgtggattttgggagaagtgcacattaatgtatggcaggaagatcaggaacacagggccccagataatcacctgcacaatgagtaagcaaatgtcttcacaaaatgtaaggtcctttcacaatcttgcatgtatagatagtgtttcttggaaagagattaaaaaaaaatctcttctcaaattaaaccctttaatttttttattgatttgatttcattcatttattcaatcattcatttaacagtattgagcacctgccctgtactatattctgtgtttgacatgaaagatactaaattactaatgtctttgtcagctcaggctgctgtaacgaataccataccctgggtgacttagcaatgaacattgtttctcacagttctggagattgggagtccaagatcaaggcattggcaaacatggtgtctggtgaggacctgcttcctggttcatagatggaggtctcaccactgtgtcctcacatggttaagagagaaggagcaagctctcttaagattcttatgagggcattaatcctattcataagagctccctcattacatcatctaaaattctaattacctccccaaaactttacttcctaataccattccattagggagtagggttttaacatattaatttggtggaaggaaatgaggggttggggttggggaataggcattcaggtcataggaagtattaatgaaaatatctaacagcaattgagtgtttattatatgtcattcactacgataaatgcattacaagatgcattatctcctttcatctttacaaaatcctaaggggtagttaccattttatagtaaaagaaaaaaaggcttagagagactacatccctgtgccaagttcactcagccagaaattggtggagcgagtacatgaatcctggtctctttgacttcaaagctcacattcttaaccacacagtaaacatagtgatatattccctcaagaaccttattatctaattggctgatgagtggcggtagaatttctaagtatcttcattaaataaaatgtagaaacaaagtaatatatttataatctgagtttccacaggagaaaagagaaaagtaggagtgattaattccaataggcaacagacaggaaacatgggaagccttccttgagaggacaatggctcagctgggcaaaaagggtaagtaggatttcaataggcagagagcatttatagcttgagcaaagtcagagaaatgctgccatgcataggggacagggcatggatctgggtgatgctacgtgaagagcatccccctaacctggtaaggttagagagaagattgggatcacaaaaagaactttaatcaatgtactagtaaatttgaactattttggaagtcaacacagagctacttcccttctaaatcaatattgacttttgaatgggtattctagagaatgtgaaatgacagctttaaagatggctttaaaacaattattcaaaaaaaatgttcaaatcaaaacataatacctctgaagacaaactctataatgctttaggccaactcagtctctgaagctcaaatgagcataaatgcaattagccatttgctcccttaaaatgagggtaggtctgtctaatgtagcttgtaatttgccaattgcatgtaaattattttcacttgaaaatcacttaagttatgtaaagggacagtcctttcaacatgttaatcccaaatattgacacttttttccccaagaaatactgttgtttgattttcaagatatactacaaaataatacaaaggcataaaactctttccagttgaattaaatattatcaaaatccttcaggaataattttgttaaggcatctatgcttaatattatatattccatacacaacatttctttctgatttgattgttaatatgttctacatatagacacaattcttcttatggcagattttatataacatctgaattgcttatcattaaatattttataacaggtaaaatgatgaatgaaaaacttgaattggtgaattaaagttgggctgcatcaaaatttcttgtctctgcatgaaaattgatgagtttgttgatgattcattgcattttgcatttagaagcattatatttagtgccaccaggttaccatataaaatgtaaaagcctagaaaaattaatatcatgtctctcaaatttgatgatgggatgagaaggtaaaatctaaatctcaactttcaaggtcaaagagggatttcttgccccattcaattactgctcaatttgatagcagtaaaggagttaagagcatctctcctataatttggctagactttcattatagaaatagaatacattaacaggaaaccattaaatacaatttacgtatgaatagccccctcagtggaagctttgtttcttccatttgcaggataaagtaaaggtaactgtttcatatcaattaccagtcactgtggacaacatacttttattaactctgtggtcaaatgcattcatctttatatttcaagaatggcacaaatctattctttttcagtattaatctatgtcccacacaattactgccctgacatttattggagtaataaattggctttagtgtttgttggcttttcccttctttcagccattctgctttcctgaattttataatgtgccttcacttttttaactgactgaagggaaggtggttctaatttcacattagtgaatgtggcccatttattttcatttccttggtaccctaagagaaaaagaaaagtatctatattcacagtttcaattcagaacaatgaatataaatgcaaacaagctttgaggtttaaagcttctatttaatcattatagttatagtagttatgtttcttggatccataactatactaaaatggttgtaagtgtgtaattgcattgaagaaacctgggttcaagtgtaaactctgcttctctctctctctctgaaaccgtggggccctaggagttctcttaatttctccaaatcttatttattcatctgtaaaatggagatactaccacctaccttcagagttattgtaaaggtgaaataaaacattttatattcaataatatttatagaaattcatattgttccagacactggtctaggcgcaaattacatcagagaacaaaacctaagaaaaaaccttctctcctggaatttataattatttctcatacaagaaaacaaagtgccattctatggtataaaggaggtgctcattattcccagatattttcagcctataacaacaaaatgaaatgacaattctttcaaatagcaaattttgatagatgaaagaccacaacttctcctcaaagctttcttcagtactctcagaactcccaaggagcagtctaatgtaagctcagagaaatggctcaagttctctccttttctctccctcctcaggccaccatgacaatgagtctgtgctgctaaacttgtgcaactgcagttgtacttggaatggccctgcacaggcctccaaggtgtcccttaccacccatctcccatacttacaccccagtctcaggaagtgctaagttcacctggccctatacattgcgtagatattgctctagacaggagaagaatgtataccctactccattcttgaagagatccgtttctctaattcatattttctgtcccttaaattgatcttttttttaagtatgagtgattgtgtgaaatctcactgatttcagaggaaataccatttcccactcaaaaggcacaagcccttaccttcagcttctgagagaataattagtagaatataataaagcatcctctatcatttattcttgactaacactatctgaagggtacctattacccagtccacatcctctttactgtttatcttctagtagaggaattctacaagttattcctgcagtcctagccttttgccttaactttagaaaccagctacttgaagatttgcattttatcttcaccatcatagtttcaaagacattggggtcaaatattggtcatagctgagccctgaaaagataacagtagatggtctactctcttttactgatctagctccaaaaaggaccacattctccttgtcatatatatataataggtttgagattatagataccagtttcaagtgatatagtagacatgttagatttggatataacagttaagcaagggcttcaatttctttgaggattttgatctgatgttaagttgccaaagcagaacgtagagcttacagcaataaaagtgaatcagacagtgaggagggaaagcaggtgctgtattgatatttacacatggacagtaacatcatcaaaattgtcatcttcaaacatgtacagcagcttttgcaaaaatgagagagaatagtaaattcagaaatgagagtaactttaaactgtaatgtacataatgggtgaagtcttccagatagctcctccagattttgcacaaagcagtgaatcttgagtgagtccaatttttggttacgggtattttctttgagttgataatagatatgtgggattctgagtgttcttgaaaaagtccttattccggcagccctcatactggtaatattttgtcataaagactttgaaaggttctactgttgcatgatttgcaaatgactgctattccccctcaaaataacacaaattggatttaagaccaatatcctcaaaactggctgaaatgaaaaatgaacaaagtaaaacataaaataatatttctgcaaaataataatattttaataactcaaaagcagttatgtcagtaagtgagagcttatctttggaaggatcaaattcaataatacaatgggtcaacttcagattagctattgcttaaaattattggtgattgaatagaacttgtaattccagactagtcaacagaatccaagcgtatgtgatgcctcacatacatttgttaaaccagagaaaacattagataaatatcgacttttctcttgtcattttgagtctaatgttttcttttctttcagttttttatttgtttgtttgtttgagacaaggtctcactctgtcatccaggctggagtgagatgaggtgatcatggctcactgccgcagcctcaacatgctgggctcactcactcctacctcagcctcccatggagctgggaccataggcatgtgccaccaggtcaggccaatttttaaaattatttttagagacagagtctgactatgtttcctaggctgatcttgaactcctgggctcaagtggtcctctctcttcagcctcccaaagtgctaggattataggcatgagccaccacacctggctgaatctagtattttctaaagatactactaatagtacaaaggtatggttgatattgccacgtcttaggtaaatggaaactttacccaagattttgcaagtgttgaagagttaacaagacaagttaacagaggttctcaaaattgaaaataacccaagccccaagccccgtgaaacatataaaaagaaaaaatagtcaaatcacctccaaatatcttaggatatgtaaactacattgttgtgttaataagcaaacatctgatttagccctttttttcttacacaataaactccagacttcttaatacaccattttaatgtttttactttattgtgccaacgtgccttttcagatttgaacatattttgcttaggcttttgtcacatctgataattgcttgttcctgttcttcaccgtctttcaacattctacttacgctgcaaggcactatttaaatgttaccactttaggaagaaagaatcacccaccctcaatggctacatgtgccacattcttctattaaatgcttattaccatcttcccatattaggttatattgcactctttgcatgtatctcattcattaaattgttagtttccaggaaaaagagacatgcctcatctctttccttgatctcaatggcatgtcataaaatatagacattttggagttagacaaacaaggtagggttttgaaccctagttaagaagcattatgttccagagcaagttattcaatctttctgaccttctgtttgcttatctgtaaaaggaacgtagtaaccttcctctcaagcttgttatgagaatcaagcgagggatcatgtaaagcacttggctcagttcctgaccccaagtagaggcttcataaaagataatcaggactcttgaaggaaggggtatgagaagaaaagtcatttattttcaagtccacctgagtggccatgagcagtaggggcagggctaggggacaaactgaacagctggaggaagtctctaccaactcacaaatctaggtgattttcatgtggagaaaagcatagtcttatttaccttgtctcaaagtggcggttttatctttataattacattttgctatatttgttcttatagaatttatgataaaatacattagcccattattttaattttatggttatcagttaagaagtagcactccatattcttacagaagctattatcaagttatgtgctatgttccttggtcagtttgggctgccataacaaaataccacagaataagtgttataaacaacagaaatttatttctcacagttctggatacttgaactctgaggtcagagaggcagaatggtcgggttctggtgaggcctctctttccggcttacagatggctgccttctagctatgtccccctcatgacagagagttagatagagaaatcaagctctctggtgtctcttctatatggacactaatcctctcatgagggccccatttttaggagcttatctaaacctaattaactcccaaaggccccatctccaaatacaatgacttcaacatatgaatgttgggggaacacaattcagttcattgcactgtgtataaaaatatttgaatatttaatcatagactcagcatactatagattttaaagagacttagttacacttagccaaattcccccattttttacaatggagaaaacagaagacaggagtggttagatggcctgcccaaggttattacaccaattaacaaataaaatgaaagtagaattagattctctgattttttaactagtattttcagcaaataaatggcaaataaagtgacacatgggcacaaaccacgaaaaatgctcatgcagaatgagagtaaaggaaatagaacagaaagttttagaaaagagtaaaataaaaggtggctgaaaatgatcatcaaaggggtggcaagagattggaaaacagaagagaataatatctggaagacaaaagcaacattgaagggatggcagacaaggcagaattctaaataaaatagcaacatttctaacatcccagaaattagagtagatagtattgggttctaataatgtgactcacaaaaatggagtttccaagtattctgattaataactaacaactgtatagtaacagatgctccattttgagtctaaactgtgcctaatctaagattccaacataattggaagcctagaaatgtctgtttgctgaagaccgttagagtgagcatcagagaaacttttgggttatgactttttctaaagcaaaagagactggatgtatatgggccagactctaaaagtacacgtacaaatacagcacagcaatcattactcagactgtcttatgactagttccctatggagtcatggctgattcacacagcattgcaatgaaagaataagtacatctcggaaagagctgctttattataataaccacaggacactgagtgcacaagatatcagcagattgagaccagcaaccatcgctggagctggttttcttggcatagggagtaacaccctcaatgtagtagcatcaggagacaggggtgatgccagaagaaatgacagcactctctgtagatgcttataattgggttgctgtttttggcatgagaaactattaaattggtgcaaaagtaattgcagtttttgccattaaaagtaatggtaaagaatattttcattctctatttttgtattaaaagtaatacaaagaatatcttaattgcgggccttagcaagagagggggaaatacctgaagccacatagcagccaagaaggcttcctcacaaggaacagtagaaacttagaaacctccagctcagcaagaagaattatcactggaggtttatttttgccagaaacattggattgggttgagaaaggagcagagaagggaaagatgaaagagaacagagccagaaaaatattattgcatggcctattttagtgtgagagacagggaaaatggctaatacaatctgagaaacaaacaatgcagctcttgacagtagtgtgtgatcatagtacacagagtctaatcaacaggtactgaaattttaaatggctgctaaccccattgctagaggccttgcaaaccataggtgcttatattttgaaagatgaatgtagttaaacagatgaaaagcctagatcatggtttcacacagttgacataatatttagcttgtttattcactcttcttttggctgatgttgtgtccagaactctttattcttcattattgtgtaggactttaattgatgtctgtggttgctttttgaacattttattcaaagccaggtgtatgaagcagacatgtataccttaattgctgagatgtgtatagtaaatcatttctttgacagcctatcagtgttttctaatgaatccagagccattcatataatttgtcattttagtggaatcataggaattggtagtttgtggtcattttagaattaatttattgaggttctttcaggggaacctgcccccgataattcaacattaattcacgtaggttcttttcgatttccctaagtgtcgggcagtctgagaaataaagggaaagactacaaaagagagaaattttaaagctgggtttccgggggagacatcacatgttggcaggttccgtgatgcccccgtcaagccgcaaaaccagcaagtttttattagtgattttcaaaaggggagggagtgtacaaatagggtgtgggtcacagagatcacatgcttcacaaggtaataaaatattacaaggcaactggaggcagggtgagatcacagtactggggcgaaattaaaattgctaatgaagtttcgggcacgtgttgtcattgataacatcttatcaggagacagggtttgagagcagacaactggtctgaccaaaatttattaggtgggaatttctttgtcctaataggcctgggagtgctacgggagaccggggcttatttcatcccttatctgcaaccataaaagacagatgtccccagagcagccatttcagaggcctacccctgggaacgcattctctttctcagggatgtcccttgctgagaaaaagaattcagcaatatttctcctatttgcttttgaaagaaaagaaatatggctctgttccgtctggctctcaggcagccagacctaatggttatctcccttgttccctgaacatcactgttatcctgttcttttttcaaggtgcccacatttcatattgtttaaacaatttgtgcagttaacgcaatcatcacagggtcctgaggtgacatacatcctcagcttacgaagatgacaggattacgagattaaagtaaagacaggcataggaaatcacaagaatattgattggggaagtgataagtgtccatgaaatcttcacaatttatgttcagagatggcagtaaagacaggcataagaaattataaaagtattaatttgaggaactaataaatgtccatgaaatcgtcacaatttatgttcttctgccatggcttcagccggtcccttcgttcagggtccctgacttcctgcaacaggttctacatggctttttgaacaataagattctacaggtacatctagaaacgttcttaaaacaaaattaaactttcctttagaagacatcatacacaagggtgctgccttcaggtcactgaaatatccagtggtgctcattgatttccccacttttccttttcctctgcaacctcatatgcaagccagaaagttcaggagttgatactgccttgattaaagtatccaaatacttctgtgcataatttagattactataatgtgaattatgtgtgtgtgtgttaaacctaatactatattttttaaaaatagaatcaagccaataaaaatgcaaatatatttattttggaatataaggaagaaaaactgaaaaatagccccaaatataaacaaatatagctaataaggtgatgatcacaacaatgttcattgtatcaaaaataaaaacttccaagtgtcacaaaatggagtattaataaatcaggtattcaatgccaccaaatacaagcagcagtaaaaaatatgtatgttattgaatttaggcaagcaaatatattcctagtgtattgatatactacataagtggcttacaaaattatgagtatagtattgctatggtttgaatgtgtccctcacatttcatgtattggaaacttaatccctaaattcatatgttgatggtatttggagatggggcctttaagaataattaatatgaaatatgttcatcaaaatggggctgccatggataggactggtggctttataagaagaggaagagagacttgacctggctcactcttgccctcttgccatttgatacctcccaccatgttataacagtaagaaggccctcaccagatgtggcccctcaagcttggccagcctccagaactgtaagaaatcaatttcttttcttgacaaattacccagtgctgttctgttatagcaacagaaaacagactaagacaaacatgatatcatattttgttgcaagtaaatactgttaaatatgaaaatatagttagagacaggtagagagaaagacaccaacatcttaacagtatctctgcatggtatattgtcagtaattgttttttcttctcattcatttgggttttctgcaaataatatgcattattttgctattaagaagaatgggaatggttactttttataaagggctttattttctcttagcatttggtttgcatagttacgcactagaacaaatgattgactgtaactgaaatagtaatatataaatagcaagcatgacagaaaccatttaaacaatataccttgactctcactaaaatctggccctcaggtctatgtcacaagattgtatgattaatttaacagtattcaatgacttgctcctaaaaaagtaaaaaagcctgtaggttagaggcttcatatattaactttgtgctctaatacattgtattatagtagattctgctcctcttgtattttaatgcacacttcttttgaaaattttttaaaaagataaataacttgtgtaacataaatttgtaggtcacacatccatctgaacctttcatttacccaaattacagaaccatcatgtgtaatttgtctcaattagtaattttatagtttgcaattaactttattgttaattgattccttctgtaataaatgtttgaggaagcgaaatgaatatgacataattctttgtcaaagacgaaaattttaggctgagacttgagcaataactgcactgccttggaaagacaagtctttttttcctgccaaaaattgtccccaagtgactgatggaaaatttgtatcagcttttcatgaagactgaaaattatattggtaattttaatattgttttacttcttactttatattttttctcactgaaaatgttacctaatttaaaaaacattgatgtctaggtcttgatgtactactctccttaaaaagatgtaataaatgtgctttcttaaggaaatatattttagtaacaggttgaggatgcctgtataaatttataaaggattaattttatattatattggagtcattcactaatgcaaatggtaatttgaaagcttggcttgttgttgaatcactgaatatatttcagagtagtagtttgtgttatgctctttagtggtgaagaaaaatcttcagtttaaagacttcattatgtttttgaatacatgggagagacgggtaaaatacaattcgaaaacaatactagcaagttagtatgtatattcttacataaatgtctggaatccaaagtaattttgtatcctctaattggtgctaaaagcatttagaagtgtggtctgtgtttttatattgtgtagaaattcaaagacaggaaaaaatttaaattgatatagttcaaaaaggataaggagcttaattcctttctcataaataactgtgccactgagtatatctctttactcagctattgctcctctcttgctttttctgcttgatttcttgctgttaatgaatctgtgttggccctggtttctggcaaactaatggttgaggagggtggctagtggtaaagataagaaacttaaaacaagattgtgcggaaagagaaatatattagtgctccagccagctaaatatattagctggcttccatctcttggtatctttaaacaataatttacaaggactggtgctggccattgatgatacattcattggtgaaaggagaaaagtaagggcaatgtaataaagttctcataaagcaaactatattctatttaaagaactttattttcttctaagattataaaatttcctcttttcttagttaaaaatatctttttgtgtaatgaaatgatggtgttactagaagaaaggtagttttgttttttatttatcatccaaggaaaacaataagacaaaaattataatttggcctcccaaatatatgtttttacattttaattttattattctatgaaacacaataatcttggaagtagtgtaatagaaacgaagaaaagaaaggcagttcctctctgtattcaagtgaagaagcacatctgggaactgccagtcacgtggttctagccttatgtataagcacatctgagaaaattagagctacatgctgagaatcagaaaagagacagagagacagaagtcatcaggtttccatttttgttatcctctcttgattttacttataggaaataatacattccttttttgcatgagatagtttctgctggatttctgtcacttacaactgaaagcatccagatgaaggcgtttctggaaagggcaatctccagctctctgtgaagggtccttgaacattttctttcaagagcaaggtctgcagtgagacacagaagtgagattcttgacccaagttaaaggggcagaaatctgagaagagggttcagttgtggtttcttctccctgctccaggctgtgttgccttggtgttctgccgatgacctgtagttagtggagatctgtgctactttaccaaatttctgatgctccattatctctctgggtttcttgatgcatgcttggttgacttccactaagaataaatatccttttaacgtccagcactccctagcagtcggtgggcaacccttgggtctctcttcagtctgaataaagctgcttcttttgcttattcagtttgccttacagagtttgctctggaactgagttgaaatttagcatatttgttaccgtgacataaacactccagaaaatctcagaattgcaaaatgcctcttggtaatgaagttccctatcttggctcttggtaatgaggttcccattgccaagacagcatttatggaatagcttgtggaagatgaaagagagagtcatcttttaaacacagccaataatggtgactccggaaaggcagaaaaggaatctctgaagtaggtgtcctggagtcagttgttgaaacaatcctattgacaagtactgtgatagacagaacaagatacatacgccaacaggcatatgaaaaagtgttcaacatcactaattgtgagagaaatgcaaatcaaaaccatctcacaccagtcagaatgactattttggggaaatagccattggggaaatcgtggctctagatttttttttctggaagaattttcgtttgatgcagggggtatcttttgtccttggtagaaagtttcccaagagcctttgaatctgcagttactgacttaccattgtccttccaaaccttgcaggaccaaaaggggacacaaaggggtttctggaggtgctagtaatggtctcttttagagctgggtgttgcttacaaaggtttattaactttgtaaaagttcatcaagctgtagatttaggatttgagtgcttttctctgaattatgttatacttcaatacaattttacttaaacagaaaaaatacctagaaagaagctttattgatataaaaaattagcagaggcgatagcattcataaattattggaagagggattcaatgagacaagaaaaggcagaaagaaaaatgagacaagatagacaatatgccgttgctacctctcatgtccctgctgcagctcacattgattgggtacctattgaatgccaggaatattctctttgctctacatgtaacaacacctcacttagctcgtgagttaaatagtatcatttccattttacacatgagatactaagagttcagccaagttatatgattctaggctcacaaacctaggatctgcaggagctgggggtctgcctggaggcaggattcttcctaggatatatgtaacgctttttggtagtcataggaactcccttttttcaggcctccaaaaacgctggcatctgcttgctgtttgcaagggtgaagaatgggatatgggtagaaaggcatagaaagcgtattggaaaatctcaaggggattaattcccattccttcctttgaggtggaaatccatcatctcagtgtggggaggcactgctgttaaattctctgccctctgcaaacagccatctgtctgagaactccctgaagtggctgctatccaggatgactgtgttgctgcagtctttgagtggttggagcgctgtaatgtctatgttaatagctgggaaatcgcagtagcagcaaccagaccactccaatggaacaatccaagttggggtaagtttgattgagcaaaaaagtcatgctgactgtgtgatgaagaggcagaactggtaacagtgacaggccctgcagtcagcagctgtggattttatgtgcagggcagactgatctggaaaatgggaagagctgactgccaataacaccttggggggaggtttgttcagtgcatctccctactccttgtatacctctgatgacatgcagaagcttaggaaataaaacacacttgtaacatcacagggtgcaagtaagtacatgtggatgccagtgtagagagaagcgaaagctagttttcattgcaagaatccaaacagagtaacagggctttgtccactgtctccagtccatggttccctggtgttcctagagtcctattaaaaaaaaaaaaaaaaaaaaaaaaacacgggctggaccatagttaaactgctgcagcagagcatagatcatccatcagttagctattatttaggggagaacaaagggatttcatgattcctatcaataggagtttgcagactagttaaggagatgatgattgtcaagaaaaggcaaccaagaactttgcccagtaagcgttagcatgccaaatgagtaatgcggccatgagaacaataggagtgcatccctcctcagaggaataggttatctgctatgtcgaatcaattatattttaaggaataagaaaaaagctaggattggggacactttagatttatggtctatgtgtaacaatgcacagagttaaattttctatatcccactaagaaaaatgttctttttgtacacaggactgtaatttgtatgtggccctctgtagaactcatccaaggcatttctgaaaagaataacataaaataaataaaaaatagtcattattcagtgctgtggaaggctctgaagtcttctatccaaagcattgaatattcagttaaaaagtcagattgcctgaaaggggcaccatgactcagtctttcataaacaccagcaacttcttgaattcttttatctgctcattgacaatataaaatcgccattgctctgtcaatctgtcattaaatatttggctctaatagtgatgccatttgggatttgtggcatctttcactttaaatctttaaaatagaaagtaaacacattcagttttatcagcatttaattgtacaagctcaacataaaaattaaacgttcacctctaaatcacactcatcatttttcatgagcccaggctgttctttgttagctctttttggctaattatttctagtagtaataacaataactgtcgtttagtatatgcctactatgggccaagagttaaaaatgctttaacaatatttatttcagttaactgcatttttcatttctagttaatcataaatttatgtagaatttttttctaaatttagcattaaaagacaaattaacaagtacctaggccaaatctatatttttcaaatgaggtcactaaggctgaaaatggttaagtatctagcttgtaatctttttaaccttggattgtttttaaaagtatgacttaaacatgacttcaaaagcacaaatcaattgtgcacaaattgtcaaaacataaataaattaagagtatgactataaggatattaaaatattctattcaattaaggaaattacatacaaagccaacagtttaagagaagatatattcaacatctagatttgataaaggaaatattatacagaatatacaaagaatgcattcaaatcaccaacaacaataatttttagggactccaagagaaaatggacaaagaatgaaattaaggatgcagaaagttaagcccaaatggatgacaagcatataataagatatttaaacttgctagtaaataggaaaaaagacaaactataacaatgcaatattttatatcaatcagatggacaaaaattagaaagatgagtaattatcaggactgctaaggatgcaggaagctggaaacactatgcactgttgataggaaagtaaactggattagctattccggaaatgattgtcactgtagagatgtatttatatggcagctttatgacattggctacctggtagaatttagctgtgtaaaattcttatattcaccaagagacagaatttgtattttgtagaaaatacttataagagagaaaggaagccattttatctgtagtttcaaactcttaactagaaattaaaattagagtttttttgtcagatatagttatttagtcctatattcccagaggccaaagactatgttcattattgtgcattgaatgtatttgatactaataaatagctgtgtatgaataagagaatttaaaaaattaatgtagatgatttatttttattttttatttttatttatatttttgagacaaggtctctctgtcatccaggctggagcacagtggcacaatcactgctcactgcagccttgacctcatgggctcaagcgatccttctccctcagccccacaagcagctgggactatagacatgtgccaccatgccagctaatttttgtattttttgtagagacagggtctcactttgttgcccatgctaatctcaaattcctgggttcaagcaatctgcccattttggcctcccaaagttttgggcttacagtcatgaaccaccacacctggcctacatgatttttttaaatcctaatatcctacatatacatagagtcatatggatcatcttaaaaatgatgagtgaaaaaaaatagttcaaatgagaaatacagcacaaacactactcatataaataaaagcagatgaacacacaacattactatatattttataagcacaactcagaacatatatcaagcttaatagagtatgaggtgggggagaagttggataaaacaggtgttcagaacaaaaggagaaaagaaagcttgagcaggattttagaatacttatcatgactatgtcccatgcactattaggaatggttagcctaattctctgcacttgaggtccaacaagcaaacaaaaccacttctattacacagcttgttagcagcaaaggcagaacttgaagcaaagttgcaagaatttctgttcctaattttattctctttttatattgcatactgcttttgtactaaatatttacataatatattcatgtgataaggatattgtaattcaattcaaatacatttattaagcagcaattatatgtaaaagattgattgtcttgggtgttcaaggacaacacagctagacgtataagccaaataaagcttggctaagtttggtctagttcaatttttttaaaaaaaaaaaaagaaaaagaaatatgaaaaaaaagcagtaaaaatagaaatccatcttcaccaagcctttaaagcaatataaatttatactgaggttcctgcatactataacacacagaaggaattcctaaaaatgttctttatccagctgtctacccaaagttctatcatcctggcaaactgctctctccaaaattcatcatcttggactctctctgaaactccaacccttctctcttataccctgttctccaacattcgaatttgtttagtttgtcttcttcctaatatagctatttctgtttaccattttgagctctggaactctaaccactacttaccaccaaaacaaaagactagcaagtaggttcaggggaaagactatacataaatacacaggtccacaatctctttggtgccagatgtatttcagaattccaaatttttcaggttttaggaagaaatttggtgaataataaacaccactaaggggacagggaagcactaatgtaataatgatatattattattactgcaacaagatatatagtcacactatataagacagagacacatcagttcaggtcaagttttgcccccaaatatattcaggatggctcaagttttgctgtctaatgaatttttaaaagcttaatttttatagctttataaattatgaaattaaagatgagggaatgtggtcctatacatcaatactcaaggatcatatgagttaatttgcataaaactcatagatcagtgcatatctgatacggtttggctgtgtccccacttaagtctcaccttgaattgtgataatctccatgtgtcaagggtggggccaggtggagataattgaatcatgaggggtggtttcccccatactgttctcatgttagtgaataagtctgatgagatctgatggtttcatatttaggagttccactgcacaagctctctttcctgccaccatgtaagatgtgactttgctcctcattcatcttctgttatgattgtgaggtctccccagccatgtttaacagtgagtcaattaaacctcttttccttaaaaagagtacagactaatacagtaaattggtactggttgagtggggtgctgctgcaaaaatgtccaaaaatgtggaagtgactttggaactgggtaacaggcagatgttgaaacagtttggagggctcagaagaagacaggaagatgtgggaaaatttggaacttccccaaagttgagacttgttgaatgactttgaaaaaatgcagatagtgatatggacaatgaagtccaggctgaaatggtctcagatggacatgaggaacttgttgagaactggggcaaaggtgactcttgctatgttttaacaaacagactggtggcattttgcccctgccctagagagttgtggaactttgaacttgagaaagatgatttaggacatctagcagaagaaatttctaagcaacaaagtgttcaagaagtgacttgggtgctgttaacagcattcagttttatgtgttcacagagatatggtttggaattggaacttatgtttaaaagggaagcagcgtataaaagttgggaacatttgcagcctgatattgtgatagaaaagaaaaacccattttctgagaagaaattcaagccagctgcaaaaatttgcataagtcatgaggagtcaaatgttaatcaccaagacaatggggaaaatgtctccaagggcatgtcagaggtattcatggcagcccctctcatcacaggcctggaggcttaggagggataaatggttttgtgggccaggcccagggccttgctgctttgtgcggtctcaagacttagtgccctgcatcccagccatggctaaaaggggccaacatagagctcaggccatcagaggatgtacggaaatgcctggatatccaggcagaagtctgctacaggggtgaagtcctcatggagaacttctgctaaggcaaaaggaaaatgtgtggggttagagcccccatacagagtcctcactggggcactgcctactggagctgtaagaagaaggccaccatcctccagacctcaaaatgatagatccaatgacagcttgcagtgtatgcctggaaaagctgcagacactcaacatcagcctgtgaaaggagctgagaggtggctgtaccctgcaaaaccacaagggtggagctgtccaaggccatggaagcccatctcttgcatcagtgtgacctggatgaaagacatggagtcaaaagagatcattttggaaccttaaggcttaatgactaccctattggattttggacttgcatggggcctgtagcccctttgttttggccaatttctcctatttggaatgggtgtatttacccaatgcctgtacccccattgcatctaggaagtaactaacttgcttttgattttacaggctcacaggtggaagggacttttgacttggacttttgagttaatgctggaatgagttaggaccttgggggactgttgggaaggcatacttggttttgaaatgtgaggatatgagattttggagcagtcaggggtggaatgatatggtttggctctgagtccccacccaaatctcaccttgaattgtaataatccccatatgtcaagggtggggccaggtggagataattgaatcatgggagtggtttcccccatgctgttctcatagtagtgaatgagtcacatgagatctgatggttttataaatgggagttcccctgcacaagctatcttgcctaccagcatgtaagatgtgactttgctcctcatttgccttccaccatgattgttaggcctttccagccatgtgaactgtgagtcaattaaacctctttcctttataaattacccagtctcagctatgtctttattagcagtgggagaacagattaatacaatagctcatggtaaatacatagtaaatgttggctataatcattatcaatacaattttatggcactggataacacatgtgttatttcatttaatccttatgaccactctttaagttagcttttttttttttttttttttgagacagagttttgctcttgttgtccaggctggagtgcaatggcacaatctcagctcactgcaacctccacctccgaggttcaagcgatcctcctgcctcagcctcccaagtagctgggattacaggcatgtgccaccatgcctggctaatttttgtatttttagtagagatggggtttcaccatgttggccaggctggtctcgaactcctgacctcgtgatcctcccgcctcggcctcccaaagtgctgggattccagatgtgagccacctcgcccagccagctattcttaatacactccatagaagaggacatcaagactcagtatcttgcccaaaaatatttgagtagtttgtgagcaagttaaatttccgtgtaagctgtgtctgattctgaagtatgcttttaatcatattgtgattcttaatttcagagagttagcctctggttaaagatgacagattgaacttatatgtttacctgttctctctcctgaaatgtaaaataacagtaatgggatatttaaaaatgcttaatccacaggtggtggcaggatggtagaggtaaaataacaacaaaattttggaaactagaaagcagacggacaaatctacttaatgactaaataataccaaggaaactaagttctaagccaagaaacaacccaatttacattgcagaatttcccaaaggctcaggacattaccaaattagatatctctagaagcgaggataatattgggatgagaaaaggaaatattggtcaaaactctttagattcatgttaaacctttctttatgccacacatcttaagtacctgaacaccactctcccctggcctacagtataaaactggttagaaggtgaagaaatttaagggaaggcttacatatggaagagtaaaacattttacattcgttttgctttcagtgcccaatactggcagccaagtttatacccttcagaaagacaggtgagaaatccttctttggtagtatctaagcagtcctagaaggcttctccacaccagttccttctccacaaccagggccaactctccaggggaaaagactgccagaggcttatcccagtgaaggaagcacattatttctactctgagccaggctaactttccctagccttcccatttcctgactccaacagattcagagagggaggttcttcactgaaatggcccatcctaaagagaagcccagagttggcaagcctcatccactgagcttttcatcacctttagtttctgtttgtaagtgtaaaaatgccaatgatcaacagatatttgagataaaggtttgtgataaaaaacatcaacaaataagaaagaggcaaattgaagacttttcaggagaaaacgacaacaagccattgttgatatcttcagggatgtaaaagattataatggctccaaaacaaaaaagctgtatggcataaaaaaggaatattcacagattaagacctcttaaaaattttgtaaatcaatcaataaaaaattttaatagaaggtttagaatatagagttcaagaaatatctcagaaagaacagtaataatgatagtcgtagaaatagagaattgagaaaatgtagaggaggaaatatcaaataattaacttaagaaactttgccagaatttaaggataggaattttcagattttagaaagcaatttagttcctggtatcctggatgaaaataagtctacacaaggcctacattgtgtaattttagaagactagaagaggaataaaaacttctaaaaactgccaggaaagaaacagctttaataacaaaaaaaaatagttattatatattttcttagcatcataagaaagttaaaaaacaaaattcaaagttaaaaaaaagaaattctaagaaacaaatgatttccaaagaagactcctataaccaggcatggtgttaattaattgaaaggtaagagtaaagagtaattagatatacaaaacctctaaaaatgtaattcacaagaagccactggagtatgtgctctaccaaaacaagaacataaactaaaaaatatgaagacctaggattcagtaacagagaattcagcaatagagaggaacaaagggaatttctagtttaatgtgaagggaaatctgtgaaggaaatcttttaaaaggatcttaaagtattacattgaaaaatactagaccacacactgaaccaattaatcacaaaatctggggatgggccccaggcatcagttttttctaagctctttaggtggtatcaatgcatagataagtttgataaccattggtgtacaagcttgttgtacaaaatgtgctccctgaggcagtagcattggcatcactggggaacttgttagaaatgcagtatctcaggaatggcagggacatggaaatatgttttaaagacttgctacagcctgagtgtggactactgtgagagtgagaaaattctaggggctgcagtcttagaggaaagccccacactctcatgggctttacctccagtacctccactaaaatcttatggtgaagaaccaagaaagttgatgtccttgtgcccccagcagaggaaagggaagaataatcattgtaaaaacaccagtgccttctccacaaggagggccagctctccaggggaagactgtcagaggcttatcccagtggaggaagggtattatttctactctgagccaggctagctttccctagccttcccgttttctaaccccaacaggggtcagagattcaaggaaatagatttggaatgctgcagccagagaagacagtgggggacagaagcaaatatatgtatatatatttaggtcatatatatagatatagatctatctatatatatagatctatatctatgtctatatatatctagagaatcactagtgaaggtcacaacctcgagacagcccaccaaagaactgagattaaatcataagattataaaatacttcttctcccccacactgtaccaccgcgccacggggccctaatagaacaacggttacagctgaaaagatgcaagacacagactttctctgagtattaattagggacgtcgaaagttaagagtgaagataaaacaaggacaaaggaattaaagacctctggcactatgactactgcaaacattgaacaaaaacacaaatattaaaaacatctaactcctagccaaattaacataaatcctcatattaaggatcatttattcagtttctagtacctgatacatatttggctttcaaggaaaacttacaatgtatgcctaaaccaagagaaaagaaaagaggtaaagcaatcatcagaacaagcttcaggtgtaacacagatgctggaaatatcaaatggggcatttaaaataactgtgattcatgtgttcgttgctctaatggaaaacttagacaacatgaaaaacaggtaacataagcagagaagtgaaatctctaagaaaaaataaagaagaaatactagaaataaaaaagaatctaagagaagttgaagaatatctttgatgggctcatactagacttgacacagtggaggaaagaatcaatgagcaggaagataggacaacggaaacttccaaaactgaaatgcaaagagaatttaaaaagcaaaacagaacatccaaaaaattatatgacaatttttaaaggtgtaaaacatgtataattgtaataatagaaagggaagaaagagagaatggagcagaagatatcctgaaagtaataatgatcaggaactttacaaaattagtgacagacagcaaaccacagattgagggaatttagcaaacaccaaacaggataggtacaaataactaactaaataaataaactaagcatatcatattcaagctgcagaaaaccaaagataaagacaaaatctagaaagaagccagagagaaacactttatgtatagaggaacaaggataagaattacatgaaccttcccatctgaagccatgcaaagaagaagaaagtggagtgaagcatttagtgctgaaaaagagagaaaaacctcataaatctgaattatatacctagcaaaattattcttcaaacatgaaagagaattaaagcttttctcaaacaaacaaaaactgaatgaattcattttcagcagacataagaatgttacataagaaatgttaaaaaaaaattttaggcaggaggaaattgatatatgtcagaaacttggatctacattaaaaaagagcattagagaaggaaagacaatgaagggaaaatagaaccttttatttttcttatacttaattgacctaaaagataactattaaaaaataatagtaataatattttaggtgattatagtacatggataagtaaaatgacagcaatgtcacaagggatgagaaggaggaattgggaatactccgttataaatcacctgtactacatgtgaagtggtatagtgttatttgaaggtagacatcgattagtttaaaatatatactgtaaactctaagctaaacactaattttttaaagaaatatagttgataaactaaaagaggagataaaaaagaatcagataaaatgcttgtttaaaaccagaaaatgcagaaaaaatttgaggaagtgggaaacaaacagcaaatgtaacaaatggaatctaagttacaaattaggtagatattaacttgatatcaataatcattttgtgaatagtttacacagaccaattaaaagactgactgtgagggtggataaaaaaaagacaagacttatgtgtttaaatatagactcaggttaaaagttgaggattggagaaagatatgccatgctaaccctaatcaaaggaaaagtggagtagctatgttaatttcagaagaagccaacttcaggacaaggaataattatcaggggtcaagaaggatattacataaaaagcacctgctctgtgtctaacaccatgacaaatttttaaaatttacattatttaatttattcctcttgaaaatacaattggtgagtggtatttactctatgtttaaagatttaaaaattaataaaatgtgaataatgtcattatgaattagtctccttttgttaactaaattacattgcaacagcaaacaaaaatcagcatttgaaaggtgcaaacaggaactcaatacaccatttcattggttaattttatatttcattgattattgtcatataagcctattcaaaactgctgacactgttgctgctcaggtaggcaagagactcaggaaaaggcttatcagtagaaccttgtacaccagcctgttgtcatgtgtggtctgtggctatcttgtctcacaggctgctgatgccacacgatctcacatgtaatcctggtggcagtttctactgccacttactgtctcacagctttaccacatgggttgatgtgtttggtatgtgcttagcacattttatctgcctgccaagttgaggtttgctccacttaatgaagctcctgccttggtgtcctgctaccatttatcatttgcaaacacctcgtcctacagagcagagctagagggagcatggcttcatgttgccgatctggctggagtccaggttcttgtagccagtgatccgcaattccatttcataataagaaagagcttatagtattgctggtgaaactgcctgaagaaatccaggtgctggcaagtctagatcctattatataggatctagataatgtgctgacctgtatattagtgtttaagtccacccccctcattccaagttacatgaccttctgcacgaccaaccttatacattctgcatttacaaaatagacaatatattacttggtctgatgtgggaaatgacatgagttattatacttttacaataaagagatagatggtatcttcatttgtaaatgtacatggcgatttattaacttatgcaagaaaaaatattaatgctatgttataaatattattcttcaactaaggactttacatgtaaaatctagatcagatttaaaacaaaataaaacaaactagcaaatagtttaatatcaagatcaatgttacagtcctcacacttcctggcttttgaagtttattttatccatattagttttatttaacacactcttatgtagtactgattatgtgatttagcaagttcttcaggtgattcttatggaggtgaaaccactgaattacagggaaaagtaaagctcttgggtacctcctattatatgaaccttattctcttacttttcagttgactgtttctatgcaaataaagatcaatagtgtaattctaactctattacacatgagaaactttatattaagttacaagcttggaggccacgaactccttggaagagatagtagggaacaacccaaacacattttatctagtgactcctggtatttatggaaataggttttttgttgtttttttttttttttcaaatttaacatgtattttaagttcaggggtacatgtgcaggtttgttacacaggtaaacttgtgtcgtgggagttcattgtacaggttatttcatcactcaggtattaagcctagtccccattagttattttttcagatcctctccctctgcccaccctgtgccctccaatagaccccagtgtgtggggttcccctctctgtgtccatgtgttcccatcatttagcccacttataagtgagaacatgcagtatttggttttctgttcctgtgttagtttgctgaagacaatggcctctagctttatgcatgttcctgcaaaggacatgatgacatccttttttatgtctgcatagtattctaaggtgtatatgtaccatattttcttcatccagtctaccgcttatggacattaggttaattccatatctttgctgtcgtaaatagtgcttcaatgaacatacgtgtgcatgtctcttcataatagaatgatttgtattcctttgggtatgtaccccgtaatgggattattgatttgagagatatttctgtttttaggtctttgaggaatcaccacagtgtcttccacaatggttgaaccaatttacactcccaccaacaatgtataagtgttccttttcctctgcaacctcatcagcatctgttattttttgactttttaaggaaaggggttttaacctataactcacattgtatagacatactttcatttgcctttgtttctgtttaaaaactaaataatcatccgtgataatttcttgatatgccccaggaacaagtgaaccaccttactgtcaaaggggctgctctctaccagcatgactatactggagaaaactatcttttgatgttagagaacacgatgtcgatgaaagcactagcaatataatatccctcaaagcaaaatggttaagaacgtaagctctgtggagcaagtatatttacatagtgccatcacacaaagtattacttacagacaaacacaggtgaggaaataggaaagaaaactatttagatattagctaaggctgatagttaaggacagaatttgttacatgttaatttaggatacttaattttaaaagaataaatacatcactaatgctattttgcatgttttagcaccttttactttttctgaagtaaacacatggaaagagaaattaaagagccttagatgaaggttaaggcagtggctttgagcatattagttgggtggtaatttaaacaatacaaaattacaattgacggtgtggtgaaacattattgaagcaggatgttatgaggactatggttttaacaggttgcaggagaaagtgtcgatgcaaaaagggcagagatggtcctgatattaatgcctccagtaatgataaaaatatattgaatgaattttatgatacaaatacattcgcaaatatggaaaattgtttcttattcaaagaatgttatgaggcatgaagcctgctgaagaatatgagctaaaataagctaataaagagagagaatgtggcagtcgctgtgaatccaggcagtataattcttgtcaggtttttgcttttaattctgtaaatctcactcagcttctatgagcaagtcatggaactttactgccccactgaatcgctagattttggtcaaaactgaagattttttaacgccaaggctagtcgctctgcaaccaacagacagccttttctatcgagtgtactaggctgattcgatgaggtgtcagtcattccatctcttacttggctctcagttcatgcaccagattgacaaggagtctatgtcatttgcccttcttgtgatgtgggacatgatctctaccagaaactccttttcagaaaaggattctcagcagcaagtcacttctataacttaccctaatggtggtctttacatcatcgaagtgcatactaaaaataaagtttaatgctaacctttccacatcattcttctttaaggattgttcagaatgttcctccatgtgctacatcttatggaatatttactctaaggttacccccctgagtccatacctggttaacttaagaaaacaccttccttccaaataggtaaagtcagcttctacaatgagttaaatttatgatttagagaaatattatgttctgggtattcagaagttctaattgccttatgttttacttcttgactgtccaggtggcctttcacaaacccttcacactcttcaaagtggcttccttcttcttttcagggaagcttgaagaactaagaaaatgtactctagccctcttaatctctctccttccatacccacagtaaccagtgatgcttagctattttgtagtttgaattgtttcatttacataactcccagggaaagaacatgtggtgttttccacaggatctaccatagacatgagcatcaaaaattgctcattgaatataaaagcaattcgcttagcgagctctaatttcacttgaagttgtttcccatagcgtgagactcctcgggcatgagaaaacaagagagactcccttaggagtcagttatttagaaaggaggcattcagtcccatataccagttgcctcatacattttaccttcagacgcagaacataatatatatatataaatataaaatttttattttttaatcttttaaattttactttaagttccaggatgcatgtccagaacgtgcaggcttgttacataggtatacatgtgtcatggtggtttgctgcacctctcagtccatcatctaggttttaagcccggcatgcattaggtgtttgtcctaatgctctctctccccttgccccccatcctccgacaggccccagtgtgtgaagttcccctccctgtgtccatgtgttctaagtcctctatgggaagaactatccaagatgtctaggttaattcttgtatttccaaaatgttttcattggctctccatgatttttctttttcctttgaagatgaagcattcaaaggcaccaggtaagggagataaggctcagtaagttagtgaagttattggagctcgcttattgcaaaggacaaaatatatacgcctgaaaagtgaaaatagcaatagagtgatttccagggccaaagaagtcagggcttctggcagcgaggttgagatggacaatgtgtttggaatcgtttgtgtttatggtgcctttgtaggcctgtgactgcctgtgcttaggaagataagaaacgctgagaggtaacaattttctgcctaagaatgtgagaaatgacagcaaaataagtaggactttcgtgttgcagcagtggtagctggaaagcttactgaagttgagctactgataagcccagaatggaaataaggccaaccctctgatgctccaaccacctccttgaaaatgatctttgtgaggccaatattcaaaattctcacaattcaaagacattactgtgtcctaattatctttgactttccatagcatttggctccccactattgatggtagtctctaatttgacatacaggttgccccattcctctgttgtctttttttttcttttttggcctactcccctcttttcagagaaaagggactaggggctaaagaaggctaaatgctcaccacatgtcttctgattaactctgtgtgttacgtaaggggaatgacggagagagcagtctgttactaggtgaggtcaaggacatccttcagaagaaactgagcaagtgactgcttggcaactatgtacagaagggatgaagaatgaaagttaagtagacaatctaaatgaattctcgaaacttctgaaaggagctatctttgaccttgaaggggaatgtaggcaaaataaaggataaaataactgacactcattaaagaccaaatttgtgtagggcacctcattttatacattatacaagaaaaaaattgataaacaaaaaaattagacatttctgctcattagaggacactactgagaaaatgaataggcaatccacagagagaataaaaagaaacatttgcaaaacatatatttgagacctcattgtctcattttacttcagcaaattctggggtgttaggaattacagttttcctcttttagaaagtaagaggtttttaattttggagaatttttaataaaaattctcaaacattaataaagccaaaagaattttacagtaaatgttcatatatctatcacctagattctatcattaacattttattattcttgttttgctacaaatttattcatcaatttgttttattttttaatatgtagttcaaagtaaattgcagttaacagtacacttctccccacatacctcaacatgtacgtcattaactataattcaatattttttatgaatctttttcttttgatataaaatatacatatatatgtgtatgcaatgaaattcacaaatcttaagtttattcactgagtgttgaaaaatacaaacatacctgtgtaagccaagctgctatcaagatacagaccgttgtcatcaccatcatgctccattccagccattgccacctgtccccaaagttttaatcactgtgtggattttttttaaattgtttaatattgcctgtttagaagttcttataaatgaaattaaatagtgtgcacttcttcctgtaaggcttcttctactcagcacaattattttgagatctatctatgttgtcaatatgttagtattttttcttttcattgtttactagtattccactgtgttattataccacagtgtgcttattgattctattattaatagatatctaggctgaaagcagtttgagactattataaataaaactgctatgagtgttattgtacaaatatttttgtgaatacatatttttaaattccttatgtgaatacctaggaatggaattgctgtgagatatttctcaaaagtgacagtatcgttttgcatttttacaaaattagatgtgagttgcaattactccacatccttaccaaaatttggtgtggtcagtcttttaatatttgttattctggtggggtttggagtggtatctcattgtggttttacttttcatttctctaatgattactgattttgagcactttttcgtgtgtttattggccatttgtattaatatattggccatatattattttgcgaaaggtttgttcaaatattttgcccatttaaaaaattgaattattgggagtcctagatgggcggatcacttgaggtcaggagtttgagaccagcctgaccaacatggtgaaactctgtctctgctaaaaatacaaaaattacctgggtgtgttggcaggtgcctgtaattccagctatttgggaggctgaagcaggagaatcacttgaacctgggaggtagaggttgcagtgagctgagattgtgccactgcactccagtctgggtgacagagtgagagtctgcctccaaaaaaaaaacattagattattggacttttttattattaaagtttaaaattactcatatcctggatacctgttctttatcagatatatgtttcacagatatttctccctactctgtggcttgcctattcattttctcaatggtgtcttttgatgagaagaagttttaattttgatgtattattttttttcttttataattattcttttgtgtgatctgtttaagaaagctttgtctagctccaagccatacaggtatccccctgcatttttctgtaaaatatttagcgtttcatattttacagttgggtcaatctttaaattaatttttgtgtgtggcgtgaggtagatgttgagatttattttttaccatgtggatatctaatgattagactaccctttgttgaaaacactttcctttctctattgcattgctttgccttttctctgagacttttacataagttgtccaagatttcagttagtagatcaagggacatgagtccgaacttatgtttgattgataaggccatttgtgttctttcccgatttttacctaacgaaaaataatactatcaattaccaacacttactagtcactgtgataattgtcttagcatagactgttttatttcatttgtaaactctattaaataaacttttttaaaaataaacatttttatgatgtccacttaaagataaggaaactagggctcagagtggtagaatgtgtcaaagccacacaactcataagtgacaaaaccaaaacttgacctgaggcctgtctgaatccaaaaatggctctcccaaccagtgtgctatgatgccctgtattagttccttctcatgctgctatgaaggaatacctaagactgggtaatttataaagaaaagagatttaattgactcacagttctgcatagctggggaggcctcaggaaacttacaatcatggtggaaagcacctcgtcacaggatggcaggagagaaaaatgagtgccagcaggagaaatgccagatgtttataaaaccatcagatcttgtgagaactcactcaccatcatgagaacagtataagggaagcttttcccatgattcagttacctccacctgatccctcccacgacatgtggagattatgggaactacaattcaagatgagatttgagtggggacacagccaaaccatatcattcagcccctggccccttccagatctcatgtatgtcctcacattttaaaacacaatcatgcacttccaacagtccctcaaagtattaactcattccagcactaactcaaaagtccaagtccgaagtctcatctgagacaaggcaagtcttttcccccgatgagcctgcaacatcaaaatcaagttacttacttcctagatacaataggggtacaggcataggtaaatacatccattccaaatgggagcaattggctaaaacaaaggagctacaggccccatgcaagcccaaaatccaatagagcattcattaaaccttaaggttccagaatgatctcctttgactccatgtctcacatccaggtcatgctgatgcaagaggtgggctcccatggccttggccagctatgcccctgtggctttgcagggtacagcacccctcccagctgctttcacaggttggtgttgagtgtctgtggcttttccaggcacacagtgcaagctgttggtggatccaccattctggagtctggaggatggaggccctcttctcacagctgcagtaggcagtgtccccagtggggacgctgtgtggagtctttgacacccctatttcccttatgcactgccctggcagaggttctccatgaggtctctgcccctgcagcctgcagcacacttctacctagacatccaagtattttcatacatcctgtgaaatctaggcagaggttcccaaacctcaattcttcacttctgcacacctgcaaacttaacaccatgaggaagctgccgaggcttagggcttgcatcctctgaagccatggcctaggctgtatcttggtcccctttagctatggctgaagcagctgggatgcagggcatcaagtcctgagactacacacacctggggagccctgggcctggcccacaacaccattgtttcctccttggtctctgggcttgtgatgctaagggctgctgtgaaggtctctgacatgccccggagacattttaaccatggtcttggtgattaacatttggtccctcattacttacgcaaatttctccagccagcttgaatttctccccagaaaattggtttttcttttctatcacaagaccaggctgcaaaccttccaaagttttatgctctgcttcctcttgaatgctttaccagttagaaatttcttccaccaggtaccctaaatcatccctctccagttcaaagttcagcagatctctagggcaggggcaaaatgccaccagtctctttgctaaagcttagcaagaaccacctttattccagttctcagtaagttcctcacctccatccgagaccacctcagcctctcagcctggacttcattttccgtatcactatcagcattttggtcaaagccattcaacaagtctctaggaagttccaaactttcccatatcatcctgtcttcttctgaggcctctgatatggtttgactgtgtccccttccaaatctcatattgattcgtagttcccataatccctaaatgtcatgggagggacctggtgggaggtaattgagtgatgggggcagttacccccgtgctgctcttctcatgatagtgaattctcatgagatccaatgatcttataaggggtttcccccttttgcttggcacttcttcttcctgccatcatgtgaagaaggacgtgtttgcttctccttccacaatgattataagtttcctgaggcctccccagccaggcagaattgtgagtcaataaattacccattcttgggcagtcctttatagcagcatgagaatggactaatacaccatccaaactgttccaacctctgcctgttactcagttccaaagttgcttccacatttttaagtatccttacagcaatgccccactacccagtaacaattgactgtgttaatccgttttcatgctgctaataaagacataccgaagactaggtactttttaaagaaaagaggttttaattgactcacagttccacagggatggaaggaagaaataggcctcaggaaacttacaatcatggcagaagggaaagcaaacatgtccttcttcacatgacagcaggaaggagaagaatgagcgaagaggggaaaagcccctcataaaaccatcagatcttgcgagaactcacttactatcgtgagaacagcatggaaggactaccctcatgatctcatcacttcccaggaggcctctcctgcaatacatggggagtataattcagattacaatccaagatgagatttgggtggagatacagagccagactatattatgtcccttaatgaaaatcagtgtgccaatcatacattttaccttgtgggaagtaactgagacattagctaagattgcttctactacatagaaaataagcatatttgattctatgtactaccctgaggaaactggaatttcaaaccagtattcctctaaatggtagctcactttctttaatgacttatgtttttattctttactctatattttactgacagtatttgaataaatctgcttgcaaatgtaatataaaagtagcccagagtaagtatggaaagctgagcttataaaattcttcttccttatcagttgaaacaaaacagacatttcagtcctctgaagtaatttctataataagaattccaatctgagatcagattttcttagtttcaagaaatctgaggaaaagcattgtgatttaaaatcctactagggcaaaagctacatgtctatttgttcagaaaatatttggtcattatactcttagtgtttcaataatgacctaaagagaaaggtgctatctcaatatatgtgagatttattgcaagtatatttgtaaggagaattgtaccaactattttgcaagagcatgtaaaaaattgaagctccatactatatttccttaaatgtaattcagcagtaacttgaaattgctttcatatacaaaaaatgacaatagtatttcctcaaatggatttgaatacaatggttttgttctttaaataataatggaaaattgaaaattggcacaataagatattccttcctgctttattaagatcagtcatggctgcatttaatagaagcaggcaactttttttttttttactgtattattttgtttgttcacttttgcctcttgtagctctacattagtgcaaagaaaatggagctgtgaagagcttctgggatttgctcttgatcttgcaagcacaatcccctcccccagtgtgacatttgttgaactccaattactacttttatctgtgtttgaacacacattgctaggttcaacaaacacatgctttactgtgcttagaaggaataaagataacaatctcatgcaagtttgtgactgtttcctaaggattataccttggaagtatagaagaatagatttatagttctatctcataatggggcttcctaaaccatgcctatttataaaattaagaagaggatcaaatgaaatagctaagtaatgtatatttgtgaagtatgaaggggcagattctattactaaacaaggaattgctttcttattccttaattatatttagtgctatgtcattcatccatcaaattttacagaagtgaaaagtgaatgggtatgagagttgtatagtatagttaagaaaatttataaaaggtttggaagtattaaaaataaatctacattgaatgtaaatgaaattgttaaggaaagttatcaatgatgaaaaggtaagatttctaaagttttaagagagtttaaaatagatgttcattaggtcagagattgttacatttttctctgccttaagttgctatgtttattatatttaacttaagcacaaaacaatattgctgatatattaaatattagtatttatttgaaggttataattttaccataattcaccatgaatttatcataattcaccataattttatatactggttgcattaatagtatatttttataaagtgtacatttttctattttccacaagttagtgaaaagacaagattccactaacagaaatgtattgtacagtaaaccctaggattacatatctattctacctaagagatttcaattttagccaaggtccaatacacaattctatatgtaattgagatggtgactgagaattgggttaggaattaaagtttagtgacaaatttagaaacatccaaatccattactgagttgccaccatatgcacatactattgtatttgcttgagaaagttgaaaaaatattttgagacaatttctgtccttggagattttacagtctgataggagagataagataaatgaaaaaatcttaaacacacatgcacagatgcatataagcaggcacacacacatcctacatacagatacacatagtaatacgtgttaagtaaatataaaaaacagccagaaaagacatgatgtgttagaagtctagagactttgtatctattcgtattcctatcattattttatttgcttaaatattcttatcctgttttattctctctaaatatttgagatagtaaaaaaaaaaaagatataatttgcaagatttttaagacaaagttaatggatgaaatatgtgtgaagaaaaaattttgctaggaaaaagtaatttaaaaacaaagggacagtagagttcaaaatggatgttctgcgatcttaagcacttcatagatgtaggcaaaatcgttggatatgaaccttctagaaagcaattaaagggagatctgattaggtttgtcattttaaaagtctaaatagagcagttgcacaggagggacttatctgtcctccatactcagcaaggagagaattgttttctatctaacctcaaaaagagaacattgtgggatagagtcaacattctcaacacatcgttgctataaacataacagatttcatgggattattttgatgacatccttccagatgggctgctggtttaatgttaatttgatctggagatagtcgtgatgtgtaattttggaccagtcacttgccctttataagctttagtttagtttctaagtttagtttcctcatctgcacaatgagggaattagactgattggatgatttagagaagaaattatagtttaagtgcccgtgagaggtgaaatcattggtgtcaatgatggcaaagaaggattggagaaagaggtattgagtttggtcacagacaagttgacagttttgcaaaaactttaaggagacagttggaaacaaggccgcagataattactgaagctgaaaaaaaatgtaggtccgtgctacatatcaaagattagagatatgaaaaaaaaatttatcctgggggaaatctgtagataaaagacaaaagccaatccataaagaatgacagaagtaagagtcacgaaatgaaagaggagccaacaaggtgacagagaaatacagaaatcaagcatttaaaaaggatataatgataaatgataattgtatgaattatcatcaaagataatacttgaagataagatacaataataggtgtgataaaatacaattgatatattcaaattaaacacacaaagaaaattatattagtaactatagatgctaggtaccacagaatatttttttctaagacatttatggctctcaaaactatattatgggaacaaagtgctgtaaataaaaaataatcagagcataagctagagtatcacaaatacccaaagataaacaaaaatttctgcatctttggtaaagatgggttacattcagccaacagtccatggtgggttcaattaagtaaaaaaattaaaaattacacctacaagacaaagagacaagattaaagaagggaggaggagtaaagtatttttgaatgtcagaaaaagcttggacaaaggcttagacataggaaagtttgggattttcagaaaacagctagtaactatgttggtcacatagagtatgtgtaacgcagtagctattgatattttcgaaaaagttaagttgagactcaataattctagagtaagaaaagttatacttaatatgttggatgatgaaaaggtattcaagatttttgagccagtaagtggcatgatcagggcagtcccttagtaagatgcatgtgacagttatagataggacaaaggagaaaagggttgagcagggataagctgggatgggagttctcattacaccatggcaatagtgtaggtggcctgaactggagaagtcacagtagaaatgaaaagatccagagggctagcagacctgggcagaaactgaatgtcagtgtgtaactactggcaaataatagtggaccctaaggctaattccctatctccctgccatctttcttacttagtaaaaatggattatggtgttttgcttctacctatctcagtgatgctgtcagaattgattatgcatatttctccaaagtaatctaaagtgctttaattctttggaactggacactatgtaaatacgattattcattacgtgtaaaagaggaatacagaatgatggatgtgcctagctaacgtgagagaactgtttaagaatacagagagggaaataagctaagtaatcaatatcatgttttaatgtggagagctaaagacattgatagaaggatactgagtggaagggaaatagatgaggataatgcgtttgggagttaagactgataaaagagggctatgttacactaaataatttcaagagaaaaggggaatattttaggttcagtgttcaatattataaagtaataagaaaaaagtttaaaatgaaaattagaggccatttataacatttattaaaaagttataagaacagttaggtatgtagatgtacattctgaatttcacatcaaaagtgatcaacacatacacaaatgcattatagaataatattttatttcaaagacaagtcactggaattgtacagttcaagtgattaaagtcaggtgactagtattcaaaaggatgggcaccattgtaggctactatggcattgacattaaggtgtcaatttctctggagtacacagagatcactttaggatcatgtttttacttggtacctataacaatagccatgaaaagaaagaattatgacagtgaaatttggactttgaaacattttttttttctgttttcagtccaggattatggatcagattgacctagcatttaacatagattaaaagtctatggtaaactgttagaaaatagtgtatcactttcttgttttctcaagccactgaaaaaataataattaaaaaagaaaatagtacatcgcttagcataaactaagttatgtcacgttttgacaactaatgccgtggcctggtgcagagagtactctctgctttggattaagataagaaatgaattaaattggtcttttaggtcccttccctccacctttattgaaaccttaccacactagctgcttggtctccttcccatttagaatggctttaaagctttccctcctatcagctgatagttttaagattaaagtgaacatatgagtgttgaagaacattctaggattcaaagctataatggtgacatgaggactagaggtatttctctgagggcaagaagtatcacttgtgtctgtttgtctggccagttgagcacgatgattccagccacgagagaagagaacgctgggctgagaggttagctgttggaataaggtttggttaactttggaattatacaatcagcaaagggatgtcctcaccagtacttctaagagatcaaacaagaggcctccagctccctaaattctggttctactgtaccaactctgctttaatttgttttaggtaatgggattccaggtgctattacattaagaattctaatttaactcttaaaaagtgttttcttagataaagtaactgggactcagggagataaagtaacttagtgactcacctaagtttccccttgtctccaattccagggtgccacccaccgtattatgatgttgatttgtgaagagactctcaagtaggttcaatttcatagtcccagtttaagagagaggccaagtgaggatttggcataccacgtcggaaaggttgccaagtcctggatttcactgatgagacggttccattctcatctatgtggctggtcggctgccacctaaaccaaggagagctcccatttgctttgtgtgaactggctttgctgtagcagtgctaactagccatgaggtagatttcttacaatcagtttggcatggctctttgctcatagccttatgtatgacaatcaagtctacatggatgcctagaggattctttagggattggaggacataaatgggactgaaaagctcataaatgagggcatgtcacaaaaactgaaattagagagtaattatggtacttagggctatgggaagaactaatgggatcaaactaataaaatatttcttgagagcaagtgacattagcttgtgtgaggagtccaaaaagactgtggaattatgttctgtgccatcaaaatccttaccccatccacccagaagagaaaagtatatccctcacaggcagattggcctcatatgcctttgctctaattttccgtttgtctgaataaagatgtaacacaatacaattgaaaaaggatgcggattcagtgctggacagtaatagttctagccatgggttctctgtctttctagtaccaataaagaaccccctctcctctctgtgaaaaaaattagttattcatgtggcataatcggttttaacacttagttcaaggctcacaaaatccaagtgattcttcagtaaaatgttaatttcctgttttacttgcagcctcacacccatattgagatgtcactgggctttttttctccatgaaccattttactgaatgtgccaagtgagaaatgtaaaatgaggttgtcatttcaatctggggggaaaggcagggcatgtgttgtgtaggggaaaactcaatgcagcagtctgtaatgcatatgtaagacaaattcagatgatttggggcccttttgatagcatgttctactttttttataagaatattaattattatattttcccttgagacttcattgaagagttaacaagattattgattttttttcaaattaagcaaggaatgtacttgagaatgcataattcataataaataagcatcaaaacactttataaagtcaacaagcaaagttcattctgacctattcaatttttaacttgaataaatttcatatttcttaccataacattatacttcaatgcactgaatactgatatacaagtatatttaaatatggcaataaaaatcagctggaaccaatcagatttatgtgataggacccttgaggctaatattttactatatcatttatttaaactcttatcttactagtctatttaataggacaaagtgattaggtgcttctatttgagagtgtacagtatttgcgttctgtgtcactgacactaatggcagggatctgtgtgattttcggtactggaaattagacaacaaaattcactatcagtaaatttccaagaggattcacaatttggcttaatcagtggatattattattttacaaagccacctgctttgtgcaagtagcaacaatgttctttctatcaaaaatgctcctacaaaatagatgcggcagtaaatgttttacaactagctaattgctacctgttcctatgaaggccattatggaatgatgttatttgcactccattcttatcctcgtactatcccaaagcacatgtgtaggactttacttagagttatcatattgtcagagcaatattatcattttagggggatagtgttgtgttgaagaaagtacccccaaaatgaaataaatagattgggtgagtttcttgcctttaaaacttactatcaggtgtttcggggccaatctctaaatatccctgagccttagtgtgcttctcaacaaagtaatagtaaaatattttgctctactcaggtctcaggactgttatgataattaaaaatgacaataaaaagtattctgtaaactgtaggacaacagaaaaatggccataattatatttttaaaatgtatgcttctggtggtcttgtaaacacaattttattaactacaaatgtaccatttgaaatggactatctatacagttttgacatcatatttaattgattctgttttttcagtgggtttacccaagcttcagttagtttgaaactgttacaaataaacatttgtatacttttaaaattattgttttgatgtgctggtatttgggaaaagagcagtaagtaatgggtaaaacttaatgatcactgtcctctaggtgctagcattgaacagttgtgtccctttttggcttcaactcttcctttccctgctttctttcttactcgagccatcttgtgtctactctcttttcctattccctaatccttgcccttttccttcttttactgttcaattcatccatttcatttgctaccttttccttgggtgtctagttattaggaaaaaacattcacagcattacattacacatgattactttagaaatttgattttctttgcttatattgaatatattccctatattgaaaactctgaaattttcaatataaggatttctgaaattttcaatataaggaatttatttatgccaagcttcttgaatatcttttctattatcaaatacaaatctgagcaagttcctaaaacttaagtagtcttggaaaaaaaatcactggaacttttaaggacataacaacagtttgccagacttctattaaaaaagtagatttgctcaaaatatagcttctttgtgaactataggtatggcttcaaatgttttcactgactgcataatgagcaactagagagcaaggatttggtctaatttatggctgtatacctagtatctagcttggagctctgagtaactaaaacaaaatggtaaatggacttggtgtagtcccaattgctacatggagactcttgctatgcagcaaattacacacacatgcaagtaattttattcaagaattatttgacagtaaagacctaggcagttgtgagaaatagtggtatctaaaataaaatcaatcattaacaaagagtttacaattttgaaagaataattcaatgagttctataagaagaaattattatgttggcttacataacccttcattatctgatcctctctttattctctattttagtttctttccatccctcctccctaagctttaggggttctgaactggtgcttttcaaattgtgtggaagaatgatttgcttttgtttgtttgaatatttcatttctaatccactgtggacgtgtgcatggatcctgctgcatgcatatgactagtacactgctcatttcacatgacaatacaagaactggtccagactatattcaaggccatgatgatgagttcactgatactctaatgttgtaacagtgtccactttccataaaagtttctaagcacttattcgcaatgtccgatcttatttctgtgcatagtctgacagtgaattagtgaattagtggatcactctccaccaattagcacactcttaaattacttgcagtttgcaagccagttgatgccccctgccattttgcttttggtttctccttcctgtaatgaccctttcttctgctcccgactaatcttctactagtctgttgagacttagcactagagtcacctcctccagaaagccttccaagactgatacaaaactctattactatgcttatcctccacatatatcacagcacctattgcctggatctgaacatgtgtgctcaattttctgaatatcaactccttaaaggagcttgctttttttttttttttttttctgtccagtgcctaaaatgacctgtggtcatcatttacatttaatatctaattattgaataaattaatcatcaaatgaagcaaaagacatgtaaatgactctggacccacaaaatagggagatactgattctggttgagggaactgggaaagttgtcgctgaaaaaaaattttgaaccaacgttggaaagaagagaaagttggcaggcataggaaggaacaacatattttaggctgcagaaaaggcaaagaggccaaaagggcaccgaattgtgatctgatcaagcaatgatgacttgtcttatgtgactagaatgttgagtctctggcagataaggctgaagaaaaatctggagagggaggcatttagatttaacttgtgggatgtgtgaaatcattaaagattttaggcactctaggaaaattcattcctgtgttcagtccacagctcctaagcaacaattgaatgccatataccatgtttggccctgctactgaagcataatccccatcttcaaacagctagtggagtagacacacaagcaacatgaaaccattctcaagacttttggtgagaagtaaatgtgtaaaacacttaaaacaatgcttggcatattacaagcactcaataattgtcagcaataatcattctcatacctgacttattattctttaatcttacaagtttacaacattcttaatgtcaggtgtgcctatccaataaaagtggacattgattttttttttttgctacttttacaagtaggttatagcccattgtctctgtcctagtagaatctgaaaataaattgtgttatcgaataagagagcagattatatgctaagtattgtgctctgggctttacatgtgttacctctattatttaattctcatagctccatgagccaatactattattacttccctttaaagatgtataacctaaagcttagaggggttaagtaacttgtccaagggaatctgagcacaggtctatccccagaaagcaaattcttaactataacattctacagctatttattcagaaatacattttttatattttgccgtgatgtaatgagtatgttggtaattcctcgtgtctgcatttgtttcttactttattgttcctcttctttcagattatcaaagtgtgatgtaggctgattttttttaaaaaagcttctttttaaataatattttttctactgaaataagtaatttctttttcttttcattgaattgtatgtcatataaaatgattattctcatgtcattgtaacaaacagacctatttgttacttttttcgcctaactcagggacataatttccttaaaaaacgagtaagctttgaatctctcactggagcaggttttactttcagtgcaaacgagaatccaaagtttgtatcatggaagttctctaataccaggatacataatgggatttttatagtcactcctcaaagataaaggccatttatttttttattttcccataatgaaccatttaataaaacactaagtgtctgtatgccatttacaaatacgttcaagcactatatttcagacttaaggaagccattctcctttcaggcagttttaataaattgagaagccttgtcacttattacggtaaacatgaactcaatcaaattattaataaaagctttctaattcatctttggatgttttcattcccctaggaaatacagttttataatctaacttttaagccatatatatatattttttttcatttttctacattatgattaatcacttgctgattgacattttcagttgggtcttattttcttcctgcctaattacatccagtcattttgttatccttctgtaatttcatgacaactctactgaaagtattgtgactgtagattgatgttccacagcttcttatagtcttgtaatttagggcctattaatggcagactgaggggaaaaaaaaagaacttaattggttttaaattgcccttaaattgtaattagaggagaagagaagtaagtcataacttaagtattttttgtcacaacaaaatttagaggcatccatgtgacacggtactgtttttgatggggacggggaaaacttcttgataactagatgtgtgaatgctactgcaatgcttactgggaaaataaaccagcaccttatggagatgtgtatgagcctgaatgtggcacaagggcctgcagggaaggaatcccatagtagcagtatgaccttaggtctgggggtgactagacagaaaggtgaaagcataatttaatataaaaacaaaatcttccagcaagacatggggcatagaaatgagttgcttcctaacagaatttgagaaacagccctacataagataagtcttctaatcttccatgtgtatttttgttgccaccatgagtcgactttggctgaaagtacattgatcctgccatggttttggtgtggccgtggatggaagggcgatctggctgccacatctgtcacccattgattttccagttgattttgccatgacttggtaggtggggtctcctttctttctccatctgcatctctcccaaacctcaatcaaaaagaatgcccttataaggagcagaaatcatctttagtcatgttgttgaattctatgtgtataatttcaaaactagctctgcttgtagagagtagataattttatataatttgctaagttactctacctcttttacagtggagggaaaatagtcttagatgttgaagagaaacacttgtggagtcaaatacagaaggaagaatataagatttaagattggcataggttatgattttgagggaagagacagttgtagctaagatgatttatttgcattatcagtgaagtgactgttgaaatgcagtaacaattcagatggcaagtggtaacaaggcaggtaagagtatattcaccagtattttttgtgcttcttttgtcaagtgagtgatttcaaagcctttcatatcattattcatggatatgcagtttgtgcatcgggaattagccagagaggcagtttttattttcacagttgactttcagaattatgaaaacctaacttctttaactccatttgcttgtacattgttttgacacattctgtaatgaaattttatgacaaggtaaagcatttatactggagagtacctgattcagttaaattagataaaagcatctgaattggacacacttcccatccccttgcagatgaatctcacttttacagattgtagaaaagagcaagaggggtgccatgttacaacacagagagattttcatcttgcttctttcttaccctttcctagtgcctgtcaaattgcctgaaacacagtaggtagatactcgtatacatttgttgaaaagttcataagtaagtagatgaatattaattacaaactatgtaaagaatttgtatcataaatcaatttttcatatacattttgaaaattaataaaactattaataagtctcttattattttacctgacctacctctgcctgaacctgtatgggtagtttagtggtagacatgtaccttgtatagttatagtgaaaaaaaaattccttatagtaatccatgtcatttatctgagatttttttaagaggcatatttgtatgtaaaaatacataaagcattaaatttttcagtacttccttgtctatagataatttctgttgccaaaggttcagcatttccttgggcgggatcttgagaactcaaagcaaatgccagttcttttacactcaaccctgcaggcttgaggatgaaatatgaataatctgatctacaaatacattcacaaatgtgtataacagctgtatgtagacagaatatgaacagtttcccgttgctgtttaatacttttctgagctttcttcaagtgtttggtgctaactgggcacctcaattattctccatctgtgctcactaccaaagctgccagccatcatactgcttgggccccggagcctatggcagagagcctgacggggtaaatggtgcaatctagtacttcttcctgggctagcctagctagttaatctagtgaacagattactttgtcttcagcattgacttagactacgaaataaagctatgggttgtcacagcctcaaaggcaactttgaatggagaggatattatattagaattccgttcaacagtgtttttcattgcaaatgggatgaaatggtttaaaagtgaaactgctataaatgaaaggttttgggtggggcaacaaaggagttaagtaatcaaattagaggatgagatataaaatccatcagcctcaatttccaatttcactccctatcaaatagtatgctaagctaaaccagagagccttttgttctttaagcctatagacatttttcactgatatggagacttttcttggtaaaaatggacatccatgatttctcataatatttgaatcaagtaatatgtcttatgatgaccacaattaccatttatggagaatccattatgtggcaagctctgtgcaagaagccctatgatagctaattcttgtaataactccacaagttaaatgctattacaaattgacaggaaggaacctaggttcagagcagttaagtaatgctgaatttatacggctagcaagtttctgtgctagagatttgaacctggctgcatttggcagcataacagttattcttaatttatttcacactctgcatctaagagcccaaggctctcatgggtttggaaccaatttctgcagcttctggattcttatcttcactttttataaagctgcagatgaatttgtgagtgggaagagggacactcaaaaacgtcacttaacttttctaagggcattgaggacaatcatcatggcaccaccaatgtgatcctaaattcagagactttttacaaaaaatttgtatttctacatggtacttattttatggttatatttcaccatggtataaaatattaaagaatatatattttttaaaattgggggttcagctgatgaaatggtggagaaagcagtgaattggaatgttttctcttttcccactaagcctgaacagactgctccatctcatatgttaacagatcacacagcctcagccatggataacttggacttttcaagttgatgtgaagaatagggaaagaggaagaagaaggacaggaaaagagaaaatgggaagcaactcaggatctgatttaaaactgtgaaaagaagaaccagaacatatgcccccctttaccctccttgaacagtaggacttaaagcaagtggaacaaaacttttccctttctttgtctctccctaagcaaatattcattttcttgaaggagattgctgatcagaatcaagctctccctacctctctcttgccacatcccatcttgccctacaattcaacttgcttactcctacaccttcaagattcccccactttcagtcaatcaatcatgtgaagagccatgctgtaattttgtgcttttcacatcctcaacttatgttacaatgagatttcgaggtgctttttgctggctcaagctgataagagaaaatatgtaagagtgttggcttcttgagctaacatcagtgttgtgagttatataatgaaacctgtctggatcggaatcctaaagctattatctttctagaactgagataggacacttaaggagccatttagaatctcttagccacttataggttgggaaatcaggttcttttcctcttaaaaaaggtttgttgagggtagcttaccatattgtcagcattttgccttatcagaccttgggagatatactgaattctaaggtatgatttctccatacggttattttgcctattaaataaggtctcaatatctattctggtggtgtttgaaaagttttcacttgggatcttctgtgaccttggtgttgtgtgccatttgtgcatcattaaaaggtcgtaatgaagttctgctgcacacagattgtaaaaggtcaagcagaaagttgggagccaatgaggttgggaagaaaaattgtgcttgctgcagaagttgagggattcattatattgatgctatggggttttcagcagagtaataactgggttagcaatagaaagtaaatcttctcagccacttagtctgaatctgcttcttcttgatttgtggggatatatttttaacagagtacaaggaaagtcattacactcagaggaaagccagtagaattggtaaatgcactgtagatagaccagccaaaagaagagcagagctagagggataaagcatgtcagcttcctggttcccactctgagaggtattgtcaacccatataaaataattggctgagaagaactttgcataagtaattattttaattctttaaaggatctaaaggactgttttttaactttaatgtcctggaggtacaagaatagctaattaacttgcttaaaatagctatcaacagaattaattaaaatgatttaacataaaaataacatcaaaatagcagcaacttcaagtcaatttatttagaaaggatcagcaaggtaagctaataagggcttggctactctataaagtgcagaagctccagttactggatctccattgaatattccctggttgcagtttcttaaaatgggactctagaaattatgtgtaaaagtgcagcagttgattgcatgtctcacaagcttacatatggagtgagataatttcttctttaaacaagccccaaaccatctgttgacttaagtcaaccctctgaattttactttgaaataaatcggaagcctagttattccacaagactagtttaatgtgttttctaaattcatacatgtgaatgcttgggggggaagaaactgtaagaaagctttttctgtagaaggataaaagtcattaagatatggcttataaaattaagactattattaggaatttcaacttaattcaaatccactgatcttaactgagtgtttaaaaggttttaaaaaagaaaaagtgacttttaagaaagcttttgaagcttgggagtgagggacaatgggcggttactgacaatttatttaattattatgttgtattatcaagtattttggtattaaggcacataatctaaggtagaaggactacgtatagttctcttttccataggtggcaccctgttttatatagaaactgatttttttcttcatcaataccacatgttggctaaatggccaatgtatcaagtggagttaatcttttattgctgttcacatataataatctcaacatcttttaaatttttgcttttaaaaaattctgattaaatgccaactaagaagacagtaaattcaatggcttgaacgtattctctaaaaaaaaacactaattatatgaaccagaatgttacatgacagccctttagaatcagaatagtgtatgtcatatatatcattcactcatatagccttgttattcagaagatgaaactattgtttctatctaatttttttctctaaaatgaaaatgttgttgaaattgctatctttgtgatgaaagaaacaatatttattaatacatttttcttttatctctttagaaactattttttctattaaaatgtacatactcagaatactatcattattaatttaacagtgatttaaatataatagttatgtggaaaaatattacatttattattttcttccctcagtataacactgtattagatactgatcataacaaccagaacctttgtcatggcaatcttattcattcatttactcatccatcaaacagttccttagaaattgttccataccaggctttggaaagtttcctctgaaagaaaactctattatctagcaaagaaccagagatgtagaaaaacgattgcaatctaacatgataatgttggatgtaaaatatcattgcatacatagaaacaataatatggaatacagctgatctctcatgagaattaatggagtatggacaacaatggaatgacatctgaaaaatgttgaaagactgtgaaaactgaactcagaattttatttccaaggaaaataactctcaaaattaaggcttaaataaatacatttttagataaataacaactggcaaagttcatcactgcagacctgttttacaagaaaagctaaaagaagttcttgatgctatgggaaatgacatccgtagaaactctgatctgcagagaggaatgaagagcactggaaattatcaattttgagataaatagaagagataaacttcttttattttcttatttttttaggtacactaatgtctgtttaaaataataacaaaatattgtgagttttcccatatatagatgtaaaatatgacaacatttgcacaaaggatgagaaaaaataaaattatgtcatgaggttcttatattttatatacagtactaaaatttgttatcaactagcttagcaaaaatggtaatgtgtgtatttatgtgtgagagagagggaaacagagagacagagacagaaagagacagattaagagagaaaaaggatgttgtaaaattttaacagttggtaaatttaggacaaacatttgtaggcatgtattgcattagtcttttaaccttagtatggttttgaaatttttaatagtaaaagggttagaagtaaaaggaaaagcagatcctaaaggattaaataaataaataaataaaaacaagggggctgggtgtatcacctgaggtcaggagttgaagaccagcctggccaacatggtaaaaccccatctctactaaaaatacaaaaattagccaggcatggtgacaggagcctgtaatcccagctactcgggaggctgaggcagtagagccgtttgaacccgggaggcagaggttgcactgagccaagattgtgccattgctctccagcctgggcaacaagagtgaaactctgtctcaaacaacaacaacaacaaaaaacaatagcaacaataaaaaaaagaaaaaaacaagggaagataccaggaaaagcatatagaaagcttcatgaagacaacacttttttcccaacacctaatatagtgatggaatttagtgtaaaatattttttggtgaattattaattattaatgaacaggaacttgacaggtgaaagagtagaaaaaggaaaaggaaaataattcggaatattagcctatcatcataactacattaacatatagtatagtgatcaagagcaggaattctggagctagattaatagtttgggtttgaatcttgactccactacttactagctgtgtaatcttggacatataacttaacctctctatgccttagtttcaaatgaatttaattacaatgcttattaattacattaatattaattataatattaatgtatgatacatatattaataaggatatatgagaatatgtatatgtataataggatatatgtgtgaatatatatatgtatgtataaatttagggaaagcagttacagatattcattacattagtctttcaacttctcaatagttttgaaatttttaataataaaaaggttagaagtaaaagaaatagttcctgaagcactaattattagacaaatattcagagtaaaaaaagaaataagaatgtaaggttatatatatggatatacattatattaatacacatagtaagtactatatattaagtactatatattaagacacatagtaagtactatataaatgttagcttctattatattgtcttataaaacattaaaaaatatcttaaagaaaactgcatattcaattcaatgaggtgtcaagtattttataaataagtacagtatataatccttaaattaaaaagaaataaaattgtattttttgaaataagtagaagagatacactttttattttcttattttttgaaagactactatctgttttaaaataataatatgttatgggtttttccatatgtagatgtaaaatatgacagcatttgcacaaataatgagaaaataaatgaaattaagttgtgaggttcttatataagtgctaaaatgtattatcaaagagcttaacaaaaatgataatgtgtgtgtttctgtgagagagggaaacagagagacagagagaaagagacagattaagggagaaagaggatgtatgtataatttatatgtataaatttatcattcactctttgtcaattatttgatcatatcttttgaaatatattaagtaaatattctcaaaacacataaccaaaccttgacttctgaaagagaatttttcttggtgtggaagaataattcaagcgtgatttaaacattttaagacattgatttgaattcctcagtgtagtgtcatagcctgcttcgaaaatacgtctcattgattcctgcctcctgatattcttgttcttgtgtgtgtagatacttcttctggtatacaaagttcctacttacttgcttctagtgaatagaatatgttaaaagtgatgaaatgttacttctaagattacattattaaaaaaaaaaacaacatgacatttctgtttcccttgtactctctccctctctggctcttctcacctgctgtgaggaagacagccaccatgttgtaaccttccctatggagaggcctataaagcagaaaactaaaggcagtctctgaccaatagccggcaagaaacgagaccctcagctccacagcatgcaaggaactgaatcttgccaacaatcacatgagtgagccagaagatccagctaagcagcaccaaaatttgttatccatagaaactatgatgtaataaatataattgaagttttgggttaatttgttacacagcattactaatgcacttggatttgtaagactgctttttaaagcaaatttaaatagctagataacttaatgacatttctgagatcttaaaaaagggtcattacaacagacttgatgccaactttcccacaatacaaataatttgcaggctaattatttatgatctcactaatacaaattttcagaggaagtttattttccttattttcttctgtttccctcatttagaagagataatctaataactaaagtaacttgaaaattatggacaggttttttttttaagattctaaaattatctgcctcaaaggaaaaactgaaatcatatcaagataaggtatttatttcaaatatttttaagtaaactgtcaacctgttccaaggttaagtgtggttttacaaaagttgattctctttcctttcacttttgacccaaatatcagtttcatctaaccacagtttttaaatagattatggaacaagtctctctctctctctctctctctctctctctctctctctctctctctctgtgtgtgtgtgtgtgtgtgtgtgtgtatctcataattttggttggttttaggttatagatagttccactgtagtgaagtaaaccagtgtgttatcaacaaatatgtattacatgatctaaaggtaaaattatgtcttgttaacactctttttaaaatgctaaacttaaatgggtccttgctatgggcaaggtgtgatttggcaggaccttaaatctaaatgacttgttaatgttggaaattatgaccaatacacaaagggttggaacctacagtctgttcaaatgactgttctggtgtttgatataaaaggaatgtaatagtaagttcttcaaatattctcaatgaaactaaagtgtttttctcagactgtgatgctcttggtgataaaaaataacatcaacacaagaaaacttacttgacatacttaatttcaaatgcttttgcttctctgtatttctgaatttgttgtttaataaacctcataaatatttcactgtttcactgagagaagttaccttaaataactccttcagataaagaaaaaaattaaaaacaaagtcacaaaggaatatagttatatgatactatgttgaaaattgtcaggtttggcaaatcctgatcatttttcttccgttgctgagagactgaaataaatttgattaatctacctctctacctccaaagctccattaaattaatcagaatacaaatgggaatttagtaaaactagaatatatttgagggggtatatttttgctgattataaaagcagtctgaactgtaataacttttatttctaccaactatttagaaatagttgatcaataattgcaaattcaatacccagaattgatttccttccttgttaaattagagaaggtatttacagtggcatttgtttacaaaatgcagcttaaacatctgcttccaaagtcggtgttttctttcttctaccgttactgagtcagatgaagtcttaactgctgtcaacgtaggcagatctgagtacatttctatgaaaatacttgtcctcaggtctcctctactctgatgggcacaggatgttccactggaggaatttcatcggacaaagttttcacaaatctgtgcagatcagttctatttagtactttaagtcccctgttataccctgtaccagggccccctgatgactaaacttagatatcctttaaaaatggaatgatcagattcaactatttgaagaaaatactttggggcacctggggaaaattcaaaaggacgtaaatattaaagaaagtaaaatgtggaatgttcaagtacagagaattgtcttgagaatcaggacacagaagttttctagtatctgttctacgaatagcataccctagttctttaaagtaatataggatctcctctcaacaggctggcctgaggcaaactgggaagtaggtgaggctggagtgtttgtttcccacttgtatcattccttctagcaataaatatgcattagcattttaagtgggtgtccttgctttgactactggaaattggcattttaggcactgtgaagatagctaagagaaagtgtttctgagtagcagtagccttttagagctccaagatcagcatacagctggcagcccgctctgcctaggtactctggggctctaatatcttgaggacacattaggtagcacagcaaaaatgttgtatagaatacataggtatccataggaaagcttcaggtctgtcccactcccttccagcctgcaaccgtgagcccagtatgctagatattctgacctctatgcatctcctttctaaatcaatagtagagccccagaatgcttaggcagagggggcagccagccataggctgaagttgcagctttcaaaggctactgctactcagaaacactttctcttagctatcttcacagcgcctaaaatgccaatttccagtagttaaggcaaggacacccactttctaaaccgcgcatgtacttgacctgaacctaagtctatcttatactcagaattagctaaatattatttgcttaacagaaatatttgccttagactgactatttgcaggctttcaaaatttgttttaaatatggatttagagaatgttgatgacctcaaaaagaagttatatttgatataaaaatgattagagtcaccatttcgctttaatcaatctcaataatcttctgcttcattttttaaacttttaatgagatttatctaagataataggtgaggtcaaatagattttttatttttaatataaaaatgtgaacagaaagcaatttattgaatagcaagcgtattctacattaatgtgtgtgccgatgctgtggggtaattctagagatttatttaacacctgtaacatgccacgtgagagaaatgagttggtgggagaaaagagttattgttaaacatagtagtatttaattctgtgccaatctgtgtggtggacttaaggaggataacagagtttcaaaggcaggggtcatattagaagacaggaatgttgcacagtctttggagagatataaagaatggggtttaatgtttcttgaagatccaggaggagccccatggtttagaagccagaatagacatgacttttcataaatcgtagattaagtaatactttatctatagtagaacctcatggggaagtgaggtaaagtgcataagaggaatttaactgccttggatatgaggctaaataataaaaagtttttcctgtagtttgtgaatctgggtgtggtattaccaaagtagtgttttggaactataactctgatagctgtgcccaggcctcatgagacatgagagaggaggccagatgaaggagaccaattagaaggatattgcagtgacgggaaagatgatcatagtgggaatgataaggaaaggaatgtcctagggacaattttcaaaagtaattaatgagacttcctatttatataaacctatgttatcaaaacatatatttttcaaagcaaatgaacactttgaggctggatgaaggaaaaacagcacacttggttgtagacagctgggcagggaagtgtgaaactgcccacagagggtacagtataaggggttcattgattgttcagctgtttgggcaacttctgccctgaatgtaaaaagaagatgaggaaatcatctcagggtgtcagataagtaccaggaaaataattcagtcttcaattttgatattatttctggaaaatcagtaaagtgggtattagcataggctcggagtcagaaagaccaggttttgagttctatttagctgtaaacctgactacttgtgtgaactgggttgagtgacttaagcatcactaaatctcagtaaccacatctgtaaaatagaaacagtaaatgacctttatagtttgattgtaaggattaaatgagatagctaatgtacaatactgaggagagagtttgacatgtagtaattagccagtacataaatattagctgtcgctgttcttatggtgacgatgttataaaatggccaaaagaacataggatgatggctttggaaggagttagaagcaacattgcaagtctgatatttttctgcagctctggagaaaactaaggctatgaaaggctaaatttaagtgaaaccagacagaagattcctacctcacatttttctattaaaatgagaataaaagcctgaaactatgccttctacttggttattatttgcaagatagttcataacatatacctcactatctctgactttttgtgttttttttttttgaaatggagtctcgctctgtcacccagcctgtagtgcagtagtgcaatctcagctcactgcaacctctgcttcctgggttcaagtgattctcctgcctcagcctcttgagtagctgggattacaggtgccagccaccgcgcctgactaatttttgtatttttagtagtgatggggtttcaccatattggccaggctggtcttgaactcctgaccttgtgatctgcccacctcagcaatccaaagtgttgggattacaggtgtgagccaccgcgcccggccttatctctgacatttttaaatgaaaagttaacatattaaatattagaacattataaaactatttttatgagaatgtcagggttggctaaatatataaactgataaattactatgaagttggtatactcattgatagtaatgggcactgggtgcagtggctcacgcctataattctaacactttgggaggccaaggtaggaggattgcttgaatgcaggacttcaagatcagcctgggcaacatgatgagacccccatctctatgaaaaatttgaaaattagccaggtgtggtagatgcacatgtggttgtagctactccagaggctgatgtggaaggatcacttgagcccaggaggtcaaggctgcaatgagtcatgatcacgccactgtactccagcctgggcgagggaataagaccttgtctcaaaataaataaataaataagtagtaatgggcaagagtaagatacaaaatttttaaacattgaaaatttacgtaggaaaactccgaaattttttggtgaccacagggaagaaaaacagggaagtgaggcagcttttagttttttgacactttagcatttattcagaattttatttttaagatggcagcatttaagccaggaagacagagaaatgttggtagaatactgaaggacatagctagttaggaaaatagaatcaattaggaaaaaggaagtgaatgcttagttttcttgtatgaaaccagaggcaggagtaggctatcccatctaaaaaagatgtcaggtggatcaggtttgatgtcttatgcctgtaatcctagcactttgggagaccgaggtgggtggatcacttgagtccagctgttcaacaccagcctgaggaacatggcaaaaccctgtctctacaaaaacaaaacaaaaccaaaacacacatgaaaaaacaattagctgggcgtggtggtatgggccagtaggcccaaccacttgggagactgaggtgtgaggatcacttgagcctgggaggagaagattgcagtgagccaagattgtaccactgcactccagcctggatgacacagcgagaccctttgcgagaccctgtcccaaaaaaaaaaaaaaaaaaatcaagtgtgcatttgtttggaaatatgaatctgacaagtgaataagaaatattctcagttcattccgttatttattatgtacatgttttctgaccgaaaccgtattctgtgagaaactaagtatttccaagaatatagagacaatggtttgctctcaagaagcttatgtccaagtaagatctagtcggaagatctggaaacccttctgaagaagttagcattgagaatgtctttaaaaaagatttcagagggcagagattagaaggcgcctcatgtggaaaggaccagaatgaattaaaaggtggaaaagatgcatagttgataacagagaagtaaaagtaattatgttacctggttgcagaaaagggaaaataaaggggagaatctttgaaaagtaagtctaagtctactttcacgttattgtatttatcctcgcagttactctgagtggtaattgcatgctcctttcattctacaaatgaaccagagaattcatgggtttgcctaaaatcacttaacaagaaagtatggtacaagaactccccatcctaaggagagactatgtccttggggaaggaagcagaggataagattttgaccttgggtgagttaaaagatggcattgtaagatagggactagagaaagccaacagagaactaactttggcatgaggatgaacagtgtgtgctgtaatggttatttgacaggtgccagtaagagaacaaaaataagattggaaaatatagactcaggagttttatgtgaataaaaccatgaaagtgtggggcacatcaaggatactgaaggcaaaatagaggatttgggtatagtagtgaggtctgaattaaaattgagcaacgggaatgtgagggcagccacgtctgtaaagctgtctaactgcttcccacaaagcttgcagtccagagcaggaacagaccaagcagacacagtgagtgacagagagaagggtattggtgtttgccactttagcataaggtaagatgtcaaagattcgttttggagcccccctagaaggaactgaccatggagttcaaaatgagttcatagcagagtagcaatgaggaagttaaagagaatggctgagtgaatcactaccagtattaatatgtccatacctatgaagtagatttgaaacataaatgactcaacttgaagacagtaagatatattgccactcccaatgtaaatagtatcatattttctgattaataaattaaatgactgagtaaaacatgccctcttgagtggaattttctggagtgaaattccatataaatatcaaatggcttcattacctaaataactccttaggctatgtttgtatgatattgatataaatatatataacaactatctaatcatatttttaagagaataatgaatcaataaaaataaaattttagatacagtgagttcaagaaaatcataggtttttttttcaagtgaagaaacagaatgaagtcatgctagggatacagaagccattcttttagaacattattccattccatcgcaaagtttgtgtacaacttctacaagttttagtttatatttaattaagattagctaagaggttatgctgcatgtatttcaataacttttgaacaataaaatttcagaattttggcgggggggcactttagcatatgtaaatagtttcagtatgaacattgagcagcacatcttttgaacataagagctaatgaggtttaactaaaatcatttcttccactggtagaaaattccaaatcttggcgtcactcttttggatgaagacactggttctctgagttcttttccttctaaaagtctatatgtagcagtgaagcctgaaagatcattttcaatgttttggaaattctaatgaaactcttaatttacttcttcccatttggttgaaagtatcacagttctaaattcgtgctaatcagaagctcagattaattgccggtgatatcaccaaaacttctggaatatgatgatagagcagacacacttacctgaatcatatgtctgattatcacaatacccatatccatcacttattttcttacaaatacaaaatgacagtcaaaatctttcaaaacataagatccacagaggaataatagagtggtccttttagttaaataaatgataaatactatatttaaggtactaggaatatcttgacttaaatgtaaatgtttcctggaatgaggtaataagcaaattgttagctttcatctaatataaatgtggagaatggtttgtcagatacactagcagaaagtagtctgttacagtatgcaggaagggtgtcagtgcactgaaaagcttgggaatagaattcttttgggaatgtttgtaacataagcttgtttggaatccagtgtagagggagcatctcaaaataaaaggcttgatttcaaatggagaattgaggatgtaaataactctcacgtgtttctgtctaagactgactctatataaatacctaggaaaattaagagaatcaaacagactttataaatcacaattattgcccatttcctattggcaaagatgataatgtgctaatatttatggttaagcttctgtggttggggtgttgtttgtgattataatttcacactaatttaaatgatgtttactttagtagaagcataaatatacaaaaggaattatttaattccaaactgttctttatagtaatgaccaactacatgatgacaagggtgagtttaaattctgggtgattacttattttcttgttgcaaacatattgaaaatctggaataaaatgcaagtcataatatttacgatcagacacggatgttactttggcaaattacacagggtttacttttctaaaggatagaaagggaagccagtacaatcaaatttgaaggcagagaattcagcaacattattttaccacaaacattgatataagtttctgagcttcccagtgccaactcactagtggaaacgtagttgtggatgattcttagcgtgtaaggggcacatcagaccttctgaaagttcaattactctcttcagcctagctttaaaaagacaaaagttaagcagtccgttacacagtcttgcccagatacatgctggccacaactaccactgagccgtgggcttcttagtcttagggttctaccgtgcacaatgtgattgctagtatataacagacacacttaatttggaataaacttctaatccaccactcttggtcttcccaagattgtctcacttagacccaatacattcctgattctagtgctgtggcatcagaacaagccaaacatctcttggagtggctaacagacccttggatgagctatagatgttatttggcaggagattacaaaatctaccataaatctgcatcctgaattctggtggcatttaaaatatgttcttacaatggtcgaacttaatttttaactctactaaaaataaatacaaacaatctcattatatttctaaagaaatatgtttccacatcataagaactggggaaacttaggatacaatcaataattctttattttaagaaagcatactgtcaagataagttattacatgaagataatgattttaaaccacataatattggttgatttggatccttaatcaataaaaattagcaaatctatttaaatgataatcagagctcctagattagaaataattttgatgaagcggtcctttaaagtaaatgccagacatgattgaaaatgtcacaaaaggaatcggaatttcctcctgatgcccaacctgacagtacgacttgcccaggaattacacattcttattgagaggagagtggagccagataggcacagacatttctgcaaatttatatgactcttttcagtttttaacagtaagactggtaagcatttctatattaaaaaatgtcttaaggaaaaataaaattttattccagatacttatgtttcatcattagagctaaaaagaaaaatgaaaaggacataaaaataatgcataagtggattattgattcttgagcatgccagtatttagatataaatctcagtggaactgaagataagctattaatatttaaatttcattgctttaattaattttatcagtatcaaatcatgcatggaaatagctaatttgacactaaaagtatacactttacattgctatatgaagaatcactgtgggtgtaacaacatctgactaagtaattaaactaggcgacatcactttattttacatatgtctgcctacactatatcattcaattagctcataattgtaaaaccaattaaattctgatttttattaattatttgtcaaatatatgtgatattctgtgtccaaaatttgaccagtggttttaaagcaagatgttttgtcattttaaaaataatttattttcaaataaattttgttttatttagaagtgatacaggcaataacataattctaagtttttgaaatatatttaacatttctttacatatatgtatatatgaaaagaaatgctatgaaatgtcatatgttttatatatatttatttatttaacaaagtctgtaagaattagactcagtttcctttattggtttagccgtttgaagagcatagggaaataaggccttacccttctttgcatcactccattcaaacctcagtgccatttcctgaacactcacatttggtctgaatctgctctggattctggggactcaggatgcgtctgaagaggcccagacagcgttcctctgttctcaaccaaaggtttcatctaaactggaaatgtttttctgtattctctttgcctaataaattcctatacatctttcacaatccaattaaattgtcatattttctatgaaacctttcctgaagctgctagagagtgctaatagttcctttctcctctgggaccatagagagagagagagagagagagagagagagagagagagagagagagtgtgtgtgtgtgtgtgtgtgtgtgtgtgtgtgtgtgtttatcctcacatgtgtgtatgtacatatgtgtgtttctaaaaccatcaacacttgtcaaggattgtatacaggaaatggctaatgaattctatctatgtggctgttacttttaaagggttaaagagtatcaccacttggttaaaattgtttgtggcccttggaaatcactaacaatggtacctaaataattcaaatttctcctatccaaagcagctccaagtatgttcagcttgtgaacaattaacatacagaattctctacagctattaataaatgctgatttgtttaaataactggacatttaaaactgattctcaatagaaaatttgccttatgtatcttacatgcatattttcctactaaatcaatacactgatggacacatcgagtgacaaattacagataaaaatatatttctttccaggaaaaaaaaaaacctattcccacttttaaaatgagattatgtagaatacattgtgggaggaaatgaagcattatagtacttagaaagtaatgctcccttaagatccaaatgcatcaacctagataccctgactaattttacaggagtttaatgcactactagaacattgaaatctgtgaaacagctccactaacttgatttttaagtgaaacttctgttgtttaaaggaagcagtttacttttaaagttgttaaaatagagaaattaattgtataaatagtagcaaatgatgatcagaaaatatttggacaacatgaggaaatatatatatttagacttttagcttctttctttctttcttttctttttatttatttatttattttttttgagatagtctctctctgtcccaggctggagtgtagtggcatgatctcgactcactgcagcctccgcctcccgggttcaagcatttctcctgcctcagcctcctgagtagctgagactacaggcatgtgccaccacgcccagccaatttttgtatttttagtagagacggggtttcaccatgttggtcaggctggtctcgaactcctgacctcatgatctgctggcctcagcctcccaaagtgctaggattacaggcctgagccactgtacctggcctatcttctgtctttttaataatttcagccaaggaaggcacatttgatctttataggaaatgaaaaccagaaaatttcacagatgtgcagttactctctaatgagttaaaatactgtttcctgggaggtgggggaacaaaatggaggaacaaaaccaaacagtgaaatatgtatctatatatgccacatagtcttttgtctacagaagaaaaaaatctcaatattgctaaaacttaagtagaatatttcaaaaaccatactatatgatgtctctattatatttttagaaaaaaaacactagtgaggttttcaaggagaggaacaggtaagatagattattttgctaattaatgtatagcatgtaattctggaaaaggatgactagtatgtgtgtcagattcatccttttggagagatgtttgaaaacatcccatttcattatgtcaatgtagttccctgaatccacacagcttgtgcagtgtggaaacacagaagaactcagtaacatttattagaagtattaatagtgatcaactgtccattggaagggttctaggcagaaatttagactagattgtttctgaagtgtcttgcaactctgaaattatatgttgtcttaattttgttttcctatttatgtgtgtataggattagaatatttcttacacaaaagtatatagacattttaaaaaaaagaagtaatgacctaatggaagggttttactctttggggtcacaaagaccaaaatgtaaatcctaaatcattatgatgctacttcctacctatgtagcattaggattatttatttagtttttgagacgcaggttctttcttcatagggtgatcttaaggttggaaattactttctctgttttacgccatagtctctgaaaaagaaaaggactgacaaccacagtggtttactgctgtttcaacttagaagaaacattggatttgttaattttagagaaactttatttcagtcatattttgcaacttactactctgggaatatcttgcatttaccctctcctttccaaatcaacaaatctaaagaatgattccttaatactagctgcatttctataaatgaagattatatatcctttattttttagtgacacaagtaccgtaatacaacggtgtgtgtgtgtgtgtgtatgtaaatgtggatatatttttccctttagtctcagattgcaacgttagtgcatttggctaaagactgtatatactctcaaacagacaacctgcagaatgggaaattatttttgtaaattatgcatttgataaaggtctactatccagcatctacaagacactgaaaaaaatttacaagaaaaaaaaaactttcccattaaaaagtgggcaaaggacatgaacagaaaattttcaaaaggagatatacatgcggccaacactcatatgaaaaaaagctcagcattactgatctttagagaaatgccagtcaaaatcaaaatgagatacgatctcacaccagtcagaatggttaaagaaatttaaaagtcaaaaacaacagatgctggagaggtttcagagaaaaaggaatccttatacactgttggtggaagtgtaaattggttcaaccattgtgaaagacattgtggtgattcctcaaagacgtaaaaacagaaacaccatttgacccagcaatcccgttactgggtgtatatccaaaggaataaaaatcattgtattataaagacatgcatatgttcattgcggcaatattcacaaaagcaaagacatgaaatcagcctaaatgcccatcaatggtagtctggattttaaaaaatgtgggacatgtacaccatggaacagtatgtagctataaaaaagaatgagattatgtcctttgcaggaacatggatagagctggaggccatcatctttagcaaactaaaacaggaacagaaaaccaaatagtgcatgttctcacttataagtggcagctaaatgatgaaaacacatggactcatagaggggacctacacacactggggcctattgaagggtggaggatggaaggagggaaaggatcaggaaaaataactaatgggtactaggcttaatatctgggtggtggaataatctgtaccacaaacccccatgacacaagtttatctatgtaacaaacctgcacacgtacccctgaacttagagttaaataaaaaatattaaaagataaacaatggaaaaaaaactgtacatactctccacatattacatttgattcttttggccctttgctgtaataatttctgtccaatcaaacatttcaccagtgcctacatccaaaatatatacccaatgcgatggaaatgctcaatcataacatagaataaattaaccctttcctatagttctgttaccggcagcaaatccgtacgggtctgcaacaaccccagttcttgcctcctcagaagaaagaatttgaccaaggaggcatagggcagaaggagagactgagacaaattttacaggagtgaaagtttattaaaacattttagagcaggaatgaaaggaagtaaagtacatttggaagaaggcctagcaggcgacttaagagatcaagtgcgtcatttgaccttttgacttggggctttgtatgttggcatacttttggggtcttgcattacttctcacctgattcttcccttgggatgggctggcacatgtgcagtgggctgtctgcaagttcagtggccagtgtgtttaatggagtcgtaggtatgctcacttgaggcattcttcccttaccagtcgttccgagaagaagatctaggttagactccaccattttgcctcttagtgtgcatgcttaaacccacttgcccagctcctgagatcttatcaggaggctgctgatcatcagtttcaggtttttttttttggttgtttatttgttttgttttgctttgcttttgtttttttctctattgggagactgcctttccctggtgctggctgagaccaattattattttagagagacagttaacaactgcctaaccatcatttgaatttgatggtcgcctgacattcctggtgtgtgtgtgtgtgtgtgtgtgtgtgtgtgtgtggtgataggggaagcgctctcctgccctgctcatacctgactagctacctactgtaatagttctggtaaaaattaaacgtgagaaatctagttattgtgttgggtgggctgctgaacttaaagatcatgttcatcagtggataagttgcatccttcatccagtttacaagtcacggaatacacttacccatgacttataacttagacaagaaaaagtctgaattgctccatgttggtgtgcattggagggagagaaagacacatattatatttatttatgacttggtgaaatggggatacttaaattatagaagcttcctttcttagtccatttaggctgctataacaaaatactataaactgagtggcttataaacaacagaaatttatttctgacagttccagaagctgagaagttcaagatcaaggcacccgaaaatatggtgtctgctgaggcccacttcctgttacatataaggtgtcttctcatggagtactagcatggcagaagagggcaagacagctctatggggactttgttacaaggacactaatcccatcaatgagggttcccccaacctgatctaatgccccccttacatgtcccacttcctaataccatcaaattagtgattaggttgtttttttttttttttttttgagacagagtttcgctcttgttgcccaatggcatgatcttggctcaccgggttcaagcgattctcctgcctcagcctcccgagtagctgggattacagacatgtgccaccacgtccagctaattttgtatttttagtagagatggggtttctccatgttgatgaggctggtctcgaactcccgatctcaggtgatctgctcaccttagcctcccaaagtgctgggattacaggcatgagccaccatgcccggcctaggttttcaacatatgaatttgagggaaacacaaacattcagacattaccatccaccttgaattatttaatcgaatttggggacattcctactatccagtttatccatatgagagagtagttgatgattccaatgtgagccatttaggctgtaagattgatactgaaaaatgtacaatggctgcagtgtaattattactttcctagtgatgtcattaaaatgaagatctaagaaactgatttcattattcaaagtgggcttttgtaactgctcctgtatttaaagagaaaatatcaaacaactttaatagagccttccatccgaggattctctgttgaggcaaaccacacatttatataagatatatacatatattcccaatactttcttgacatgactacccagcactcacttttgatatgcccatcctaatgttcttttatttaaaatcctacttagatcattgggctagtgaaaagtcaattaaaaaaacaaataataatttaaatagggagggtagatatattactgggcttattaacactagctttagcaatcatttttctatgacttttcatttaaaatgagacacttttaaatgcaagcaattggcagcatgttattcagccattaaaaataatggtaaaaaagactacataatagagtttaagatataatagtaaatagaatatatacaatagtatatactgtatatacaatagtaaaagaatatatacaatatctactaagattggagctttgttttaaaaagcaatacatttttaataagaaaatatataaacatattaatagtatttatttttacgtgtgtgacagaatttctgttcatttttttctttttttttgaaacagaggttcattcttgttgcccagggtggagtgcaatggtgcagtctcggctcaccacaacctccgcctcccaggttcaagcaattctcctgcctcagtctcccaagtagctgggattacaggcatgcaccaccacgcccggctaatttttttgtgtgtatttttagtagagacagggtttcaccatgttggccaggctggtcttgaactcctgacctcaggtgatccgcccatttcggcctcccgaagggctgggatcacaggcatgagccaccatgcctggccctgtttatttttttctactttattctctatcattttatttaataaacatagattatgttcttaaataacatattagatctaataaatgaaataaatatcagacatataacatatatgttagaaaatgacatgtatagtagatgaacatatgttaatataaagctatacagtgtagggaaataatcctgtagattctggactctgacagaacttagatggtgattccccttagcaagttagctcaactctgtgtagctccattcattcatgtataaaatgggtatatacaaataatcttaatttatgaattaagataaatatattgttaggaacagatgtatttatatatataatgaaactaaaatagtgtctcgcacatagtaggtagtaaatatgtattaactattatgatgaaatttatactataatgaaaacactttaaaattgcagacaacctaatattcagtgttcttcgaaaacacatagtgaattcctggaatttaatttaaaatacataataacatctcatatattgaggttacttgcatgacatctttaactatttggaaaaaagtaaacaatatagattttaagtattggaatacttttaaaaaagaaatgccggaaagttcataggctgatgctcatgtaactcattcttcacatagtctcaagctctcactcagagaatttcttcttattttgcatccaatgctaatacccggctaatatagaaatttttttcccttataaccacagcaaacaaggaacaggtaaaaaaaaaatggtggccattggaaacagtctctctgacaagagtgaaaaaaaagagctgatagccacatggtggaaacagagacaggactgctgcacattatgaagaaacaaaaccacgaccacaacaaaaccaagcactgttcattctgtagagggataaacagcctctagatggaaaatatcattttgtattttgctgtagagtgaatacaaaaaggtgatgcttctgctaaattattatgattgttatggttagaactcactgtttcggaaagcaggaatattttttcacacatttttaaagaatttttttaactttagtacttttgtgtgggatgggctatggaaagaaataattgcattaaataacttattccttaacaatttcagataattgagtaacaatacagaaattctaaatcacaattttttaaaaaaagagttttcctcctttacagttcagaatatttaaaaaataatctacaggcacttacattacaacaaagtcaatcaatttaactaacaatagttattgaagaagaaaattcattagtgaataggttgcagcaaaaattaacgtatcttcacatagaaattttctccagattttacatttttaaaaaaataagactttctgctctctaaaaagacagtgcaaagtgaaaaatgaggaagaaaaatcaacagaaattgaacatgcaaattatattcatttaatctttgtcctctaaaaattcagaatataatagaaaccagataaccaaaataagggagagattataattgtgtttatcagtattcagaagtcaaaaaatggtaagaagggattatcctggcctaaataatgatagagtgatatcaaccacctaataacttctctgagaaaatactgttcctgacatttaatgctccaaattcttcctgtaatctttgttccactttttgatatgtcataaaagtttacacttttgtaattcaatcatgattcatgtttttatattggaataatgagcttcagtcttgatatcttgctaaagttaactccaaatacttaaacaatgtgaaatatttttcttttaaaaactaaacacgaaactcaataggaagactgaaccataattcttcttttttgtcaaaactaagactatatttcctcaattgcaaattatctttgattgtaagaatcatcaccaaactagcgaaaattcttgaaagaaaaacattctcatatttaaaatatattttggttgtgaaatgagatttaacttcacaaaagttaaaattataaaaatgtaaacattatttcttaaaatttgctccttagggatggatagataatgtgataaagcaagtgtaacaaaatgttaggtgtagttgttatatgaatttgtattatattctctttactgtatgtttgaaaattttccagataaaatcttgggaaaaatatgcttcttagaacagagaagtttaaaactccttattcaaattaagaaaaataacatttattaggctttcaattgcatttactgaattccctctctatgattactcatttataaatggttttataaaatcgtatcctcataagtcaggtgtgaattaaagtcatttcttgggcaatacagtccacataagtaacttcattcttacccattagtcttattcacattttctcctttcctggtactccaaacctcctcccaaagaattttcaaaatatatagatcttccctttggagcacttttcaaattagaccttgtattgtggtcattgtgtctgaccttaagcattttgagtgaacatattttgtactttatccttcatagcagaagattacagagtaagaaaggctacccttagaaagaaagtggatatgtttttcttctttaaattaaaaatctaatgggcaaatttctaatttttaatctgtcactaaactattgaaaagtaaatatgttgtctgttggcagcaaaaagatttaaaaatacatataagctccacttttttaaatgagctattcattctataacttttcacatattaggctggtgcaaacataatcgcggtttttgccattacttttagtggcattatctgagcttctatcatggtcaagaaaagactctgactagagcagtcttccaacttccgttacaatgatgattgtcaatggatttgtaatgaaattaacaaatttttggataaaatcattaatatttatgcataatttttaaaaggccaaatagtacaaaaacgtatatatgaaagttattcttttctgatcatacataccacaagcaccaaatattttaccaactttctacagtaatgacaatcactttttcctttcaggaatatttgatgaagtatatatatgtgtgtgtgtgtgtgtgtgtgcgtgtgtgtgtatatttatgtatgtgcacatatatatttatgtatgtgcatacatatatatatttatgtatgtgcataaatatatatatatttatgtatgtgcataaatatatatatatatttatgtatgtgcatatgaccggtttttggattatattatatgattgttaaacaaatactttttaatttttttgcctaatcttaagacattaattactaatagttttaatatgcagcctttaggaaagaaatcacatatgtaaaaatattcactacatgctctaaaatgagccttggtggaaacatgaagaggatataacataacgttaagttcagaaaagaatacgagttttataactcagtataagccactatataaaacatatagttacttaagatgattggaaaaagaaactgaaaaattttaatagcctttgtacatttgtggtgaaatttatggaattttttcctcctatttcacccaaaactatcccaaaactttaaaaaatattcaaaatcttactatatttaaaataaatatttgaataatgcaaaataaaataatatgtaacatttatttttttcttactttaaatgaaaagtttacagtagaatctctacaaaatcgtttgtgtttggcacagttattttatttttcttgttataaatccccaaagccaagattcagaatcttttagcatccaaaatgtaatctggaaatgtggtgtaaaatatttcctgaaggaatactattatctttacatagacaaaacgtggagctggaggccattatccttcgcaaactaatacaggaacagaaaaccaaacactgcgcattctcacatataagtgggagctaaacaatgagaacacatggacacatagaggggaacaatacacactggagcccacttgagggtggaggtgggaggagggagataatcagaaaaaataacgattgggtactaggcgtcgtacctgggtgacaaaataatctatacaacaaaccccgtgacatgagtttagattatccatataacaaacctgcacaggtacctttgaacctaaaataaaagtaaaaaacaagtatgtgggtgtttgtcagaagcactcatttccttacagccattttgttttatatctagcgtggtaataacaagctgattaacttttctggagtagttaagtgtaaaattacaaagctgccaatgcatgcgtattctgctggtatctcagaaaaaggttttatgaaaagtgcttttattattttaagccacaattataccacgaaagaaaaacacatacctgcataattttccaaagtattaagtaactaccaaatacgtcccgtactctcacccctaaatccaaacccagacctgggtttcagatctttgcatacacacattctctgcattttttcatgactgtgtatcctggcctttagatataatgtaaagttctatgccacaactatacctgtggtcactacaaaatgaattttagtatgtttatatttgcccacataattatttgacacttcataattgatcgtaaggatccatcactcaatgaatttcccttttgaataattaattatgaataagaaatgcagtcagtcatgtgtttaatttctcttagtcccaattatgtatcagggaaagaaagcaaatgagttctccattttaagaagtattttttgtttgccttttgctttgtattcctgcaatatggcatcatttgctgctcagggcagagacttttaaatcattatgaatgcaagcaaagtgttaataggttttgctgcatggcatatatgctattatatatgtgtatgtatagcgtatatatgctaatattacattttgttttttcctcaaatgccaagatataaaataaagtaatatcatagaataataataaaaaacattcattttgcttcaaaacttattttgtattgacattagtaacataagtgaatgattaatttgcaaaaggtaagcaattaatatcagaggctagcaaaggttcagatactttacgagagaaggcaataaggttcagaagcaagtgacaataaaaaggagactagaacaggaaatagagattacgtaggaggcctttggagaacattcaaatgaaggacatgttacaagttcccattttactgcctttattgccgcaattgagggcgttgtttatcaaactgtcaaaagaaaagagagagaataggatttttaaaaatcattaattaaaactaaattattttggctgggcacggtgactcacgcctgtaatcccagcactttgggaggctgaggcaggcggatcacgaggtcgggagattgagaccatcctggctaacagtgaaaccccgtctctactaaaaatacaaaaattagccgggcgcggtggcaggtgcctgtagtcccagctactcgggaggctgaggcaggagaatggtgtgaactcgggaggcggagcttgcagtgagccgagatcgcgccactgcactccagcctgggcaatagagcgagactccatctcaataaaaataaataaataaataaataaataaataaataaataaataaataaataaaactagattattttttacttcttaaaaatcaacaaggatccaaatatttcaagacacagtaaagaaggtgcctgaaattcatcacaccaagtgttggtctctgcagagtacctattttatgacaggtttgaaatagaagttggggataccatagaatataaaaactccgatctctttttaaaaatcaatagcttttaaaatcctaaatgctctcacttctgagattaataaacactaagaatccatcctgaacacacacaatggcttctattacaaaaggaaaaatgaaaacagtgctattactgacacagtcaatagatcccaactcagtgtatattgtactttctatatttttaatttaaatgcatacagttctagggacgggagcgtgatcagcattcattcacttcagagcataatagaagatatggaagtttttcccataaataaacatataacctgtcttgggtactatctgcttaaaatattttctctggaaacttatctagccattctcagtacgtggttcttccgctagcctgttctttattactgctttccttccttccactaaaacttgagcagaaaatcatgaaattgtggtctctgcttcaggtttgaggacataaaacctagagtccacaaaaacagcagccttccttgaaataagagaggatacaagaaaagtttgcattcacactttccttagcttaaaggaacacacaattttagaagcataatgaattttcagagtacctgaaaatatttcttactttttgtgtttatatgcccttacagtaaaagggacctctactttaaaaatttttaaagtagttaatatatattaactcaaacaatccttcagcaagacttctattcttattatgaagggtgagactgccaataaatcattcgagagagctttacagtattcatgtggagtgtgctgcagatccacttaatccaattaagttcaagaagtaattctctcactgatggcatccagaatttctatggcaaattcacaaatgcattcagagggcagagtaagctctataatatttgccttggggactgcataaacaggctttttttttttttcttttaacatattatttggcagacgtaggttttagtggtggtacaatcactatatctagagttatcagtttattttaactcattaactctttatcagccaaaaggcagttctataatgaaatttatcttaatgaaaagcaagcctttatttattgaactgccttattaaaaaatgtaatcactttttctgtatgtgaaccagcaaagtgttctgtttacctaatgtaaattattttgtgttagaattttaaatagaaaaaagaaagaaaaagagactaaggtccgggcgaggtggctcacacctgtaatccttgcactttggaaagctgaggcgggcagatcacttgaggtcaagagttcaaaaccagcctggccaacatgatgaaatctcgtctctattaaaaatacaaaaaaaatagcctggcgtggtggcaggtgcctgtaatcccacatacttggggtgctgaggcaggagagtcgcttgaacctgggaggtggagtttgcagtgagctgagatcgcaccactgcactctagcctgggggacagagcgagactctgtctcaaaaaaagaaaaaagaaaaagagactaagacagtaattgtttattgctccagaaagtcccacccgcaaagatatttcaagggagaaagaatgcttggacaagttcatacactgagaaggttggtcatttgagaaccaaattgaaaggaattgtctaaccaaaccagtaaaactcaggttgaatatagagacacataaagatcaaaaccccaagagaaatggcaatatttgtacgtgacggaaggtgaaatttaagaaaacaatgatttttttttttttcagaatgttatggcaatcttccagaaagccacagatgattcagccccttgctactcgaagtgtggttctcagaccagcagtataaacatcatcagggagattcttagaaatgctggcgtcaggcttcattctggcacatccaggggattcttattccttctaaactaagagtagtaatttttgccttcaaagatacttgccatccccactggattttaacaattgtaaataacattgtgacattgatgcattgctagaccatcagttcttgcagctgaagaagtacagtgctgcagccaggaggcaggatttctctttttcagacagctctgaccttcccagggcagtgattgattttagatgaccaggtgcctgaagaaaattaacctggagttgtaaaatcaagatgaaatttgagttaatctctaatcagtctgacgaatgattcaagggcttcaacattggtcatctccagtgaaaccttttaaaacagctatttgtgtttatagctttctcttataaccatcaggcggtttctatatttattcaaaaattatagaatgcattctactctgagtttttaaaaatttctctaagtgatttatgctgacttaacacctgttgaaaacaaatgcctttcagttacttaaaagaaaaactcaaattaataataggcttgccttcaaactttgcctgtggcacaaatattttctttaactaatgtactatagtatttagtcagggaccatgctgcttccaaaatagatccagaactattgtttgttcattcacaacaaattaacgaagaggtcatgctgcagctaccatgatttttaatccaaaaatactgtttttaaacataggttgatgaatcatttattttccttctcaggaaccaaatacatatttttgttacagtgactggttttataaaagtaatatataaagtttagggtattttatttttgcatttaagatactgtaaaacttaaatcctacctagttacaagttaaataaatggttatgtttaaaagataatttctaattcattaattactaattagtggctccgctgcctcttcctgccatgtaggctttgattattttactactgttataagcctccccaaacatggccaagtcccaaagggaagagcaatcaatcaaatctattttaagagtactgtactaaggaagttttggagtaaatgaattttaaaaataaatctctgaccctctcccagcttataatctttcaacatataaagataaatatgtccaaattactattacaaataaaagtgcatagaatataaatatgtatgaagagataaataaaaggaatatgtttgtgcaaagcattcctcttagcccatgaatatgtgctataaaatggagttgcactgagaaggcaccagaaacagatgactcttcagagcttgtaagacggtactgaactggtgaatggaaggaggaaattatgagctggggagagacacataagctaaaccaggggaaagaagacatgtagaggaaaatatccaagtatgatagaaaataaagaataatttcaccaaaaatggggaacaggtactgtaggtataggcataagattgggagtcattttaacaatgtcagggaaaattttgtggaagatgaaatgaggattttggcaaaaaagttttcatttcttcatatatgctctaagagctatgtttgcttcctgttaaaaacacttgtcacaacaatttgccatttggcaattattaaaaaaaaaaaatgaaagtaataccagtgatggcattctgttttctatttttgagataaaccaaagagtgacattagtcataacattataacgtttctcttattattatgatgatggttattattattattattattttacttcagcagggaaattgggtctctagggcccatatctgctgccatatatgcactccaatgcatgacaatactggccacttcatgaagatatatagttagtccattccaggtgtccctaaagagaatatgaacattcaacttaatgattattcaaaagttagggacaattgccaattcaaatgtggaccatggattctaacttcaaatctgttctctgtctccctttcccccaatgtttcattcatcaagtccttaaattttctaagccattatcaaaatgaactggatctgcaccaggattttagaaaggagcagtcccatagctcattgtcattcccttgagctagccagtcccatgggccatacctaacaacagtgaatgcaaagaataaatcaaactctcgggtcactttaaaaagcttagttttcttatgaaaatgaagctttaactttgcctggcacatcagggatctaaaggaatacaatcttccatttatttgcattagccggaaaggtattgtgccaacacggaaccttattttcagcaaacgcaattttgcaggagagaaggaaaaggaagaattaagatatctatctgaagtgaatttaaccagatacaaaaattctgttatggctaaataagtgcaagtaataaagatacctgtttacagaatagtgctttctttactaaaattctacattgcctgttagaagatgagagtatgtcagaagcacacagcttcgagctaagcagctgcaacatatttcaaagctgtacatgagctatgcgttagaggaaggaagtaaaggctcatctcagtatattttagagaacaaattaaaacagtagtttgtctctctgaagcaaactgattaatagttacacacaaactcatcaataatgctaatgcctagcaataggttaatgctgtacattagcctatttgatataaatgaaaccacaggaaacatttatttaagttgtgagtttcattgtgtgattgcctctttcccaagtttgaccttataattaaattgttcacaccacacatataattattttctgctagttggtgtacatttaatattcaggcaatccttttagccaatgtcagtataatttagttaataatcactatctattacaaatacaaagattgagcctctttgctcctctcacctccaacatatatgcattctaaagtgtttcagacatttcctttttttccctctctaatggtttttcttccatataatctcatatatctcatgaataaaatttagtatcacagtttgggaatttaagtgaggaaattttgttttccactgaaattaatttggggaaatttttctttattatataaatctacaaatctgaacataatccaaaaaagtaaaaatctatataccgtagtgtgctgtatagtatagactagatttaaagaattagtgaggctaaccaaaaactagtggtaacaagatggttttatatattttcttaaactgtttatttactttatattttattgatatatcatttgattatctaaaaagcaatttataagttacgcccccaaaatagcaccgtatagacacataagtgaaaaaataatttctaccttttgtttttcatttaatatgtttgaacatttatattttaaatactcattatcttatatagagacttgtagctatagagcgagcttgtccaacccatggcctggtgggccgcatgtgacctaaaatggctttgaatgtggctcaacacaaattcgtaaacttttttttttttttgagatgacatcttgctctgtcacccaggatacatgacattgcttcacaagatatcttcaaaccccttgtctcctaacttagcactaatttggtaatcattcagacgttatcattacaaaaactacaaagcctattctttctttcaggcagtctgccctgagggtataaacaatagtatttattacatattctttaggacccccatgttataccctattaaaccttgataaatattcttctgtgtttctagaacaaacaaattgctttcctgctcattgttccttggctccgctaaaaaaaaaaaaaaaaaaaaaaagtcaagcatatttcaactagaaaaaggaaaccataggcagccagacacagagactatactgtttctcatttcatcagccttgggacttgaacagcaggtcactccatttgaaaactagcagacgtaataaatagaaagaggcatagaaagcaagctgaccacagattgggctgtagcacccagccatttctgtctgtcttggaaaggccaaagagaatgcactgtatactgccattgtatcaaatgttttgggcacctttttcagggcatttatgaaagaaaaaaagaaaagggagggattaaggactggataagccttttcctgcctgagtacctgtttcatgatgtttctttatagtcatcatgactggcaaaataatctttaaggttgcttggcagtgtccaaaaagtagacaaatagaccttgtacctgtggaagaaattttaaaaactaaaaaaaaaaaaaaccataaagttgctttatgaaaaataaattatatgggtatggagctaaatttggctaaagaagaaaaaaaatctgattttagtaacaggtagccaatgaaaagcaaattaagagcagccctcacatatcttatatattaacttcccagaaagtcactagcagttgtaaaaaagtatgctaaattagattgtacacatgataggggagtcactttcttgtgcaagagctgatgtgtgtgtatgcttgtgtgtgtgtgtgtgtagaattatggaggtgacacacacatccattatatatctatatatatatatataaaacgtgtgtatgtatgtatgtatatgtacatatataaatgcattgtatatatacacacatgtataaactgtgtgtgtatatatgtatgtatacatatgtaaatgcgtgtgtatagatacatatatacacacacacattttactatatatattacattcataattttaggctgggcacagtgactcacacctgtaatcccagcactttgggtggctgaggccggtggatcacctgaggtcaggagttcgagaccagcctgaccaacatgatgaaaccccatctctactaaaaatacaaaaattagctggatgtggtggcatgtgcctgtagtcctggctactcgggaggctgagacaggagaatagcttgaacccaggaggcagaggttgcagtgagccaagatcgcgccactgcactccagcctgggtgacagagcgagactccatctaaaaaaataaataaataaataaaaagtaattaaaaaataattttataaacaccatcatgagccttatatacaaagagtgagttttcaaacatttttaactgcagaatagcttttgatataacatttttaatggacacaatgtatataatagacaaaaatggaattaatgtgatatgtgtgtatagaatatataatacatatgtaatatatatgtgtatatgtatatatgcatataatatacataaatataatatatgtaatatataaacgtactgttattgagaggaactaggaacagaaactggattgtctcctccatctcccttggtgacccatgaagggttctccgcagaacatgggttgatttagttaagtacaaatataacctagttatactataatagtgtaaaactttctaaaatgcatttaacttaaacaatataatcatggaaatatcattttatagagcattaattccctgaaagatattgtaaatatacctctaccatcagaatacaaaagtagatagaaggtcggtttgaaaatggataacttttaaatgggaaagtccccaccaaaatacctacaccattcaaggtgaatgtttaaatgagatgacatttgtggtaatatattataaattttagaaaaccaattataacatgatttgtaacactaaagtccacctggcttcttttatgtcatttaagtttttattagatgtgatcatttttgagaaatcatattgaaatatattattctagtgagtactctcaatattgctttttataattaagaatattagaatttttctaatgtaattgaacgtgtagaaaccatgacagtggtatttagaaacaaaaattttcataagtgacctcagaagacaaggtaacatatttctggaattaacatctgggaatgaaatttaagaaaataaataaataagtttttgtgtatgtatgtctgtgtgtaatcatgtgtgtctataagtttttttttttaactaatggcttgtggcttttgccacaactgaatatttaaaaggcttccatttattcaccttgggaacgatttgagggttaagaagacaataggactatgagcgccactgtagaaagatgctagctagatataaatgattataattatccaatattctgaatgttttcttaatcaacagatgggatatttctgttcatggcaaagaatttcaaagatgtaatgatttcatttttataactattcaaaattttaagtatagctctgtttagaactcaaatcactttagaaatcattcatatttattcttcagggcaataattagtgaatggatatgagtatctttggactgtctacacaccaaacagcaaactgaaaacttggcagttgttcaatttatttgatcactgtggattgtcaaagggaatattcatggcccaaaagggaacctttaaaattatttgaatttagagctgcaaataatcatttttatgttttaatataatgtacatgagtcatttctatccagtctgtgttataaacagataattctgccagtcactcactcaaccttttgaatctcaatcattaaatctaaaattatttcaattgatgtgaatgtagggcacaattatgtagtgttttggagtgagtttatccagccagctatgaagaaaaacataatatgtaatggaaaaatatctgatccagtttacaaagaaagtggttataaagagttactgaaatagctcctggagtttgacagagatcaaatcctaagggaagtggtcagaggtgtggtacagtctctaattatgaacaaggatactgctcattatcactccaacaccagttcaccctaagaaggtagtgattcattgtcagtgggtgagtggtgcatagttagcagaataactgcccgccatttaactaactcgtgtagctctaagcatgtgtctggattacctgttttatcagttaatcctcctgcagtagcttctctgcagtatatcactgaggtggtattaacattcgtctgataaaatcaaagcatttctccataaatgttggaccacagcaaacacatatacaggaaaaataaaaaggaaatttacatacaaatcaccttcataatgttactaatttgttgctacttgcagtaaagctcttaatgagattatccaggattgggactatttcctttgagagtttcatttgcctcccgaacatttttccttcaattgtggctgtgcatttattacactccattacctatatttcacattttgtaattcagtttgtgcaaatttgtaaaatgtgttcttacaacaaaaggaaaaaaaaattaagaggaagcttgtgcatgatcacacttttcttactataatatgcatgtctatgtgcatttacctctatacccacctagcaaattggtgagggtaaaaggagggtcagtgggaaacatttttaccaaattcagaaaatctgctgcctcaaatgatttttccagtgtagtagatgctaagaaaataaatagacattggatgtctagcagtctcatctttctgcagtcctactgaggactgatttcactagagtatagaatggtacttctcagacttccctgtgcattgaaatcacctgatggtcttgttaaaattcagattctgatttaatcagttcagtgttaggcctgagtcactgcatttcaaaccacatcccacaaaggccactggtccacaaatcgatcacaccttgagtaacaagagtataatcgattaaactactagtagataaactcactttcagtttaaataactgaatataaagcaaatgcatgttgtaagcaaacaccaaaaaagtgagtaatgccttaaaaatgcataagccattagaagatttattacataagagcttgtttatacatttaatgagattttagctttgttaacttaaatgagatctcattaaaccaatgaaaatgccacaaaattaagatatcaactaagttgggctccctgctgtgaaattctcatagtcatagtgaagataaattattaaaactggacatttctattaaaatcaaaacagtctttaacaacaaatgtataaatcaaaaagccaatgtgcaaaggaaaacagtagaagttatgcaacagacgttttagtcccagctatgccatagaacccgtttgcattatttatacattgaagatgataaacacctggctcgaatctcataaatatgtagttagatctgaatatgataattcatttgtaagcatcgtgaatgaattataatttatacctaagacttttttaaaattgcaatattatttgctgctgtagataacatgcatatgctaattcacagtgtttaaggctgtttatgatctccaggttttaagatatgtgtggtcaattttagttgatattgcatttttaacaatgccccagtttcactgcaaaaatagacttaaatgcacagattttgttgaaatttatagcaatgcgtaacaatattagttcttattgaaggctttccctggacttctgaggattaaaggtgagaatataattccaaatctgagtaaacacttatagaaagtgattaaaacttatttagtgatagaaatcagtgattattttaacttggcagtctatgtgccaccattttagccttttagtatgacatagtaaagtaattcaaagggaaggcttaattaacttcagaaaaaaaaagttcaaaagaatgcagtaataaaaataggccctcttgtgaaaagaaaacttgttagttaattcttatatctcaaagagagataaactgtgaaaatacctgtagagttcattctcaaggcaatagagtgtttctcgacgtccacgtgtggacaggatgcagttctgatgtgttttgctgagtcagggatttcttgtggcagctgtcactgttgatgcatcatctttaaagacgtgcctgagaactttgccatgacccttggcggcttgttgatttttctgtggaaatgtatgaaagtataatttagtttgtttgggttttacatgaattaaatatggggtttttgctcctcattgagcaaaataaggtgaaaaaaacttccttaaatatttcagagtttgactcgaaacgaaaactcaaaatgtaatcttgtgctgttatttttgtttccattgtgtgatgccagaggctatagacaactaaggaatctttcaacatggcttgaaattttgcatgtatcaataaatacctatggtaaaaaaaaaaaaactttattttaattttagctactctataatgttcaccgtaaagtataattattttcacttatttttatcaatttaattaaacatattttattgagctctaccccactgctagaaacatattccaaaagtacaaggctcatcttgtctctcttggtttaaagtctttcaatgcctttgctttcccaaggcatttgcctaaagttaaaccctttcagtgtggcccacaagcccccttaggatctgtctctgtctgcttgatgtataacccaacttctcccctcaccccatcacttcacatgctggcttccagccacacggaactctaaaagtggtttctccaatgtgccatcttctcttaagccaccaggcttcacataggctgcagtttatcactaaaaaggaagtttccttttttttttcttcaaaatcccttcatttcaattaagaagtcaccttctgcctcctgctttctaagatcttcataaggggtaagaaaggtgccccttctaagtaaagtgaccattttttttctagttcaccagagaaagtctcaatttatgtcaattttctcaacatttcatttatttagcactccctttcactcacaatggggtgtgtcatcctggtttggatgacacactccacagccatcatacttctagaggctccgttttcccctctgcagcaagtacgaggccaagagcataactgttttggagtcagccaggcctattttcaaaacccatgtctgccttctgtcaactatgtgatatcaacataggtagttgctgaaaatttttgaccttgattttcttacttataaaattgggacagtgatgtttaacttctggtactttttgatttttaaattcaaccatgcaagtaaggtacatggcttagcacctggtacattttaggttctgttaatagataaatgtaggcacattaaaatgttaaagagttacttcggacgaggattcatgaatcaggcaaatcaaactataagcagtttggactccaccaaaggagcatgagacgaaaaattgtataaggtgtttgaggaattaatacacagaaactatttgcttgtttaaactggaacagtagctttcaggtctctagtcagagatgagttggcagtttctggttggttcagctgaagtttcgttttactgtttacactgagttaggtttgatcagcttacgtctgaacccaaagtgctggagccatctcagcctaatggcctcccaattaattttgtaaacaactttcaatgaatcacagctttttaaaaacttaatgatagcaatagcactgtgttctaatgatatgttacttccttcacaggactgtatacctcttaaagtcaaaaacgtgtctttgtcttttatttgtttttccgcaggccctcgcacaatagtgcccacactatagattcataataaatagttatcaaagggattagtgactagaaaaatgactgactgactaaaaaatgaatgaaaacatattatctgtcctcaaaggaagaaaggtacttttaatgtaagccactctctgtgtgtcataagtgctccccaaaaggacaaagaaaacagtgaagaaattaccctatttccaatcgggagatcagggaatattcacagagcaaatgacatttaaatagggcttcagcaggaagaaagatgtgttatggagtagtacttcagacagagggcatgatcaccacattttcatcaaataataaatatgttaatgaaagatatgtacttaaaaataacaaaaaagtatttctacaattatatgcataagtttagattttccaccctccaaagaggcctttgtggttgccattcttttcactgacaaatgtactgctgaatgtgatttctcttaggttgatatgtagtataaaaaatcatagccagctttttttctccctctcttggtttaactcttgcacattcacacatgggggggtataagatgttcattttttttcctttgctttttaatacgaaaattatctcttaaaactaaagtcgaaattaataaagatcttttttctaaaattagaaggatctatttgctttgacaaattctaactgtttatagtgtcacattattttcaaaatattacagatgtggaaaaggggtagaattagttttgagtaaaattatggcttgtcagcagataacacaatcaacctttcaaacgcaaacacctctttccaagtgtaattgttaggaaatgagagccgtattcaaatgctaaataagaaaaatgacgataggaataaaaactcttctggttaaaaaaataacgaagaacagaattttaggcacggttttcaaaagctctccaattgcaggtgctacctggctgttgactggttgattggatggccttgatagtgttgacagcccatgaattctctgacagcccagggaattcaagttaatggacagttaatatcatgattgaatggtgcctgatctatttgaggatggaaaatcaatagtctattagattcgccaggagaagtgggggaagaataagcatgcctatttgccttcattgctacgtctacactaattaagcaccaccttaagatggaggagagtctggagaattgaactggtaatgagattccgacttgaagtaaatgaagcaactttaccataaggcacactgacagacaattaaacctttttatcaatgcagctttcatgcagaaataaaatctcatatggcaactgtaaaataaatggaggactggaaggaactgtaaatctttttctcagcttgcagttgtacttgtaacttccacactgttttgacatttggggtttttgcattagaagtcatagtgagtaacattgcatttttctacatagaagttccgtgtgtcacattcattgaaatgtttcaagaaaggttttgattaaacataaaaccaattagagataagcagtttccttcaaaaaattttggactggaaagaggaaatattctaaagagtaacaattgctgtatttcaaaaatattttaaaatattttaaagctgttagttgtatagataaaggctcatttttgcttatacaaatatctctttttcctcacgttaaaaatactctaataggaaagaccatcatacatagccagagaatcttgccatcttaattttcagaatgggagtagattttattttaaacataatgatgggagaatgggttttttattggcaattaaatgttctagtgaactgacaggtattaatatgccattataatatagtaaagtaacataactcagctgcatttttaaagaaaatatgcctttgaatcagaggccttttgttatgttgcagtgaactagtggtatgataaactgttgtacaaaacataaagatattattacctattagaatcacacctaaattcctcaccatcaatattcttgaatatagtttttactgtatgacctagtcatacatttacctgttaaatttctataaatagagtctaaactttttttaggaaaatggccagagcatataaaatttttttctttacttttttcatttctgtgttatagctaacactgtgtacttcacactactgctatttattatttttctttttctatatagattactggcaacatttctagtttatcttttgtataaaagcagaaaaatagaacacctggctgtttcttctcacctcatagagtaatgatattttactttatcttttatttactctgatatatttaatacaatttttcatttcgcagtcttttgcagtagcttctcttttctcctttcaggtttcaaatcgtccttctttaagcccttgttttgtccttatttcttctgcagttatttagttacttgtctctctatccatgtcctatggcttggctattcgagtttcaaaaatattatagtaatatttcacttaaattgacttgtgagctttaagatattataataatatttcactcaaagccattttactcaaatagcttttattgagcacctgttagatatatttcactgggctatatttatactatgattcagatgtgtgcagtaattcatggttttactcaaaaatatttattaaatgtttagaattgtgtgttctgcatgtgctcaacactgtgaaacacactggggattcaaagactgccttactaggcatagattatgcctttaagtatcttataatacttgtttttaaaatacagcatgtaagttagacacgtaggaacattaaatgtaatctaaataagaataaaagatataaaaacatgcacttgaattatagtggtacagaaaaagttgaggaattttgttgtattgttctaactcgagacaaaaaagagcttcagagaaaagataggatttgagttcaatcttgcagataaacaggattttgttaagtggggaagaagtggagagatgctcatgatcaggtaggtgtgcaagtcagcagggttagggttaatattttctttggcagagttttaggttgtattgagataggaaacaggaatttagggtgagattatagaaggtattgagtgtcatgctgaggagtttagacattattctggggtcaaagatggcttctaatcaggaaattacatgacttgatatgagttttcaggatatggctagtgacaagagtagaaaaggatgtgttctcagattataactagcagcaaacatggaaaagaatgagtcgtcacagagttcagtgaggaagttattttataaatacaggtgaaaataatatatgcttgtgttttggccaagtagggtatagctaagaaaggggagacaaagaagtagaatagaaagacataatttacgggacttaagttatgactggatatgaaagttgcaagaaggggaggaattgaagttgaatttcattgtttggatcaaagagtttggctggctgacatggtggctcatgcctgtcatcccagcctttgggagccaaggcaggtggatcacttcagcccaggaggtcaagactagcctgggcaacatggttaaaccctgtctctacaaaaactacaaaaattagccaggcatggtggcacgcacccatatcccaactactcagatggcagaggctgaggtgggaagatcacttgagctcagggatgtcaagactgcagtgagtcatgataaggccactgcactccatcctgggcaacaaagtgagaccctttctcaaaacaaacaaacaagcaagcaaaaccagaaaacaaagaatttttcttttaacttaaatcagtgacaccagatcatgtttattcaggacaattgtcttcaccatactgagagatttccttccttggagacataatatctatatgtagatatagatatctatatctatatctagatatatatatatcttactcttctagcatttccacattttacctaatgaagtcctattaccttttccaatagaaaataatagtgcacaagactcttaaggacccatggaaatatatactattagcaatgttggttttggagcaattatgtgaatggctacactatcccatggccatggaatttatttgaggtcacattggttaattgctcaatgaaacagaggatcattttttgactgatatgctggagcccctgaaaataattcagtaattaccatcaattgagaatctatattttacttgacccggtgataatacctttacacgaaacatcttattcaattcttggtaaggaccataaggcttcttttacagatgtgtaaaatgaagttcaaaaaagttaaatcatttgatcaaagcctcaattagaatcaccgaggaaggattttaacttatgttagaatctagagctcgcataaagtttatatactcactctgaactttttgaggtgagaggcctctttaatatatgctgtttctccaagaatatagcattatgcctggtatatatataatagtttctcaaaaattcaggatcagttatacttttctattatgaactaaatctagattttttaatctgatcttttctctcaatatttttgtatcttgaagcaaaaacacaaggatgttccaaccacccatggtcaggcttcctcaaaaaaatattctcttcttgtcttttatggttttaagaattaattgtgttcacatattcaaagaaattaaaaaccaagaatttatatatactatattttttcattaaacattttatttttagataattatagatctatatgcaattgtaagaaaaggcaaagagagatcctgtattagtcagaaatctccagagaaacagaaccaatgagatatatagagagatatataggaggagatttttaaatgtgaactggctcacatgattatggaggctatgaacttccaccctatgccatctgcaagctggagaactcagagagccagtggtataatgcagccccactctgaaggcctaagaaccaagagctgtgatgtctgagggcaggagaagactcatgtccagttttaaaagataaagagaattcaccctttctccttttttttcttctattcaagccctcaataagttatatgatggctacatacattagtgagggtggatcttctactcgatctattgattcaaatgacaatctcttcaagaatcacacacacacacacacacacacacacacacacacacagagagagagagagagagagagagagagagagagaaataactctttaccgtctatctgtgcatcccctacttcagttgtcacataaagttaaccatcaaaggtcttatgttgcctttacccggtttcacaatgataacgtattgtgaaactatactacagcatcacagccaggatattgatattgatatagtcaaggtaaagaacactaccatcatcataaggatctctcatgttgcccttttgtagccactttcctccagctccaccctctcctaaacgttacctatgacaaccactactctgttcttcaattctataattttgtcatttcaagaaagttatataaatggaaccacaaagtaaataagacaaagtaagacttatgcccggcatttttcccttagtatatttctgtagagatttatctaggtgattgtgtgtattaatagatctttccagtttattgttaagtaggattccatagaatgatgtaccatagtttgtttaaccattcacccactgaaggacatttaaacagtttccaacttttgactataaattaagttgctataaacattcatttacacattttgaggtgaatataaattttcatttccctgagaaaaaaattcccaaaagttccattgctgggttatacaatagttgcatttttatttttttaataaactaccatattgtttttcagctgaggctgtaccattttacatttccaccagcaatgtatgagtgatctgatttctctgcatctccagcagcaattgctgttttaactcttttattttagccatttcaatgggaatagtgacatctcattgctttaatttgcatttttctaacatctaaagatgtagaacatctttttatgtgcgtatttgctatcaacatatcctattcaatggaaatggctcttcatgtcttttgcccattttctaattgaatcatttgcttcttttactgttgagtttttaagttccttgtaccatatttttatattttaaatagtaatatttcgttaagtatgaagtttacagatttttctttctatagcttgtcttttgatccttttaactgcatctttcacagagcaattttttaaaattttgataaattctattgtattgattttttttctttcatgcattgtacctttagtagtatgtctaagaactatttgtgtaacttatcccaaagattttctcctgcattcttttataaaagtgttataagtctgccaccaattttgagttaatttttgtataagatgtgaaacttagatttctgttccttgcttggttgcccctttcctgatcctttgactaaagagagcaggcattttggggactattttttgtctgcactccctggtatttccaggtacctctttttcaataccaagcctggactatatgaggcataaagaaaacacagcacactcgccattgttagaaaaagctaagctggacagtacttaaagaggtgaagaaaaaaaattattcaggaactattgcaataggaaagaaagagacctcagtatagaactgagctcaattctggataaagcattgacaagtggagatttatagccaaggaacagggtaggggtcagtgcatggaaattactaagaggaaacatcaggagtaagggggagttctggctaaaccaacttgcaaggattcttgctaagactgagtgatgcaggtctggcaagggcaggcctaattgagaagatgggtcagaggagcctggctaaactttggtcaaggaaagcaacttagtcatcagcatgtcatttcttgggtctgaggtccctaactgatctgctgatctgcttgctcttcatatttcaaagtctccgtctctgtctctttctctgttctctctctatgtgtgtgtgtatgtgaaatatatatagtacatacacacacatatataacaggttttttataaatgtgaatattaggtatatttatacagcaaaaactgccctataaattttaaagaactatttgaaaagatacaggctaaatatttttaaataacctttacaataaattcttattaaattttttcctttgctaaaattatagaattaactggtttatttagaaagagaaaaatgaaaaacaattaatagtataatgcaatctaaaacaagtgccttctaattattttaaagtaatattattatacttttgtagtgatttctccttttgagataattttttaaataataagttccttttccttcagttttaaaaatattttccctcatacttatttgcaccctcctatgactgtgcattattttttgtgtaccattttctagtttgcacgtaaagtcactgttatactctgttgaatagctattattgccttttggacttgcttctcaatttttttattctctattcctcacttataaggactccctcctcatgtttgaccatgcacattttattgaaccacataattttcatgaatattttatttgacctacaactgtcaagaggatcttttctctttttcatataataatgtttttctctatatctgaccttataactccatcgagaaattaacatattaaatgtattcttttatccttctttattgaggctcagttgaatttttatccaacatagaaaaatgtattagctgttaaggtactataccttattggaatatttattataagcaaagatgtgaagatattttaggtgtctaaatattccttccagttttgtgtttaatgttgctttcaaggaacaaatcacttgaaatttaaatttggattcagtgtatgctgatactacagcatttacattagaagtaaaatcagaagccatccacatgttcctcaactatgtctggtatggtcaattgaaaaggagccaatgcaaacgcccctttgataattaaagacattttaaagaactgcaaaaacctaaatcaccatctttgttgaattgtgtagaatgttccacactttttttctttattttcattattttttgtttgttgtttttagagtggtatacacttgatttgtcatttttagaagtgaacattctgccagtacctacttcccaagacttgttaaagttggaaactacagatgttcacttgggtggcttctcctcagtgaacatttccctgatttgtagttaattctctattccattgagtactgtgctacatttccctgtagatttgtgcttgctttttccagcttttccacatctccacctctcaaatgaactaatcataacattacgtttggttgcttgcattattactgtgtttagtttttatttctatctagctgttttaaggggatgttcgttgtattttttcaggtaagattagatattattcctgtttttgcctggatccgacatccagaaaaagcgtaaaacctgaaaccaataagaaacaaatgattttattccttgctatttaactcttcaagcattttcgttgggtttaagtacattgtaaaaattaatgagtattattaaaagagttaactattatgacactaactccaaggatatgccaagtgcatagtgggtacttaaaaatattccaatgtacaaagaagtaaataatgaaaagcgttaaaggacatttgcttgatatagtctgttaaaatacataattctgacctaggaattcttttctaacatgatgactttttccctaaattatctggataaatgccttcattttaaaatatgttttgtatatgtaaacatagaatcttggaatattttcttttaatccaaagaaacccgaggtaaaatgtagatgaattaaaccaatttaaagcactagataagaaatacgtgattttagagaacaatctctctatggcctttggtaaatagttacttctgctttttaaaggtcacagtcagaaacacccaaagtaagtgttgaggaatatttatcgtcagtccttatacacacttgggcaccatccagcattaagcaacagtaatttctcatggattggccagaatacactgtatttaagtaattattttaatccaaaaaaggtatcttaaagagttaaaatgttgtagttttcataactattagattttacattttgctaactactaatctgccagtctaagagaggaagtaccaattcatactccacagtatggctacataagctagtgaagcaggcaaagaatgggactgtagaaactggtgtggcccagaaagaccagtccccagtaactagtagttaattcttatctgaattgatcgtatgtaagaatggagaccaaaaatctccaaatgttacaattttaagattttaaatttaataaaagccagaactttggatttttatgtgaaccctcctttcccagtttttaaaggttggcaattatttcacaagcttttaaacccactgtgatcaaaataagctacaggaatatgctaaatacaggttaattttaacaatatattaaatttatattgaattttaaaatgatcataggctaaaaatggcctgttacatttggtaaagttaaaagttataagatctacttttaattaatacatgtttatgcaataaaaccctaaaaaaaggaaagcaaaggagtagtgtagtgaacacaaggttatagaatggtaattacacttggtaggggaaggaagggaatgaattattagttattagtatggttttgccttatggtctgaatggagagttactgggtgctattatgttatttaaaataatcaattaaatgaaaactaaataaatgagagcaacacatgaacgtgcaaggaaagtatgccatgaagcaagggctaagttccatgcatattaaatccagttttaaaatatattaaaacatgctaaacatatcgactcttggatgtaccagtggaagtagtcctggaactgccaatttggaacttctgttctaagagaggaacccagccagcaagatgattatgtgagtgagaagttgatgcataagacaaacagaagttcaacagaatgactcaaaaaatgtcacaaagtaatgtctgaataattaccaaattaatatagaggcagttggcactagattataaattagaaaaatttctagtggcttagaaagatgcctgagtataaaaacagtcctggtgtacgaggagtttatatatgaaactttacaaggttgaaatgtctagttgaagaatgaagtcactggatattgaaatagataagatgattgattaataaatggaaatcaattaaaaatttctctttattaccatacctgtaaatattttttaaaactttctcaatgcatcagactgctgttaataatatgagaacaaattgacaacatagagtttgaacttcttggatagaatcaagaaaaaaaatgtgagagaagccactattctttttcttctgaaccgatcacagcaacttctatttctcctttttagactcagtgccatttcggtgatatttgctaatatcactgtattctgctcactgttcaatagatccatgacacagattaactgccctggttggatgcaggatgtattttatatcttctgttgtattgaaaagtcattttaaaatgtcactcattacttccgcttaaaatgatggattcatacagtagaagacaagattaaattgatttagaagtccttatttataagctaataacatcatgtttctaaaaatatgttagattaaaataaaaatatgatttatttttattttagacccattattgattaaagaatttgacacggtgattagtatatagtaagtactcaatgagtagtcagtgaacatatgaattcatgagtatgtgcttggcctttaattgatcctcttaacaagctgatacaaaccaaaaatctttatggctaaacagaaatatatgtgtatgtgctatttttaataggatatgtatataaacacatatacatagtatcttctataattccttatgcccattttcaagaaatattgttagataggatggagggattagtaaggaaaggaagaagaggctacttaaaataaagtaatcccatcacacatctagattttaatgcttattttttatgttctatatggtaagtactttgacatttttcttaccttgaatgcattgcttctaagagcatttgtcaatagtatacaatctccaaaaaatacattttcacatgcaagtaggttaagatactaattttatgtactttcaaagtttgatcttcaagaaatcaaacaataacctaacagtgattttgagctctaaatgtttctaaggaagattgacaaaatgaaagcaaaacaaaaagaatatgatttatttccaaaataagacaaagttttatgagacatagtctttactattcaattcaaatgtattctactctagtatttattaggggaacatgtcagtaaaaactgatttaaaactttatagaactataactttcttatcattcttgcatctcctagctaaaatgaatttcaattcccttttttctgagaattttgcaacaattgttgccattcattagctgtgtgtctttagaatattcacttaatttttctgagcctggatttaatgatttaaaatgtgggcataaataacacttatctatgtcataggcatgttgtatagatttagtaaaatgattcttgaataggtcttaagataatgcctaacatttagaaaattaataacactttattatttctgatattttgattagttccttgtcaagtttttatttatcactaactgtacgtaggtgaatcaactgaaatgttcaaggctgacaattggaagagtctatatcagctctttttatagttacgacggaaatctttggaaatcaggattgataacagtagaactgatagaacttaactaccccacagcagtagtaggaaccactctaataaagataatttattttaccagatgctctcttctctaactttattttcccctcctttatttttagattaagtggtacaaaaattagctaggaatgtccaacatatgttaaatagaactcctcttgtgtgacagaaatatatttcctcatccttatctaggctgaagcattggccttaatttttcagtgccatgcctgcacaggctttagtttttatgccatgtgatgctggctgttttcacccacatggctttaatggcactacaagtatttaggcgtgcaaattgcagtagcaaacatattttataaacattaagggaagattttatgtaattcattaaaatactaacctatgaatatcaacttacagcccccagtaatgtgagtgaagctgtaaaaatgatctctctcattatggataatccccaattttaaaatggcatataaacaatttcaaaactcccggaagtgctctaaatattgtaaaatggatgcgtcataccaatttatctgatgccttactcaatgaggctttaagtctcaacccaatcaagtcacaaaaattattaatctttcaaatacaacaaaaaggtagccatcttttctcttttttcagtatgtttccttttaaattacaattttgttaaatctgattttgctcgcataacttctagtgatgtttgtcatattttatctaacgctgcatagtttacatgcacttatacattatccgtaaggtgttatacttttccacctcatagatgtacccagaaaatgcatctttctttataatgttcatttttaccccaattcgaaggttcctaacaatactaggaagagactaggctcttccaagtatcaggaatctctgactttccaaattccttaatctcaaaattgtcctacaaaatagcaggtatctattaaaggcaagtaaactgagttacagagtaatttgcttaagagtatatagccaataaggagcagcaattggatcagaatctagattttccaaactttgatagacatatctttactgcctggttaacaaaggactgttgactatgctgacatctaaaatggtcctgggattgtggacggtctctttcaaaattaattatattttgatttttgtactttcaaattaaaaatgaaagtaagtagagaatggtcaatgactcagtacgttgaagttagatttgggttcaaattttgtacagctgctggttatccctatgactttggaaagtgatttgatcaactggagtttactcattttccaatgagattaaatgagagaactacagggcttagttacgcataatgactgatacttaagcacaatatataatagccactattattgtaaaaattgaaacatgggaaaacaagattcgatctcagctgttatttaggttctatccctggttctccatgtcactgacttctgcattaccctaagcaaatcttacctctagatattatttttgtcatgtgttacacagatatataaaaccaccgttatagaatccacgttaagataactgattcatggagaggtccttccatccagagaatgttggggtcatggagataactttggaatcccgacccagaaataaaaggtacaaatgaggctgggaagaggtgacaagggagagcgtgttagttatccaaaagactatgtagagataaagggagcctggggatactcttacatccagatgtcacaataacaaagacaaagctctagggtttaaaagtttggactataatttatcctctatcactaattttctgggtagcctcaaaaaatgtcatttaactcctctgagctttaatgctttatttgctcaatgaagatgttgaagtacatgacatgtgactgtggtcacctcaagcactaaggttctatatgtctctacattagatgagggcatcccaaaatatattccatttaacagttaaaaatgttcccatagtgaattgtgcatatgccttgtaccatctaaaatttcctagtaaaaactctgagaatattaaaacactgggaagtccattacaacaagaaaattattaaccattcaattcccaaatcccatagcctccatggaatttgtttaatacacttttataaatactgaaatagacaatataaaagctttgaaaagtatgtttaggtcaaatataagatattattattatcaccattctcattgctgtacaccaccaccatcaacaccactcgtcatcaacatcactatcatcttacatttatgaacacaagttctatatgctgcattgtgaattgtgacatgtaagtttttttctgggttttctttttttttttttttttttttttttttgagacagtctcgctctatagcccaggctgtaatgcactggcatgatttcagctcactgcaacctccaccttgcaggttcaagggattctcatatctcagcctcctgagtagctgggattacaagtatgtgccaccatgcctggctaatatttatattttttgtagagacaggatttcactatgttgtcccggctagtctcaaatttctggcctgaagtgatctgcctgccttggccttccgaagtgctgggaatacaggcatgagtcaccatgcccgcccaacatgtaagatttttagaactcatagactaagatagcatttggaaactgtatacatactcacataccacaaagatgaatgttgatcatgaatttcaatattaactcagtgcgaatgtagaatttaaatattcttagataatggcaattgaaatagaaggcatatgagccatatttcagttaaatttcatttcagttctgaatgagttttacttattctatcttctcatttcttagaataattaataaaatgatatatgaaaaaagatttctattccgtgaatggaaagtatatactggagttgacagtcttataatttaataatacatagggttcaaagcattgtacatccattattttattttatatttgtaacagtcatttaaaagttggcgtgacagatattattttattcattttatgcacaagcacactaaaagtaaaaaaggttaaatgccttcttcaagggtacagataatcttgaattttcaatgatacttaatatttttaactttatagcctattttgttttgctatcattcccttcaattacattatgtctgtaataggcatctatcaaaaaaaaaaaaactggttcatgtgaaagaatgaagatttcaaatgagagtagatcaatgtttcttgagtttatatatataatatatatcacagcacacaaagaaaaatcactgggataggccgggcgcggtagctcacgcctgtaatcccagcactttgggaggccgaggcgggtggatcactaggtcaggagatcgagaccatcctggctaacacggtgaaacctcgtctctactaaaaaatacaaaaaaaaaattagccaggcgcagtggcgggcgcctgtagtcccagctactcgggaggctgaggcaggagaaaggcgtgaacccgggaggcggagttggcagtgagccgagatcacgctactgcactccagcctgggcaatagagaaaaaaaaaaaaaggaagaaaaatcactgggataaatgaaccagcctgcttatggctggtgaggaatggccatgagagtggcaagaggtccatgtctaacacacctgaaacctctttgcaacacaccattgtgttgctgcctatcagctggaaagctctgaaatccataaaaagttgattgatttaaccaaagattagaaggaaactctatcactgtcattttcatagagcaggttttattttgtatggcccattaaaaaatgccctttatttaacatacaatcttaacagacactcaagtcgaatactctatttcaggatctgaactaatctggcttcaaagagaacaaagaaattccatatgcaggaaataaatgtgctcaccaggagtttgttttgttttttctctctgttaatgaaggccatgtcattagtagttatttgttgttgatttttcatctactttagaaaccagtcatttttctctcttatttttattttttatattcaaaattcataaattgtttgagccattgccacttacaactgctcagggattttttaagtggaatgggcagcaagcattttctctaaattcttctcatgaccctaatcactttcttcttattcgtattatatttatttgtatgtatttcacctctttatctagtggaagaatctatgcctgcttcagcgtcagagctctcagagagcttactctaatatcttgcatgtagcatcctaactccatgacccaagccattcatttttggaacacttaatttggaattaatttccaaagcctgtttgttgcaggctctgagaattaaaacaaataataagaagaagatatggttttgtgagtacctaatgtagtgataaaaactaaggttatataacaatttcaacatgttgcaataaatgttaagatttaaaattttttaagcataatgtattcacttgtggtagagaaggagctagtgaggaaacatctcaccaaagaataaaattctgaagttattcttgaaggattcttagatgttcagcaagtacatatggggtgatttcaggagtaggaagaaggaggtttctagcatgtgcctaccttcatgatctaaaagagatataagaaaatcgaagcatttggaatgatctggagaggagatgttacatccaagtagaatgcaaattaggaaattggtggccgtgtattacatactaaaggtcatagtatggtttttcctgttgcacccttgacttgtacagattacataactgaatgtgagcactgcctgacattcttcatgttatatagtaaaagaccgtatgtaatctcaatattcttctctataatcttctagaaaggcaataataattggtattctatctctagctaaggcagaggacatagaaaaaaaaagtcagtggaatatgcttttttcttcgtgcatagaacatgtatggttaaattaaaataaaattattataaaagtaatacatgtcttttattgaaatctcaaataatagtaagtttagtagagtaaaaattgaatgccttcttttacccacagcacatcatcccatgattcatcctttcagaagctaccattagagttttgtatgtgaatttccagacccacttctatgcatttctaaatgtacatgtttcttaacatgataaataaaatctttatatgtaatgtattttctacaatttgtttctctttcacttaattatttgatgtagacaacatcttctacattatgcataggtttatctcactctttttaaccacttcaaagtatctcatagcttggattttttagaatttatttttaaatcccccttgtcttaaaattttgtgccaacctattagactggctaaatagtttcatttcacatggatataggaaagctgtttcatgtgcccaatcattctatggacttacattggggttgtctattctataacacatgctattgttagagtctttaaaactgctccaaaacaagagtttctccctggaatgactacagtattactatacaacttacttagaagctaaactagcttcttaacttagaaagtgctctgggaatatttgcctgggacccatcactttaagatttacctcaatcagaatttcccaactaacttctgtagaatactagtacatcttaatatgtgttcaacccaaagaaattcctttgtcacataataaaattctaccttattttcccttatatactcatggtgcagtgacttatattaaagaccagaaagttcctgtagtaaagatatttatttatctttgtttttaagaggagcgctaagctcccttttaaataatagctatattttattaaatactgctattcacagtttgaaaaccactgatatagatgcttaaatacctcacaaaatgtccattgacattaaaaatagcaaacattgacaaacatccaaatatcacaaaaatatagagcttgaaataaaatcagaaatgtaaggttgttttaagggttaaatgagatgatgtgaagcaatttacatggcatcaagtacatagcaagtattgaaaaaaagtactgacttatggccaggtgtggtggctcacgcctgtaatcccagcactttgggaggccgaggcaggcagatcacaaggtcaggagtttgagatcagcctggccaacatggcaaagccccatctctactataaatatctctactataaataaaaaaaaaaaaattagctggacatcgtggtgcatgcctgtaatcccacctacttgggaggctgaggcaggagaatcacttgaacccaggaggcagaggttgcagtgagccaagatcatgccactgcaccccagcctgggtgacagagcaagactctgtctcaaaaaaaaaataaaaataaaaagtactaatttattactagttccacctggtcatctcataaattcatttattaatttgactcataaaaaatatttaccagtgacccactttgacttcttaaagagtttgaatttaaccctatggcattaagaaacaactggagatctcacaacaagatatgacgtggtcatacttgagttatagaaaaatatctctttctctctctctctcagcagtatggagatttaattgacagaggagagttatgctcccaaaaggtaaagtttaaacctcaaaaagatagtttcttggccaagttatcacaacttaaaagccttggaactcaaacataattgactttgaatccaggcttcactgctcacgactctactggctatattcctgactcttgctataaggaggcccagcactgttatttgaccctcaatatatctgtatctgcagaacaataggccttgttatgttagccattcactccagtaagctagtagtctgcagctttcaaagttctgtaagttatgtgccaggaattaccttagagcaagggaaattcaagttcaacttgaataatacctttagagtcaactgggtagccttgtgtgtgccctacagttggtaatacattgagagttcaggccaagcacatatgctcattatttctgctgctttggactggtaactagtgacagcatttgaaagaacaaaagcagcaagttctgtctgagagccacttgaccttttcaactctacttgacctccactctgtccataggtcctaagtggaatgaatgttactaggaatattattgtctacagcagcattttattttgagattactgaccagacacatttccacccaatagggtgacctgtgctttgtgtaaaaatgctgtgtgtaaagcacagggcaacattgtcacactgggtccacatttgtattctagacaagttggcaagtatatgaaattaattagctaatgtaatcagcaattctggcttgagcttcaagtagccttagaaattagttctaaactagacttccagcacaggaaaataagaaaaataatatttgctccatagctatgggcatacaatttcatttggaatagattcacttctggatgcttgaatatccagttctcatcactgaattttttatcaaaaaataaacaataagttttaactttcaagttcttatacctccggtagcttacacaatgagaactatatacccatatattaaagcgttcatcatttaacttacataggattttatggggacaaaatcgtaaactagaatatactaccagaacatatgtttctaatttctttactttgtagagctgagcctacatgagcatataaatatgagaaactgaactcactattcttgcacttgtcattttcttctgtaaatcaagcagacttttctgcctctaatttacacccacgctctcctccatctattcttttacttcatatatgtggaaaatttttccgtctttcctaagtaaagacttctctttctgctctttgaaattccttctcctttggactggctttcagtcatactgtcttaacataccctgtagagtttttataaaaatagataataggaaaaatgagtaaacgtatttcccaagcccaatcatattgcccattttcgatctctgtaaaaacatagtaagttgttcaatgccatccgcatctcattattttcccccgtatagcagataacctctttgagatcaacattttttcacataaagttttaacccatttggaagactggttttctgcatgttatctaagaggctgagcatgaaggaaaggcttaataaccataaaataaaaatggcagggtcatacaaaggaactgtaacattgctgcacactttcttgctttaactgaaagacaggttatgtcctctgctagctgaaaatccaccaggatcccttagtcttttattatcttctacctagagggggagattatttttttccacctctctgatgacattttcaaaataattcttgttctgtaataacctcttcagggagaaggaaaaaatgcagttgacgcagcctcatgatcatcatgtggcaaatttgcccttcagatttaacaatgacgttgtttttaagccaaagcccagagctagacctctcaaagaaaagatcatttgctctggtttttccctcacatggaaaatcatttcctacccttgcttaatttatgggtttttaattacagagagaagatgaattttttttttctcattcttagatccactatacctatctatgccgatgtttttggttgtcagacatgtacaaagtcaatttgtttcagcagcatgctatttgttaataaaaataaaatgtaataataaataaattaataaataaaaatttcctctttaaaatgagacaaggagaaagcttttttaagatagcaagcatatgtgcaaatatcagctgatatatgaacatatcttggaaccaccaagaagaggatgtcaaatgctatcagttatgcatttaggtagaagacaagtgaaatgtgaaaccatggatgcttaatttaaggtaaattcacctaccacgagatttctggcatagactccaactcatcaagattcataattgagaatcccaaagcaaagagcagagagccatttgcatgcaggttttggagatgaaaaccagtgacaaaggcagaaaaattaatggccaccagagtagcagaacattgggatttgttgctggtgaattacaaaagagacagccgagagcccatgcatcgtctgtggttgtcaaagatttctgcctgggagttcatcaatgttgagtctgtagtcaagaggctgtttttgttgttgttttgtttaccttttgttttgtttacaattctgccttggggtttcttccctggtttggaaacattcccttcacagtcccccattctcatagaattctttctatcctcttgcttcatagagtcataaatacatatttttttcttccaagcagtcatagtgtattatctttctgtggaagtctcttagaatgattactccctttcatatattcccgcttccattactgaagctcttgcttccatgcctcatacactggtgaatatcatagccggcacccatttaatctattctgcctataggtgccatattaatcttcctgtgaaactgtagtggtcatgctttaaagctcaagaatctgcagttatttctaaggcttccttcactaatcaacacatctgttcagcttttagaacctcttattaatatatcctatgtacttcaactgcctgctcctccagatacgttgatgcatttcaagtcttgtatatcatcataaaccattgtgctgtggtctgaattgtgttctctcaaatatgtatgttgaagccctaacctccagtgtgactctatctagaggtagggtctttaggagataattaagattaaatggggtcataagggcggggccttactctagtaggatggtggccttttaagaaggggaagaaagagagatccctttctgtgagaatgttcccatctacaagccagaaagagagacctcagaaggaaccaaatgtccggcattttaatcttaaacttcccagcctctagaactgtgtgaaaataatttttgttgtttaagctacccagtctatggtgtttgctatgacagctcaagctgactactatacattgtcactggtatcattgttactgctctgttaatagctaccatttattgaacataaatccactgaatattcctccattcaaagatatttcttgagcacctgttttgtacaagcctgatactaatttatgggaatacattggcactgataaataaaatcaccatagtccctgttctatgggagagattaaaatgaaacaaatatattatagattatgtatatacacatatatgtgtatatatataagtatatatacatatgtacttacttatatacatatacttatatatatacgtatatatacgtatacacatatatacgtatatatacgtatacatatatacgtatatatacgtatacacatatacgtatatatataagtacatacttatatatatgtatatgtgtatatacatatataagtatacacttatagtatatacttatatatttatacgtatatgtgtatatacatatattacacacgtatataaaatatgtatgtatattatgaatgagctaaatgctgggatgaagaaacacagaattttatgggagcatgtaacaaaaggaccaaatttagcacggaggttcctggaatcttttctgagaaagtttaagctaacacttgaaatttgactgtgaattgaccaggcaacattagaagggccagcagattgaaagagcctgactcaggtgcaggcttgggacacttgaagaatgtaaaaaatgctagtctagctgcagaatattgagagtgcatggagaatggcatgagatggagttggaggaatattcaagtgccagattataaggtagcattttaggcaaaggttgaggttttttatttgtattctaagagcaatgaaaagccattctaagagcaatgaaaaggcttaaagtttagatatgatcttaatagattttcagatttgaaaagactttttgatgactctgtgtaggatgatctaggtgaagaaaaagaaagtaagactcatttaatattttagcctataggccatattggcttacactaggttgcagcaggggaagataaaaagttgaggtttgatttaaaatatatttaagaggaagtcataaaaagatttcatgattgactgtatatgagcacaaggaggtgaagattatcaaaaatgatccctagatgtgtgggctgaacaactagccagatggtggtgctgtttacaaagctagagggaagtaaaggagaaggagtttaggtgggggagctgtgtgatacagggagttcaggtgtggacatactcttcttaggatactggtaagatggtcaaatggagatactgaataggctgctgcatattccagttcggaactcaaagagaggtcaaagtctgaaatattgcctagtgagttggcagaatatacatgcacatgtcatggttgtacatgagattgtatacagagaaagtatacggtgataaaagaagcagataaaacttggcactgagtcccaaaagaaaccaagagtattcaagagataggaagaaaacttttaagattgtagcatcccaggccacaaggagtgaggaatatttccagagagtagtcgtcggtcactttgtcagaaactactatgcggttaagtcataaaaagaagaaaatagctgttaactttaacaacacagagcttctactttagggcagacatcatgcaagaccttttacatctaacttttagtctcacagtgcaataagtaatattgtcatgttgcagatgaagaaatgagcatctgagtgcaaggtcacacattgagaaggagtggaggcaaatctgtgttcacccgggcatgatgctggaaagaagaagccttatactctgtcactgccactagagccttcacctttccctttcttgaactggatttgctgtattgtcactgtttctttgtttgtttgtttgtttgggctttaaaatcaaggccacagaactagtttctgtttattttcttattgctttatgtgtggtagccctgtctctcccattagatttatgagttcactgagggcaagcaccagaccatagtgtagaggaaagaaaatatactttgcaacctgacagacctgggtcatagtttaaaaattataatgtccatgaagtgtctagaggagtgacaggtacagatgatccaagtgttgaatggatgtgacttttattatttctgtatattccttccaaccaagtgcactgcagagagtaagattaaatatttatgtaacttaattgttaggataccatgtgtggtaataaattcttcctcagttaattgttcccatcattattgttaatatagtttaggagtcaattcactctccatatcaaaacttgccttaacctgggactgagaagagaatataaaataagatactgtgcctttccttaaacctgtgcaaatgccatattggaaaactagacccttgaaaatcaccaactactggaggacaacttctgtgatttttctaagctgccttttccatgtacctaatctagcaccagatacatggtatttacacaatacttactaaaaataaataaataaatttgttgttaatgaagaggagatttcttggctcccaaagacattagaagctttttttctgaactacaaaatgtcatgtgctagcatggcatgctaacttcttaactattgctctaaactctattggtaagatagatagttagatacagtttatacacttgcacagtagggtatatctcaccattttttccaaaaatgtcatggggataatatgattttataggttatgtttgacaccaaaagaagctaaaaatgtttcctagactgaagctgaggcttaataaatatttttaccatcatgactcatcaagcttaatatcttggaatactgtgtgagaaatcttatctaaacagtttaatcatgcccaagtgtgtggtagtttgataagatcaagtaatgtagatatttagaaacttctaaattatctgtattcctctcctttcaacctttactagtagagtggaaccatgtgatccaagggtgtggttattttctattatttaagcattgtaaggacataatattttaaagccacttgattctatgttatcctgttgttattttctggcagattttttactcgtaatagctaattcttttgacatagtaacaatagcccctgcattttttgcatcaggtgtagggctctgaaatagtaatactccctccttcttcccatattcctgccaaactcgtctcttcaacattcttaaatgtgtcggtcatactaccttcacctgaaatgtcaccctccccatgcatcctgctgtagaaactcctctcctgtcaaggttcagttccaatactaacccttcaaaaaaggtacacgtagcaggtacttaatagaggcttgagttgagtgtaataacagctggcaattttcttcccaactttatccttcatgtattatttgaaatgcaataagttgggtccatttaaggtctctttctagaatttgggtgcacactgaaagtatattccaggcatcacaaacacaaatgtttatagggacaaggcagttaaaataaattagtatagtgagcctggttgtctgaatataatataggggtggtgggggctatgataaaactaaagtacaaaaagctgtgtacagaagcggcttctgctagttctagctgatttttgccactttgttctgtcattttctcaatgtgtacaaaagtgcccatctctcaatgagaatttgttgaatgagtcactgaatgaatgacttaatgctaaatgagaaaccattgctacgaaacctcctaattttccaatacataagaggaatatgaaatttttattggaaacactctcaatttttaattttgatagtcccctaaaacaaaaggtcttttttgaccaaatagattcacacgctaagcttagcctgagagccagcaggaatgctacctatcctacattcatttttaagaggtaattcatttctaataactttgtaaaggtgtaataatttaaatttgacttccagcttccctccagctggagtcatgaaaaatagtaaaataataatagaaaagataatatgtgggatagataagaattaaattttaacgttttctgaaatattttcatttggatccttacttgatccttacaacggctcagttgaatggaaagaaagtagctttcgcctccattttactgcctttgaatatatccagtctctttactgctgttctgattgaatggcgattatttactgacccattttaaaagcagccccaaagtccatgtagttctcatctttgtacatttagtccaagtgactgaccttagacaacccatagtgagggtgcttttaccttctcagttggtagcttgtaacttgtccatttcgggacaagctatttcagtgggcttcataaaggagacacctgcctggacattcaggaaggctgggttctttagatatggtgctgcataaagcaacccgaaaagaacatcataaagcctgtcctgattatcaatcaccctcctcactgcttcatctggaaaatgtgtctgcctgccaaatacagcaggcccaggaaatcaaaatagaaatgggaaacaaaggaaattagagagagaaatttctcatcagaatgcatccttgtcctgtggagagcagaacgttgcatctgtttgggtcattacctggacattataggtaacaagcttcaattaaaacatgtccaaacatgtatggttagcctgttgtcaaatctggagataagagccctaacacaagcagataagtagcgtataaaagccttgtcttgccactccttaccaaaccctcatttggtttcagaaatatcagtcggctagggaaagtttttatcctctacattcaagacttagaagtgttgaggcccaaacgatcaattttttggctcataatttaaagaggtaaaaatctcgttttgtatggcatagatgaataaatgtgattcaactcaccacctgttgctatatctatctccccccacccccggtttacaacacacacacacacacacacacacacacacacacacacacacacactcattcattcattctacagtatctaggaaaaacatatgaagtggagctgaaaaaatttacaatcacaatctatgtttatttttaggaaaagctcagaatttttcaaagttcactaaaggtgaatttattagtcaaagtacgtacgacatttgggttaagatggggttgttagatttttttgagggcgttgactttttcaaaattgtactggttagactttagctatgctgctgagggggataccccagccagtgaaacagtatagctttatctttaagcctagggctgggaattaagtccttatcattgtatatgtgaagggaaatttgtatttaataatgttttttaaagtatgcaaagttaaagtaattaatgtgccttataaaataagatacctaaatgtaagtaaaagaggttgcagtgggtcctaagtataatttttcaccctctgatctaacacatttgtcactgaaagttcatgtgtaattttcaaatgaacaatatctttacatttactactgataagacgacgttgttcattgaatccaaacttctcttgtaaccattaggatctgtaagagcctgtctgttgctagtttgcagaatgcagctgcagaccacactaggaaagagactgaacttcagggcagggagcagatagcactatcctgagatcaaatcactgtatagaaggccgggcatggtggccctcgcctgtaatcccagccctttgggaggccaaggcaggtggagcacctgaggtcaggagttcgagaccagcctggccaacaaggaaaccccgtctctactaaaaatataaaaaattagctgggtgtggtggcaggcacctgtaatcccagctactcgggaggctgaggcaggagtgtcacttgaacctgggaggcagaggttgcagtgagccgagatcgcgccgttgcactccagcctgggtaacaggagtgaaattccgtctcaaaaaataaaaaataaacatcactgtatagtagatcgccctcaccccatgcctccaaaccttggtccagtttccaaaacaaaatttgttccttgcctgacagctctaagtcctcgagaatctaaatgggctgggtgtaatataatgaaagaaaggaataaaggcattcatccctttattcactccacagagttttaaggacctatgatatatcaggcaatatggtatgcaggagacacaaatcacaaacagatgaactttttgggagatgatggccaggagagaaaatggcaaaggtgtagcaggtgacgcagacaacaagaataaaagcaaagggacagaattgttcattgggagagttacactcattaatgacggaagaatgagtagagtataaaggggagggaaatgagagaagaggatgaaaagtggggtctaaaatttgatttttatactgaaagttaagagcatgtagatcattcttcagttaatggcagaaactacttgctagcaattgtgtactgcactgtctgccattcagttcctgccaaatactcacagtgacaataaaaaaaattgtcacagggatataaacttttttctgtgaaagatcctcatgtgattcttactcatcatacccctttcctgagaagagaaaaaatagtgtaatgaatgtatcaattatctatttattaaatttcatctctctagtaagccaggttacccggaagtcctaaagcatcattacacactttaattcctcatgcagatactatgatgcccttgcctttctccaaggctaatgtacgaaatacatggaaaatgagattaataattatagtattaatagcaataataagtaacatacctattattttatctgacaataatagactttttatgtatgcactactctgttaataagtgtattgtccataacattgtccaaaatgatttgtataaacgttttcacacatagtccttagttccctgtgttcttctattagccataagaaagctacataaccacgatgtttctctctttattgtggatgatgagaagcccagagctgagttctgattcacatggtggccacaaagttttttctacattaaactctctgaacttcagttttcttgtttggaaaatgaaccttataatgataatattaatagcaataataagtaagtcacccattatgttatatgaagataatatactttttaaaaaactttaatataaacagtgtagtgtgtgattatatatgtctgtttaagtaaactataatctattccttagcattgaaggactcaaatcaggacactacctttcagggtggctacatgagctattcaaatactattagtgaaattacaccagaaagcttgccaattagctcaaaagatattagaaatctatatggtaaaatgacaagtgtttaaaatttgtcaatggctagaaaggttgtattgatttcactgctctttcttaaatgaggcactagaatataaaatctcaacaggttcatactttcagaaaagtgttcacagtctggatgcctatttggtaccatgtgtctcatttcatggcctgcagctcaaacactggctggcttcaccttgtttcatctgccttggatataacagaaaaggaatttccattcatagttgttattcttcaagagttctgaggacagaaggtgtgtgttcccttgaatatacaaggagacaatttatgagaatatttgtgtctgcttactaatcaacctttataaaaatgagagtttgctctaagacttgctttcactttaacataatacttggcagcctggagaagtatagaactccacatgcttctgattactaaaggctaaagatatttacaaaacaactagacagttgagggtaatgtcatctcagaagattaaataaaatagccaaaacctttccataaatatttgacatcctgattgcatttgcaaacccatctccgaaaggtaggatattgaaattttttctttcatgtttcttttcttttaataggatattgaaaatttttccttcatgtttcttttcttttaagactgcttcagaaaaaaatcagtttgaatactcttgtaagtctggccctgtcttgagggatttatggattttttcagtctgtttataacctcctgtaaagcttctgaaaccttttggattaatcatcaataaacatttactaagcacttcccagagttcaaggtactcgactagtcacgtgggcttaagagtgttcaaggtagactcagtcactgcctcaggagtcagcaaaatgattctgttctttatccagtaatgagattattttatatgatcgcaacaaggacattcaatccaacaaatgattgagtatgtcccagatataagactcagtgctctccaagggagtgaaagagattgcataaagggcatccgaattaaaagagccatggagaatgtttaccaagcgagtaacccaaggatctactagggtcactctgtcctttggccagtgacaaattaggcttaaccactaatccatgatttctggacaatccaacaccctccccaaagttgctgtgaaatcttgagtgtcattgattccacctcagcctcttctaacctactgccagtaaactaaaaatgatcagttatagatcatctctctatagtgccttttggttcttgttccttctatgtccatttagcctcactccttgatttttgtgtgaaaacacaaggatatttggcacttattagactttcctgagtggtcatttggtcagtaacattacagtgtgtaggaaggggagaaatgtaaaaccaaagaaaaagtaaccaagaagttaaaaccttcacatgccattcattccttcgtagaagtctccagatcctaacctgttttcttgtcttgagcctcacttggaaaatatcttctaatctttgacatctaaatctccaatcatctttcagaaaaaactcctcccatttaatctttccttcgggatccattcctctttttcccaacagtgtaagtctggagtctaagaaattcagtattaattaacgcctgggttaccagccagtcaatctttggaggtattttgttctttaaatcagatacaattttggcttttgttgggaagggggtagacagtatgatgacaaggaggttgaggatgagaaagaggctttgacaatccgagttacgcaaatagtacaaggtaggtcagagctccttgtctagtttccttgaaggtcttctctccataagagctgaagatcttagttattcctctgactgtaagagcaaactcgcacacttcccaaagacaagcagtaagtttttggaggcagattgtcggaagtcccataagataaaacctttgcctagctcccttcttaattagcaagattatctttctcacaatggagtatttcttatcatacaaaacaagatgtgctttttctttatctctcccccaccacaccccacaaaacacacacacacacacacacacacacacacacatattttttacttgagcctttttaagatttagaagcagacctgaataagttattctaatacctggacaaagctttaaagccactgctaataagattttagactgttaataagttcataggcaaggtcttcctcctcctcagctttaatcttgaaggtgaaggaaaaagacaaattatattttattgtacccacaaaacgaaaagaaacagttgcgattaaaggacagaaataggagaattactgacttaagtaaacattaagaaaagaatcaaaaggatcattttagaaaatggcagatgggaaagccagtttgcaaaacattaaggagtgactggctgccggggaattggtgaggttaaaaaccaacagcgcttttgtgagatcttagggtgaaactgagagagaaatggaaaagcagcatgacccatcttatttggttatcaattcaacactttcatgtacatgaagcaatttatttagccaaaacattaaataaatcatctgggggagctttataatttaaattatatctgcatttaacacattacggatgaaaaaaagtctgtgtttctttccaaatctgaatgagatatactgtccccttccagactttatactgaaggactaagaaaccagtctcatggtgggtgcccaaaatgacattacatgaagaggctgaagcatgtgaagtagtgagagaaacttgattcttcttggtatttctacatagccccccaaaagcctgcaacttcaagataaatgacttgaagctggatagtgtggaccctggcaattctgaggaaactctcgtatgccaccaggaaagtaaggactggatcaatttctcatacacagttaaatgcgacctgaccagtggagacacaagtgggtgcccaggtaaaagcagaggcgaaggtctaattccatattcccagatatccagcaaatttttggaagcatatgcaagaaagattaaggctgtgcctttctactgtattcctggaggagctggcaccctgtctgatatttatgcttccttttcagaaacaattgtaggtacttctgacatagaaaaaaaccccgcaatttagtgttctgccaaagttctgagattattaaaaccattttcctaatgtctttattataatacctatcattctgatcatcccacgtgtaacactattgtttcttaagatttctaatgcatcttaatcagacatttggtatcctaaattaaccattattgaggcaatttcatggaggttgtatttctcagaatctttattttaaatagtttattaggtaaatgtctgaaaatactgagcaaactgataaggtaaaaaacatttgtttttattttttgacaaatgaaattgtaagtagttagctagaacatacgatagaattgtttttggttacatcctaatgataggcagaggacataaaggtgtaacatgtttcaaggtaaacagttaaatatgctcgaaagggagcagtagttgtctagagaatatgtggcttaaagcaaatatttttctaaccctcgagagatgttaatgattcctattaataacacagataaatctttgaaataacaagcttttttattcactctagtttttagtaaatgggtttgaagtgctaacagttttgacttttaaaagaatatttggttatttccagatcttctgtgtaacagaatttacatatttacagtagttgaaatatgacctaatagaataccagggaatacaggatccagtgctggaatcgtcactgtggtcatttgatacttagtttaactaaaataaaaattgaattttatatactgctatgtacgtgagacaaaatttaccgatcaagaactatcttgactaagtaattccttattattttaagctagtacttttaggaaaagccatttttaagattcagacccagatcaaatctggtgaaataataaaatgggaactattattactgtagcattgaaaattgagattcaataagtaaaaagtgactactatttgcaggccgctgttattaaattttaaaattctacctctcgcttcttctttctgcctgaacatggcttaatttatcttctaatatgtttaaagccatgcatgcttgtggagggctttgatctttgcttcctctggaaataattttgaaattgcaagattggaacagtcctcaatttctgaacatctgcagcaggatacaatagatataggttacaaaagatgtttgtaagttccaaaaatacatatctgatatattggtggaatgttcacattaatattaagaacaggaaaataaaaggcacatagcaatacatactattgggtgtttgttacccccactttcagatactgtaggaaataactacatttgaataaatacttcagcctgtttccatgaccctatccctaaactgatacgcttcagtattattaaattgggacttaggtcattgttttgtgaggtcacaaagccatataagatataggagaaaattgacacttactgggtgggcagagcaacattgttttgacagtgaaaattaccaatttataattttttaagaaaagcatgcctagcacagaccacctgattaccaagaggaagctgaagaggagattctactagaggtaaggaagagatattgttttcttgactctgttcattaggttcagggtaagcaactctatttaccaagaataagctagctctctttcatttgaaaatatgtctgcccaggtaggcctgcagacataacaatgttaaaaacaggtagctttattgcagcacttatcagtaccttgactattcaaaggtgttaatatgccaggtttcccaaagtaattaatttttatcttacagaatatttgttccatttacatagtttgggaaacacagccataaatgttacagatgctccttgactaatgatggggttgcatttcaataatgccatcataagttgaaaataccgtaaatggaaagtgcatttaatacatctaacctaccaaacatagcttagcctagcctatcttaagcatgttcaaaacacttacattagtctacagaggcaaaatcatctaacaaaaagcctatatatatgataaggtgttgaatatctcatgtaatttattgactaccgtgctgaaagtgaaaaacagaatggttataaggacactcaccattaacattcgcagttgaaaccaccattgcaaagttgaaaaatcataagtggaaccatcctaaattgaggactgtctgtattttcttggatatttcctgaaatatgtttctatgtgtttccatctaatagaaaatggaatataccagcaagcaaaatgtctaaatatttatttcaacccctgcgtggtttcctaaggctgtttaaaccttaaattctaatattaggattggatatgacataattttatagtaaagattggtttagaagtcactaatctaggttttaatctagactctacctaattaactagccatatgaccttggaaaactaatgtcaaccttctgaaccttagtttttcatcttttatatgagagcactaaaatctactttggcaaacttgctggattgttggaaatctcaaataaggtcatggtactgaaacaattttaaaaactctcacatcaagggattatttttatgctctaccagaaattatatgtgtcatttaatgcctgaggataagaaaagactgtaaatatgcataatgaatcaagacagccatattaattttgatatgtctttgtgggaaaatacctatagttctatattattttatctgttttacatgtgggaaaacataaatctgaaaaggaaaatcattacttctggtcttattaggtagaaaggggcattactatctattccagctcctgatttctgggaataaacaaaaacagactttatttgcacatatggtgcctaaactgttctagaaatcatttatctggtaacatttggcaaagtgtcactctacttgttaacatcattagcatagaagaaattgatcactccaattgctctgctaatccatttgactcgaagttagaaatgacactattttctagcaattctgtttgttattctataagcatcattccaaacatttggaggcttcaagtcccctaatataatgttttagatgaactgttaaaaacttggcattggggtaaataaatagtttaatagcacgtttggtctcaaaggaatttacccgcatactatatatatagcagttatttgaaatttggcatagaaatttagttcccaatgtttaaggtctcttggtaagtcaattcaagttatcagaaaaaaatgttggttgccacaatgtatgcaaattattttcaataatgttgtttttaccctctcaagccttcattttagttgtaatttagaatataattgaattattttgttataatttactctacattcactagtactgctttctactattctttttttttttttttttgtgagacagaatgtcgctccgtcgccgaggctggagtgtagtggcgccatctctgcacactacaagctccgcctcccaggttcacgccattctcctgcctcagcctcccaaatagctgggacgacaggcccccgccaccacgcccggctaattttttgtatttttagtagagatggggtttcaccgtgttagccaggatggtcttgatctcctgacctcgtgatccgcccgcctcggcctcccaaagtgctgggattacaggtgtgagccaccacaaacagcttctactattcttaagatttagttctttatgcacagctgcataattctaggtgtttttacaagatattgagtatattgctttacttatcaatctttatttcctcatttttggctctttgcaaaatgggaaaaaaaagggaaaaggtggtgctgaaggtaaaaaaattaaattatctggtttaattaagttcaggcagtaaacttaaaacttctttaaatttaaacttaattctctggttgttttataatcatggctaaagaatatagaagccaaacatacttttaatacccagttacaaaatattttgtagtaaaattaaaatctatgttgtactaaaactaagtatattgcacatcttgcacaagtgatgataattgacacatctttatcactcagagtccctggtgtaccttagggttcattctcggtgttgtacgttctgtgggtttggacaaatatatattgacatatgtacaccattgtagtatcatacagaatagtttcaccgtcctaaaaatctgttgtatctgcctatttctaccttcctcctaatccctggcaatcactgacctttttactgtctccgtagtttggggatttttccaggaagacatataattggaatcacacgatacatagctttttctgattgtcatatttaacttagtgatatgcatttaagtttcctccatgtctttttatggcttgatagcttattttttttttagcactgaataatattcccttgtctggatgcatcacagttgatttatccattcttctactgaaggacatcttgcttacttccaagttttggcaattatgaataaagatactatatctcagtgcaggttttcgtgtggacctaggtttccaactcctttggataaataaaaaggggaaaaatgctggattgtatggtaagagtatgtttagtttggtaagaaacgccaaaatgtctcctaaagtggtggtaccattttgcattcccaccagcaataaaagagggttcctgttgtttcacatcctcaacagcatgtgatgttgtcagtgttctggattttggccattctaatagatatgtagaaataccttattgtggttttacttagcaattccctaatcttttcatatgcttacttaccatttgaacatcttctttagtgaggtgtctatttaagtcttttgttcattttaaaatcatgttgctcattttcttactgttgagctttgaaagttctttgtatattttagataacagttatttatcagatgtgtcatttgcaaatatttctctcagtctgtggcttatcttgttcttctctttaccagatgcttttcttctgttgaaatattagctgtacttttagggggatttgctatatattatttatttaacacctttaaaaacatttgtaatattagacaagcaaaattttattataaggctttaaacatagagttcatctgtgattttttttgccagataaatttatatactagcttgaatatttctagaacagtttctaaatttgttttagatgtgttcattacctagagttaggttttagtagatatcttttaacatattcattatttatttcatgcagaacttgagttagataaattaatctttattcttaaagtttcatagtttgggtaaatggtagtaatatttattgagcatatattatttgctggatgtattttaagtattttatatgaattattttattcagtcctcaaaaccctaggagacagggaatattattttcatccccattttatggatgaggaaatgaggcaaaaagaaagtaaatttctgaatgtcatacaacccatacatgagtggaagagtagtgtccaaatccaagcaatatggttcagcaatgggcttagccattactccacgttactatatgtcatcttccaccttctggaacattaaaattcttgaattgctcttggttgacaatatcctctttagttttccatgtcatggattattttttaaaaatcagtgatttttacaaagattaaattttgaagaaggagctgggtgaaagttatcatttcaattaggctattcttttattaagtgttcacaaattttatagccaaaagttgaataattttgtataactctatgattgggaaaaattatattagttaatgactcaattttgggaattgatgttagaaatttatttttaatctctatattaaagtattatcatttgttatttctagaatagttaaaagccaaatagtgcaatttcagttaaaggaaaattttaaaatgcttatgttaaatgttgtttaatggcttcttagctcatcttataattgttacacttcacttaacatttttctggttttctttagtaattaagtacttcaggcttttccatgccatttaagtaatagtttttacactgttttatattaagaaattaacaagaaaaagacttttttttaaaatgcaagcaaatcatttttcaggcagttaacaggaataggattatatccttcaggaaatttataagtaattttcctatccagtaataaaataaatgagaggaggttgctgaagtgtttcctaatctttcatcttgtcacattaggattcatttaaatgccaaaattcaaaatgtctcatgtgaagaagaaaaaaaatcgcacatgtcaatgaccaaatatacaaggaagaacagtgggtgcatgtatgggaaatttggtttgataagaaaatggtttcattcactgaacatacaatgttgaacaaatgtaattgaaatctaagatacttaaggaaaagatccatatgtacctgaaaatgtcttcctcatagtactctggagctatatttgtaataaatatctgctggtggttcattaagtcaacaaatatgtttagtacctactaattgctagagagtctcctatcctgagctctcaaccacagaagccacgtgccagctttgtgaagcctgcagtctgctagagaagtggggagagatgaacaataaatagatcagcattaaattaataaggtcatttcaggtaattgtaagttatgagaaaataaaacaggatatgatacagaaggactaatggtttatattttagtttttaaattaaatgttaaacacatgaaaaatgttattatttgatactacatttatattatttatttcatgtgtatatcacatatataaaaccaaaacacacggcttcttaaaatctagtgaagaaatcaaacatttaaatcccctatgtacccttctaatctcaactttccccctaccctcacctctagaagttgccaccatttttacttttgtgtttatcacttgcttagtttccctaattattttaccacatatacctgtacctaaatatatagtatcattttgtatgtttaatatattgtataaatgaaagcatactcttgtttaataactgccttttgagggtctacattttgttttagacattcatctatgttgatgcatattcatttgtttttcaatactaggcataataattcactatatgaattcatcagagtgtatttatccattctttcttgattggcatttagtttgcttccagattgtttgtttttctctttaattgccattacagctgatgcagctctgatcctttttgatcacacttttgacctgatacatatgtataagtcgttctcaatgggtatgtgcctaggtgtagtttctgagttaaaaggtatgttagtacaaattttctaaataaattttctggtttgtttcaagcagcagtactgatttacagtagaaatgtgaacttagaagcagaatgctctccacagagaatacaagcaaaggccctgaggtagaatgagcttggcgtattctaggaagagaaagaaagacaaagaactaaaacatagcaagacatctaaaagccaaaaaaagggttaaatcagggcattataggacatttgaaataggaatcaggatgaagaacatataattttatgcacaacactaaattattggtacaaagacatatgcatttatattatatgcgtgttcttgcactgctataaagaaatacctgaggctggataatttataaagaaaagaggtttatttggctcacagttttgcaggctgtacaggaggcatggtgattgcatctgcttctggtgaggcctcaggaaacttacaatcatggtggcaggcaacaggaagccagcatgtcacatggcaagagaaggagcaagacagagaacgaggaggtctcagactgtttgaaacaatgagatctcatgtgaactaattcagtgagaactcactcatcaccacagggatggtgctaaaccattcgtgagggatccactccatcaatccaatcacctcccaccaggccccacctccaatactgggaatcacaatcccagagaataggagaggacatccaaaccatatcaatcagtaatattatttatattaaatagtacataaatactgtttaataaggaatttatgggctactgcagattttatagagcaggaagacaagtgaagccactgttagccacagggaaagttttatttaagaacttcattcaagttatgaaaccaaagtgaagagaatgacagaaaccaaagatgctatgattattatttggtcgtaactttacaattatcacctcgacaaagggcatatctggtctccctcaagatgtcgcctttcataatctctgtattccaagtggaatcagtaattgcatagcctgagcagcagtttttgtgctaaaaagcagccagcaaaaaagacttctattacatgaaagcttagccttctatatttacttcagtttgactttatgacttgctgatggagatttggtgggggggtatacagcatctccccacaatgcactctttggcaaaaccacagagaaatagtctatgtataaaattacggtcagtcacttcaaccttcaatgtgtttattttcttccatcagacacaagtttaggattggttaacaaattcttcatagcaggaattaattactgaataaacaacatctatgaagctgaataatgcaatgttgcttgattaattagtgtaccaattttttttaattttagacttagatgctttcttgcattcttgtttcaattgatagtttttttattattattatactttaagctctgggatacatgtacagagcatgcaggtttgttacataggtatacacgtgacatggtggtttgctgcacccatcaacccatcatctacattaagtatttctcctaatgctatcctcccctagcctcccaccctctgacatgccacagtgtgtgatgttcccctccctgtgtccatgtgttctcattgttcaactcctacttatgagtgagaacatgcagtgtttggttttctgttcctgtgttagtttgctgagaatgatggtttccagcttcatccatgtccctgcaaacaacatgaactcatccttttttatggctgcatagtattccatggtgtatatgtgccacattttctttatccagtctatcattgatgggcatttgggttggtttcaagtctttgctattgtgaatcatgctgcaataaacatacatgtgcatgtgtctttatagtagaatgatttataatcctttgggtatatacccagtaatgggattgctgggtcaaatggtatttctggttctagatccttgaggaatcaccacactgtcttccacaacggctgaactaatttacactcccaccaacagtgtaaaagcattcctatttctccacatcctctccagcatcctttgtttcctgactttttaatgatcgccattctagctggtgtgagatggtatctcattgtggttttgatttgcatttctctaatgaccagtgatgatgagctttttttcatatgtttgttggccacataaatatcttcttttgagaagtgtctgttcatatcctttgcccactttttgatggggtcttgtaaattggtttaagttccttgtagattctggatattagccctttgtcagatggatagattgcaaaaattttctcacattatgtaggtggctgttcactctaatgatagtttcttttgctgtgcagaagctctttagtttaattagatcccatttgtcaattttggcctttgttgctattgcttttggtgttttattcatgaagtctttgcccatgcctatgtcctgaatgatattgcctaggtttttttctagggtttttatggttttaggtcttacatttaagtctttaattcatcttgagttaatttttgtataaggtgtaaggaaggggtccagttttagttttctgcatatggctagccagttttcccaacaccacttattaaatagggaatcctttccccattgcttgtttttgttacctattttgtatttacagaaataagatgtttaagataagacagacggtcaggaacagtgtctcacgcctgtaatcacagcactttgagaggcagaggtgggtggatcatgatgtcaagagaccgagaccatcctggccaacatgatgaaaacccttctctactaaaaatacaaaaattagctgggcttggtggcgcgcacctgtagttccagttactcagaaggctgaggcaggagaattgcttgaatccgggaagcaggggttccggtgagccaagatggcgccactgcactccagcctggtgacagagtgagacttcatctcaaaaaaaagaaaaagaaaaaaaacagataaaatagacaaaatagttaaacaaaaaggcattgaaaaacatatattacacctgctttttaaaaatgaatcatcattcttgtctttgacattgctacttgcattttgcagcacatttgattgtattccaatagaattctcctttttaaaagactagataatgctctgaaagtctaggacatggctatcattcttgattagtaaaattataatacattttaataattttatgcactgtaaggctaacggtgcatatattttaaaagttgtttaaatctaaacttcacttttacctaaaatatcaacaaaacttaattaaatattacaaactccaataggagggagcaatgtgccatagtgcagtagtttaaaactcttttgaccaaatttctgttagaaaaaactattttacatcatgactagtgtgtgtgcacacacttgtgcctgctcacacgcattcacaaaccttgtaactgcatcaaaagtttaagaatcaaaatttactattaatatatgcatgtaccttaatataacctattaatctattctactcttttccttccttccttccttccttccttccttccttccttccttccttccttccttccttcctctctccctccctcccttcctctttctttccttctattcttttacacttctgaagtggttaagaatgttactcggatatacaagacatatgtatagcaaatcatcatgttgtacactttgagtatatacaattgttgtctatcaaatattttaagatttttaaagaagcattgttaggcaagttgttttatctctaggtgtaaaatgaaaatagcaatagcacacacaatatgatttttgtgaggttaaataagataaagtatataatcagcacaatttataaccactaataactgctcaataaatgttaatgatcagcaaacgtgtttttagttttaattttaaagaaaagcaaattattttaaatgtttaaagatcattcaaataaaattctttataaaatatctgacatgaatctttttttttttttttagacggagttttgctcttgttgcccaggctggagttcagtgtcgcgatcttggctcactgcaacctccgcctcccgggtcaaagcgattctcctgcctcagcctcccgagtagctgggattacaggcacccgccactgcgccgggctaatttttgtatttttagtagagacggggtttcaccatcttggccaggctggtctcaaactcctgacctcagggcatccacccgcctctgcctgccaaagtgctgggattacaggcgtgagccactgcgccgggctgacatgaatcttaattacaaagtagacctttaaaaataatttgtaatatatagtataccattcttcttagtagtgtttacataaaacaggtttaagagaagaaaattccgttcataaaagttatacttgaacaagaatgtaaaacatcttttgaagcagaatggaaaacttttgttcaagatggtttatcggtatgtagatacccagtgaatccctgatagctgagattggcctcccccgtcatccccagttatagaaaaagcattctagttacggccggtattttttgttaatgccaaaccacagctaagcctagattacccaggtgaactagggtttgtgtaaggatgtcataggtagcgtctgtaaaagttcccggctccaggagaccaatgaaagtgaggctacctggagtcagagcgcacgggccccacctacaggtctaccgaacaagagcaaattgttgctacgcggtgtaggtccattgttgccagtgcttctgatcttgcaaaggggaatgaaaatctgaatttttgtgtaatggctcatggctttttttttttttttttttttttttttttttgagacagagttttgctctttttgctcaggctggagtgcaaaagagcgatctcggctcactgcaacctccacttcctgggttcaagtgattatcctggctcagcctcccaagtagctgggattacaggcggctgccaccacgcccggctaatttctttatatttttagtagagacagggtttcacatttttaaattctggaaagtaatttttgaaaattaaaaaccgtgtgggccaagcaaaacacattgctcactggatctggccgaaaacgtgctagtttaaaacctgtgatataattcagcctaaagattcacacctgctgaaatcagaggaagaaagggtgtgggaattaattagattattgtgaataagagtttcttaatatatttggaaagacctccacttcaaacactgcatatgaataatacatgataatgacatgaatattattatactttaaacataaatgaactaccacattaaaatagcttctaaatcctcctcttgttcttagttgcagaacaaatttgcatgccccaattaccaacattctggtgtgcattttgcagaagaacacttctacaaaagaatgtgtgtcattcagtgaagaacatggcataacagtttcaagctactaaactgaacaatgaattaactttctcagtgacaaacatgagctgttctccaatttgattaaggagtatgggtattttcccatttgtagatgttgcactgtttttctggtttaaaagaaaagaggtccttagaaaaatgtgttacttgtgaatgtgttaggtttctgttcagttttagtagcttagattacacgtaaaaggggacacaatatgtcctagataatacaatcctacagaagtcatacatttcccagaagaaatgatagggtgttaagtaattacaactctatggtaagtacatctccactttaaaagtgcttaaataaatataaatatacattcccctctgctaatttagaaatacataccaaattgccataaccctatagctacacttgcattttttctctttcctactctcttgcctatctttaaatctgttttcagtaacatataattaatactcagcagcataacccaatttactagcacttaatcgtctcctcctaattaagtatataaatctgtttaataaatacatcatatacacttttgcatgggttagaagaaactttacttgctctaaatctaaatagaattattaaatagaaatcaaaaatagttggccattaaggctctataataactatttgtgtgatttctttccttcatattattcatcaaatgtttacttagcatttactgtgtccctggccctagtatgtgcatgatacagtggtaaagtaaagcatttattacttgtactccacatttccacaattatattattctgctattgcaggccttccacaggcataccaaatgaagtacaaggtattgcagtgtgtcattcaaaacctgttaacaataggacacatttttttcttacattatttcctactcctcttttatgtgtgctaatgttctggtcacatctgattatgttatcaattaggatactttgatttgcaaaacatggtgaacaaggaagttcttagtgggtagaaaagaagttcctaaggcaaaacttcatccaacaggcatgacttcattaagctctcatacatttacatttagtgaggagaaaaaactttcagagtagcattaaacccacctttgatgtcccccaaggtttcattggccagaattgaatcacacagtcataactagccagcactgtggagtaagctaacaatactatctaccaaaaattcttactgtaacccaaacctagccatttctcatctccacctccctccatggcattcctttgaaatgctttcttcttctgacttctgcatgtgttaaaattctacatttcagcagcccactttttcccaaagctttaatatttctctgcttcacaaagaaaagtgacttcagcattctgtacacttaatctgtccctatcttctctaatgtttatgctttgttcaatagttgttagcatgattttctttatttcatatcaaattataaacatccttgaatgtaagggcagctaggttcttattatttatggcctttaaaactatcaccactttatgaaaataatgtagccattaaagaaatattgataaatttaataaaactctaaaatgttaacccaaagatctctaaaaatatttgaagtgatttacaagatatgatagataataataacacagtagagactaaagaaaagaaaattgagtagcatagaaaacctggataagcacatcactgaggttgggtattaaattggtttgagagcttttgaataactaggtgaaaaaaaggaaaacaagctggattaaacagatgttgcattctggtaaagtgtgacttaaaaagtcatattttcctgtaaagaaactcaagatgtgtatattcaatacatggataaattacaccacttattgattcataatctccaacattttactacttttccctgaaagaatcttaaaaacattatttgtccctgtccttatacgctataattggaaattagcaaaccagtcacagtgtagttaccactgtagaagttgccattgcacagctagtaacatggacaatatatagctattcaatagaaacttagttatttctctaaaatatcagaaatatgaccacatagtgggcattattaatattttaagtgtaaatatatactggcacctacaaaaaataattctgcatcctctcttttctgtatcaaagttaatgtatttcagaaaagttgttacaaaaccacaaatatttctagtgcagggtttctcaacttcagcattattgacatgttgtgacaaataaattatatgttgtgggggactctcttgtgcactgtaggatgtttaatagcattactgatctctgcaccttctcagttgtaacaaacaaaaatgtccctaggcgttgccaaatgaatcctatagagtaaaattgcccctatttgagaaccactgtcctagagccaaccctaccttcctagaattacatttggacctgcagttaagcccaaattaagaaagttacacagcataatcgaataagaaaccatatgaatactgaagtctcttatctgatcattgctgcagctatcattaaaggtcatacccattatctagcagagattcaaaaggtaaatattaggaagaaatgataaatcactacttctatttggagcaggaagtacagggatggagagtagaaagccgtaatgttggagaatacagtggcataggaaaacattaaataatcaaagattaagttattgataataaacattcctaaacaaaaattagtcctgtagcatgctggtcattgtagtacaataattacatcaactacgtcctctcaaactagccatactctatctagcaggccatttgtcttaatagcatttttctcattgtggacaccctcctctgcctttgaattatctggttcatagactttttttttcccccaagtctgaaacatctctacagctcacataatcccctctttctcttctatataaatgtgtatacctaacagagtagagctgcgatatcatatattgatgagtggtgtcttttacacatagaaagccaaaaaaaaaatactccttcactttgaaacattggattatataaaattagttaattcctcacttaccctcacttttacaagcttaataacatgtttttgtatagtaccttataaaaaagatgtttattagtgaaaaggttgctatctgttgatgaattgatcaatctgtatttgttaatagtcataatttttactttctaccttcattatctcctaatttcatcagagtatttgaaatagttgctgtaatattgaatatgctgattatgtgcatgatgtttaaaatttcttctgacatctttgccataatatgggcttgcatttctctgaaatgttgaattgtcctgaggcctctaaattagaatgtatttatcttttttaataaagttctaataaaaacgtatgacagacagattaagtttctatgaatctctagaatgtttgttctttgtaaacctttacatagccttctgaaaacttgcacagcttgatacagatttactcagatcattgtgttatgttgatgggtttcctttgtgtaacctagttctacaaagttttctgcattaagcgctgagtgactgatctagaacaaatgtgctgcctgaatcacttgagtattaaatgagacacagatattcctaaagtcttcgaaagagttcctcttttgctcttcgactgatttccacactacagatggacaaaaaaaattattttaaaactccatttctgagttaaaagtttgctgagaaaaaaatatatataccatgaacttccatataccaatttttgaacctcataatgtgaatagaaaaaaataactgttagagaaagaatacagataccaaaacacctttgcgtatctgttctaatatcagaacattatgaaaaggccttacattcaaaagttttcatccagaacaagtctgatatttgtcttcttctgaatttcaaaatataatggtgagaaataaaaatcattaactaaaactttagatttgaagagaagtagagctaaacttttcatctagaattatctcaaatgtaccacataatattcaaataggaaaaaagtttatgtctatatctatatgtctatccttctatatatatgtctatccttctatatacataaatatatcatctaaaccatatttagtgtattttagattcttcacaaggaaaaacaaacagatgttcttaatgtcaaagaaatatttaaagatttaaaaatacaaaaaaacaaacaccgcatgttctcactcataggtgggaattgaacaatgagaacatttggacacaggcaggggaacatcacacaccagggcgtgttgtggggtcaggggagcggggagggatagcattaggagatatacctgatgtaaatgatgagttaatgggtgcagcacaccaacatggcacatgtatacatatgtaacaaacctgcacgctgtgcacatgtaccctagaacttaaagtataataaaaatatatatataaaataaaaaaattaatagtactttgcttattaaacatattaggtttaaaggacatatcatttaggctgacacatagtattcattgagcatcaagtgagtcctataatgttatgtggaaacattttttatttaatctccaactaagaaaaccagatacttaatataacacgataatcctaaaccatccacatctgtcatctattatctgttcagcacctagtatgatgactttttaaagtttatcaaatcattttattcatctacttaaaagtctttactatcttttcatgcacttagaataaaatgtacattccttgcctgtctcttctaaattctgatctagcccttgcctacctttctgactttacttcctgcctcccatctccatcactatgctttgcagacataaaataccagttcaggtcctctacatgggaaaccagcctcttttattgactgatttcataggcttcaaatcttagttcaaatggcacttcttgaagaggcttagctataatatgtcactcccttattcgacttttcctcaacacttcatagaatttaccacaatttataatattgataaattgtgacagttgcattcattggacaatgctcagtatgatgattatactaatgtaagcaaggtaacatttcaaggacaatgttaaactcaattttccttaggtttgaaacaaacgtgaaggtggacatgatattcactttcccacatacatttaaaatacctataggtatagacagatgtagaattttgcttacagagaaaattgcagtgaatatatcatattgtctgtccagaggtcttgagcattatcttggtttctaacatcaaccctacaacttaataatcacatttgtatatatacttatgttttcatgattttaaaacaggaaacatctttgaaatgtttatgattctattgaatttaaattgagttaaagttggctcataattaaaatcacaatatgttatagtataactttttttcaaaaatcagctacatattgagctctgaagattctgaaattggccagttacagtggctcacatccataatcccagaaatttgggaggccacagtgggaggagcgcctaagcccaggagtttgagatcagcctgggaaacataatgagaccttgtctctacaaaaattttttttaagccaaacatggtggtacatgcctgtgctttgagtgaattcagctgaatttctctcctttgacttagttgctatttttccaaacactagccaattcaaaatggctgtgaatttctctatttgtgtattttattgtctttggcattcacaaaagagtgaaccacaatgtaaccaaaataaaatgtaactgtgattcacttccatatgtggttaatggcccatggcaaaattttgatgataattcatctttattgaattatattaggttattatggaatcaggaagacatctagaactatcatcattctttaagaatagcatttttttcttctcaaagttgacgtcagcagaaggcatcctggacagaaaatgaatcaccaaagagtttatgcttcattttataaagaacttcaataccagatttttaaaaataaattttattatttagggtgatagtataaatatacttttaagtgctgtaatggaaaaaataagattgcatttccgtggaagagagtgacaatatttcccatttaatctagggctccctgttctcaaataaattgttccgtaggtgacacaaagtaagtgatttggtcctttctacacaagatttttcacatcaagtttttatgaaggaatattactacaaggaattttactgaaccggaaagtgtaaatgaaggatcattgatgaaatgtgttacaatgagagcaaaatgtgaaatgttgctgaactaaaatgaactttgttttgtctccagggcagtcatgacttaatgaagtacagctataagcaagataagtcagactttgtgcagaaaactgacaatgaaagtgattacataggaaaaatgccccctaagtagattgtgtgtgtgtatatgtagatggttgtgcatatgtttgtatgtatatgtatttatatacatgcatgtgtatttatagtatatatgttgtagataaagatattgtagatagatatatagatattgtagatagatatattgtagatagatatagtatatatagtagatagatataaagattttcattttcattttatattaagatatttatatttaatttatattttatatataatatataatataatatataattatatataatatattatattatatattatatatatttatatattgatataaatatataaaattataataatataatttatatattatttaatataaaatatttatattattttaaatatttaagatgttttatcttaaatatttggaatgcttttgttacacagttgagagatctaaagcccatcattttaacatcaaatagcataacttgcattttttttattaaaaatacttgcccttactatgtcttttctcaaagacaagacgttgatactctaggtggaggctgtttatgtttttttctttcaagagatgcttgacagctgctccctggagaggaactcagactccttaaatttttattaggctacagtatttgaaatttggaaagtagacattagtctttgaggtacagtgtttgatggtatgaatcttttaagctgtagtactgcaagagaagattgcagagattagctacagaccatttgtcaggggagactgaagcattcgtaacaatgtatagtgaaaatatacttgcaaacttttcattagacaatatagggaaatcttattgtgtgtttttcaggtttcaatgttctatcaaataacatagctactaaggttgtaatggagttttttttttcccatttggttctcattttcagacaaaagaaatgtcttcctggctaaagatgccttatattgcagaagtagcatatagcataaattgctttaaaaataagcaagaacatgcaaagtgaataaagaaatatcgaaatgagtagggaaataagggtaccaagaactggagtgtgtatatgctaacgttatttttttgtaattttaaaaaataaaaggcttgtggtgttttcagggagcaaagccaatcttagtgaaatctattttgtaagccttagagcaaggacataaagttattcctttaatttgtttccttacaagtgtttctgtcttcatttataatctagctacaatactttgaaacacctttacataataacataaactgtcaggaggctaaatttaaggcacatattggttattttaagtacctaggctgtgagaagaacatttactacatttaactagttaaggtataaagagcagtggtacaggtcttggtagaaaacgttctttttaaacatataacatcacgccctgcttcttttctactttaacgcatgtatggagtaaaggtggctgaaacttgttatttgctagatagtgactttaggaataccatttaagccagttagctgacttaatactatagtaaatgtttttaactaacagctatttccggaacattgtatttctctgggaaagctatctaggagatatttctggcagggtcagctgggctccccgaagtatgttcagccttgttgcctgtgttttctttttgacctaatgttttgcttcgttttgtttttttaacgctgcccattctcgaaatgaaagtaagacgatgttatttgaatggaacacttggaaacacctttcacgcaatgactctgtataactagtcatttgtcagggaaaagtgagatttttctctaaaattaatagatttgagagtaagattccatatttagtgtatcaaaggtattgttttaagaatgatatgaattttaaaatagtctaatataaaacataagggggttctcacttaaggaggtcttcatatttaagaggtaaagtacagtttgtagtgtgcaaatctgaaaaagtatgatattgataatattaacaaagtctgacttttgcccaaaatttgtgattaatgtcaaaatgtaaaacaaaacattatcaaaaatagcactattgcaaagctacgtggcaagttaattgtaaactacatttactatatttctgcactatagcaacacttactctagaaaatataaatatcccactatcatttgcatagattcattttaaattgcgtgattttaaaaattaaactttgtctttctacatagtcttatttaaggaatatatgtatatttatatatataatataaatgtagaaaaaaatatatgtatatatattccttaaatgaaatgtaaaaggcctgtattttaattacatattacactaatgcaagaatttcaaaggcacttggtgagtggtggacctgaggatgtgtggatgtgttggaggaaaaaacggatgtttcagtgcaaagccaagttgaccaaagtgctgtgaacaagatttttagatcatttatattcaaggatgcttcttaataagatgcttatttaactaaaaacatacacacaaaacccagtgtaactggtaaccttagaacacgtttttccccctctttctcatcattgcgtattagcatattaaggaaaataaacagtgtggtatatttttatatgacatctccacttgtgcttattaataagtattataagtcactattaaatatgattgatgaaaggtttttaaaaaaattcatcaatgggtttagataattcagatattcattttttttaatgtgctttgaatttttctaccaacgatagttgacgtaacccccctccacccaaaaagactaaaaggaaacaaaatgcctaacacaatgatggtcttcagtaaatgttagaaatttgtagtaaagagaatttggacgacatacttgcaatgtctctttaaactctaatgatgctgggaacttttacttgcaaccttaacctcttcgtctgctggaaatagattgtcttgatcatattttcagtgatctcttttccaagcatggggaagaagcaaggaaagagttctgcaaggagattgaaaacagattggggcagagagagataaaagtttagaagcagcatcataagtgtatataagatatttccttaaatctcttcctttccacccttagaacactcactcccactatttttctttaatactttttagtcttaaacatcaaccaggattctaacaccacttacaaaaattacttattttcttctgccttaagtagaaagtacattgtccagcccactagtcccttctattatggagcttctggagggtcgtaagtagaagagagtattggtgacaaatgaaatgctatgtctaaatgactttaagatcggacgaaagaacagcagtatgctttgtgtttacttaccttgttaagtgtgttttcactcactcctcaaatcaattacagtttttagtctccttttattttcatgtgctaaccaataaaatttcacacgtttctcaaatgcgaagaagaaaatttgtgttcaaagactttgtaaagtaatacatttaatatagaatttatttgagcgtgtattccttgaatgcccactacgtatctgaaactataatgtatattatgtggaaataaaatataagtagaaaccaaaccccaaaagtttataaatctgggtgaaagaagagataacatttctaaccatataaacattagagacaatataaaatagaatatcattgaaattccctggaaagtcattgtgatatatagccttactactcagtgttgtctatggatcagaagccccgggcataccttggtgctgttataaatgcagaatctcagaccctgttccaaatctactgggtcagaatttgcattttagcaaaattctcaaggtgtttgtgtgtacattaatgtttgagaaacacttagttggaatagtgttattttgtgtgggtataaatgtattttagagagtgaggggctggaggaggtgataaggggaggcaagacaggatatatgtaccatagtttgaaaaagccattaatcaaacaatcaaggcttagtgtagatgccagttcatcatgtcctggctcctgaactccaccttgttatccaacagtctgcattccttaggcctttcccttcactttctattttaatccaggccatggtaagctccttactactactgagtgcactcaactttttttcagtctcctttttcaaaaattgtgtttttgcagtcttcgagatgtacaaaatgaaaagatacaaaaaaatcttctctggttattagagaagaattctttactgagtaactcctgagtcaactcaggaatagccaggctgctattcatccagtataccctcggtagtattgcatctgttgtaaaatacattcaccagctccctaggaaatggctactaccatagaagcaagactacttactctgaattctggcactttgaaagccaattatgaaataagatatttgtgaggttttttttactcttaatatctatacgtctgtaactaaggttaaattttggtccatttttcaagtgttacttaactacagacaaattagtaaagagccaaatcccaggaaatatcaatttgtgggcaatttttaattgagagaaacatttgaaaaactcagctctaagtataatattctaagtgtcatattatattcactaaacccaacaactaaattttataaaatacaatttgctctgattatacagtcagtaatggatgaaaaagaaaatcaggatctagtaaataggtgggcaatggaaaagagaaagaaagcccaacaaggtaagagattttctaaaagaggtggagagacaaagaaatatttataaagagaagatcacacagaagagaaaaaactgagacaagcagcaagggacaagttccctaggctatgaggctgatgtgttaatcaagttaggcggctggttggattccacagtttatttgtactatagtcatcaaagtaagttatcacctgctatccctaacctttgaaattccaatgagcttttcagcaattatccactagccactgctcttcagctattattattatgcttaaccttcgctaggcatttaacaagatgccatgacagcctccatgggggattgatttcattctcttagttgcagcattaaagccacagcagtatcatttcatgagtacttgaagtgggccagatgaaatcaatttcttacgagattttctttcttatgcaaaatagacattccgtttttaaatatattcctgatttttagcatgaattcttttccttttattcatctctagaacgccaaaataaagacacacaaacacatacacacacacacacatgctctataaacagaagccattacttttttactctttcagtttttatttcaaatagtttcacactcacagaacaattttaaatattatacaaagaaattcatccagattttcaaatgttaaaattttgccacatttacattctatctcgtttggtttttttctcagccatttgtgaagaagttgtagacctgtagatcctgattcctctctcctaaatacatcagcattcctcttcctcccctgcccaaaataggaaatccttttacataaccatagtaatgaataacttaaacttttttttcattattacaaatatttggcattctctaacaatgaatttcttatttacaataaagaatatgtttcttatttagcattgttctttccacaagagcttttcttcagttgctaacatctcatttcttcatattcatccttatacttctgtaaagtattttgtaagagatgactgcaaagcataaaattttgagtgtgaacacttttctttctcctctaaatatttatcttgtctccttcctatataatatataggaatatatattattccaatataataattgtatattttctattataatagttttatcatattgccaatataatagttttattcatccccccaagcatttatcctttgtgttacaatcagttcttttaattattttaaattgtccaattatattattattgaccatagtcactctgttgtactatcaaatactaggtcttattcattctttctaactatttttttgtacccatgaaccatacccacctcctgccctcaacccctctactactctgcccagcctctgataaccatccttctactctctatctccatgttttcaattatattgacttttagatcccaataagtaagtggaaacatgtgatgtttgtctttctatagtcatttctgttttcatagagaaaatattgatcaaactttaaacaacttaataatatagactgtgttttctttaccttttccttttttctatcaagttgcataaagtactgtgaaatcagctccaaatctgtgatggaaaacttctttatgaataatatttagcctaatggatcatagcctagaaatgcaatgacagaaaaaaaaaatcaccatataactgttactcactgaatttcacatgtcagagctacaacatctcccaaaggaaaacattattttatttgcactccagatagaaggagcaaaatatttaattcatgctatgtgcttgtataaaaatttgttttattgtgattcaatattttctatgattgtgttaccaaaacactagggtttagtttacgtcttgctgcttgccacacagaaagctaatcactgagacaactagtattgccagtgaagaaggctttaatcatgtgctgcagccaaggagatgggaaatcagtctcaaatccatctctccgactgactaaaattaggggtttctatagcagggaagaaatccaacaatgtataggaaaagaaggaattaggcaggggtaaggaagaaaggttagtcaacaggaagcaggtagcaagtgatacaatcatgacaggactagcgtctcattttccagttgcagtgatctggtaagtttcagctccttaatactatccacggggtctgatggtagatttcctgagaatggaactgatagaagacaaatgtaactttctcaagttttaagactgggaggatcaatttctatatgtattgaaagaaatcataaatgtcagttctgtggggcaattggactggtctcaattgtgagcctcactttccacctgcttccacaaaagcaggaattctagggttggaagagcttaacatggatggtccaaatcccatctaatataggaatcgtcaccattagctcaacaaacaatgacagttaactcctggggtagttacataaaaatacagccaaaactagttttggacaatttagtttctaaattgaggaacaacctgaccccccagaattctgtactcatgtgtgttagatatgattttttgagcaatataaatgtagttatatcatacctttcacacacaaatagaattaaaaactctcatattcttaggtttttttctccttctctaggctctgtttaatcagttcttctgtctcttactaatatgaaatggtttccagatggtaacgtcattctgtattttgtatcaataaaacatctaggagcaatcagtgtaatccagttatggattgagtttggagggactataacctctcactaatcagaaactattgccattggctcaagtttgagagcagttgcttcacatttttcattcattaatacaatgatcgataaaatcattatgtttgttctgctttttaagagcaactgctatcaactgcattatgtacaattctgtactgtgcaattgatttcttgaatttaatcaagattttatattcattattcattatatatattcattatattccaacagctgaagaagctgttggattgccctcaattagagaatgactatggatcctaaccatgaattagcactaagaaatgagacaagtttaaaacagtcctatgactgttctaccatcttgtgaaatgtgagcttcccatggattcctatctagtgtgttgtcatagcctataattcaaggaagagtcatctgattaaatgaggatgagagaaaagaaaaaaaatcgctttaattctatggctactctctgtcaggcacaggattaggtaaatgaaatatcagtttttattgacacctctgagaggaagatatatacagcctttgtacacagccagatttaaagcctagagacttagactcacatctttagccactactttttagctctgtgttcacaagcaagttccctggatcttcattttaaagtggagaacagatgaaattaagctttacaaagagaattttcattaataagtactgtttatattaaggttattattaactacaggataccactgtctactagactagatttcttttttctaggtagaatcgaaaatattctaagaatacgagcatcaaccttattcttcaggttaggaagttacccactttaaaaattttttctcctttcatgagattcactgcccatggatatttctaaacttaatttctctcattgaacttttgttgtttctttaacatacaaagtaaatttccatgttaactggaacctagaaaacttttgttttcccttgtattacaccttgaaggatttttttagttgttaatgtttcatttaattactcttttccaacttttattttagactcaggggtacatatacatgtttgttacctgggtatattgtgtgatgcttaggtttagagcatgagtgatcccatcaccccggtactgagcatagtacccaacagtttttcaacccttgctttcctccctccccgcaacttccagcagaccccagtgtctctggttaccatctttatgtccacaagtacctgatattttgcttccacttctaattgagaacacacagtatttggttttttgtttctgtcttatttcatttagaataatggccttctgctgcttcaacgttgctgcaaaggaaatgattttgttcttcttaatggctgcataatattccatggcatatatgtaccatgttttcgttatccagtccaccattgatgggcacctgaaactgattccatgtcattgctattgggtatagtgctgcatttaacatacaagtgcatgtgtctttttggtagaatgatttgggcttttaaatatgtatactcagtaatgggattgctgggtcaaatgatacctctgttttaagttctttagaaatctccaatctgcttttcacagtagctgaactaatttacattcccaccaacagtgtacaagtattcccttttctccacagcctcatcagcatctgttgttttttctttttgactttttcataatagccattttggctggtgtgaggtagtgtcttattgtcgttttgatttgcatttctctgatgattattgatgatgataattttgtacgtgtttgttggctacttgtatgtcttcttttgagaggtgtctgttcctgtcttttgcccattttttaatgaaattacttagcttttgcttgttcagttgtttaagttcctggatattagacctttgtcagatgcatagtttacaaatattttctcccattctgtaggctgtttactctcttgatagttttattttcctgtgcaggaactctagcttacttaggtaccacttgtcaatttttggctttgttgcgctttttcttctactattcttacagcttgaggtcttacctttaactctttaatctatctcgagttaatttttgtgtattgcaaaaagtacaggccattttattcttgtgcatatagcttgcaagctaatccagcaatatttattaaatagggagtcatttctttattgcttgtttttgtcaactttgtcgaagcatagatggttgtaggtgtgtggttttacttctgggttctctattctgttccattggtctaagtgtcttgtttttgtaccagtaccatgctgttttggttactgtaggcttatagtatagtttgaagttacatagtgtgatggcgctggctttcccaatgctgtttttttccagtgctgtgtaaaatgacattccaatgctgtgtaaaatgacattggcagtttgataggaatagtattggatctgtagattgctttgggctgtatggatattttgatgatattgattcttccaatccatgagcatagaatgtttttgcttttgtttctgtcatctctgatttcttacagcagtgctttaaaattctcattgtagagatctttagcctctttggttagatgtattcctaggtattttttgtgtgtgtctattgtaaatgggattgcattcttgatttggctcatagctttaatattattggtttatagaaatgctacttatttttgactttttcttttattatttgaatgctttttctttctcttgtctgattcctctggctagcatttccagtactatattgaataggaatggtgagaatggacatccttgtcttgttccatctctcaaggaaaatgctttcagttttttgcccattcagtatgatattggctctggatttggcatagacgtggttcttattttgcggtatgttcctttaaagcctagtttcttgagggtttttatatgaagagattttggattttatctaaagctttttgggcatctgttgagatgatcatatggtttttgtttttaattctgtttacatggtgaatcacatttattgatttgcatatgttgaaccaacctcacatcccaggaatgaagcctacttgatcatggtgaattagctttttgatgtgctgttgaatttaatttgatagtattttgttgaggattttcatgtctatgcctatcggggatattggcctgtagttttctttttccactgtgtctttgcaagctttggtatcatggtgagtctggcctgatacaaagagttacagaggagactctactcctcaagtttctgaaatagtttcagtagaattggtacaggctcttccttatatttctggtaagatttggctggtctgtgaatccatctggtctggggctttcttagttggcaggtttttattactgattctatttcagagctcaatattggtctgttcagtgtttccttcctgattcaatcgtgggagatggtgtgttttcagaaatttatccatttcctgtagattttgtagtttatatgtgtagaggtgttcataatattctctatgaatcttttgtatttctgtgagattggttataatgccacgtttgtcatttctgattgggcttatttggatcttctccttttttttctgctttttattctagttagtaatctatcaatcttatttatcctttcaaagaactttttgtttcactgatatttgtgcagattttgaggtctcaatttcattatgttacattctgattttagttatttcttttcttctgctagctttagagttagttttttcttgtttttctaattccattaggtgatgctaagattattaagttgaggcctttctaactttttgagataggcgtttagcactataaaccttcctcttaacactgctttttctgtatcagagaccttttggtatgttgtgtctctatttttatttcaaagaagtttttgatttctgctttaatttcatcgtttacccaaacggattaagttgtttaatttccatataatggtatggttttgagagatcttccgagtattgatttctatttttacttcaccatggtccaagagtgtggttggtatgattttgatttctttgaatttattgaggcttgctttatggacaaatatgtagtcaatcttggagtattttcggtgtgcagatgaggagaatgtatatcctgtggtttatggttggagtattctgtagatttctattatgtctagttggtcacatttcaagttgaagtccagagtttcactgttagttttctgcctcaatagtctttctaatgctgtcagtggggtgttgaagttccccactactgttgtgttgctggttaagttattttgtaggtctataagtacttttttatgaatacgggtgctctatggttgggtgtgtagatattttgtatagataagtcttctcattgaatataaccttttgttaatatgtaatgcccttctttgtcctttttttactgttgttggtttaatgtctgctttatctgatataagaattgcaacccctactcttttttgttttccttttacataataaacatttctccaaccctttacattgagtccaggggttgtcattacttgtgaaatgggtcttttgaagacagaagaaagatgagtcttgttattttatccaacttgtcactctgtgccttttaagtggggcatttagaccatttacattcaaggttaatattgatatatgaggttttgatcctattgtgaagttgttagctggttgttttgtagtttctattgtgttttattctatttttgctttaaagggtttacaaactatgtatttaagtgtgttttggtggtagcaggtatcatttatttgtttgtatgtttagaacccccttcaggatctcttgtaaggctgttctagtggcaacaaattcccttagagcttggttatattttatttctctttcatttatgaaattagtttggtgggatatgaaattcttgtttggaatgtcttttcttttagaatgcttaaagtattctcgcaatctctcttggcttataaggtttctgctcagaagtctgctgttaccctaatggggttccctttgtatgtgatctgcccccttttttttttttttttaacctagttgcccttaagatttttttttttctttagcattgaccttgggcagtctggtgactatatgccttggtgatattcattttgtgtagtatctcataagtgttcttttcatttcttctatctgaatgtctacctttctagaaagattagagaagtttcttttattattccttcaaatatgtttttcaagttgtttgcttttttctttctctctcagaaatgccaataattaacaggtttgctaactttacaaaatcccatatttctcaaacgctttcctcagtttaaaaatttttttttaaatttttttgtcagattggcttagtttaacagacttgtctttaagcactgaaattattttttctgttttttttccagtctattgataaagttttcaattatattttgaaattccttaagttttttatttcagaaattagtttctcaattccagaaactgagatttatttctttttaagatgtttatctcttccttcatttcctggattgatttagaggatttctctgtgttgattttcaactttgtcttggatctcattgagcttccttgcagccattctttgaattcctctgtcatttctgagtttctaatttggttagggatcattgccagagagctagtacaattctttggtggtgtcactacatttagatttttcgtggtgacagagttcttatgctggtcccttctcatccagagatgctggcacttctaatttttgtaattatttctatgcaagtaggattttcttcttcttctataatattgttttttaattattatttttctttctctttctattttccccctccctaggagatgtgactgtagagaatgctggacagggtcatttggcattgtttttatagctctatgcacatctttcagcaggctttatattggctattgggctgggcagttcatcctacaagcccataaatgtcacttataggtaagagctggctgcagccaatgtgactgggtatatacttgattcttagttatttgcagaagctgtctgttgtctcaggcaatcagctgatttgacgactgtacaatggtctgagctccctgctcagccctaggtggtgtgggcagggagccaaaacaggaggggatgaccggggcacatccacctgcaggttccctgatggcaggcatagtattagcaccaagaaagaagccagtgggtggcctaagacactcagaggtgtgacaaacactcaggagaaacttccttagctccaagttctctgcatggggatagggggtggtctaaactcctaatccaagagagtgagtactccagatgccttgtggacctgactgagtgtggaacagggaaggcctgcctacacaaaaatctccacacaggaggggtggggtgactcagtctgcttcaccaggcttggagcctacctgtcttgaagaatggttggagatctgcctgggcatggagcagagaggggtctctgtacaggaagggtggagtgactcaggctgttggaccaagcaagcaagtgctctgaatgccgagagatattgctgagcatgtagcagagagggtactcctgcacaaggatctctgcacaagaagagtggggaagttcaggctgctgagttaggcaaacaagtgttctgaatgccagaggatctgcctggatatagatcagagaggaccttgatgcaccacatctatgcttaggaagggtgtcgcaacccaggctggtcaaccaggtgatcaggctgctcctaatgcttgaagatctgcttgggcttagaacagagagagtccctctgtaccaagatctgtgcacagtaagggtgaggtggttcaggctgctgaaacaagtgagccagttctctggatgcccgggcatggagcagagagagtcttgctgtaccacaattaatgtggtaggaaggattaagaaggatgggtggctcaggctgctggtacaggcaagcaagtgctccagatgcctgaatttctgcctgggagtagagtagaaagggcctagcttcaccacaatctcagggagacagagtggggcacccagcaatggcacacgcagatcagttccaggtcactaagctggcctgggctacgagtctcaccacccaggagaaactgtagctgtagcagctctcttcttgccccaggcttacaatgggggagagcacaattccagtgcctactgcatctggggaaatgtctgcagcttttcccagtgtctttccctcacagcattttcaagcctctccctaagtaaattccagggcttgggagaggcaaagtcctgtccctcgacctgggttgctcggattcccagtgtaaaggtgagtcacaaagggagcttctctgtctctctcacatactggggcttcactcactttgaacaaccagacaccatcatgggggctgtttgccagtgttttcctctcaagctttggggtatccttcaagattccagtggattcctgttgtctttcttgaattaaagcccacagagttgatctttatgtactatcttgctgttgctaggtggttgaggtgtgctgaaaacctctaatctatcatctttgaaaaaaaaaaaaacttttaagttttgttcaattagtccatcaaacatttcccacctcctacaatctttgataacactttaaaaaaattctaaacaaagcttttctaggaagttttagttttttcaaagctgctttgcttttgtgtctcagtaatggtgtattacagggcccagcagcacatggatgatccactgctgtaatccaccagcagggatccctggctccgtgatggattattgcattacatcatcagcccaagggctgacaggaaagaaagtacttcaaacagtcctccttcgtaaattgttttagtcttaatgaaagaaaagatatggttttgaatgggtatggatgagtagaaaaactgactatacctttcagctctgtattgaattacatacatgtgagagcagctaccaaaatgctcttggttcacaagatggaattttctgttcattttaaacatatggcactagctaatgtgcataacagtgaccacaatgaatataatattccataaaataatgaagagatttttagatcatctgaatcaaagaagaaatttaagtagtattagtataggttttataatatgtgcattttagttcttcaataatgtgtgctattgccctattaagccaaatgtttgtttaaccacatactacatttcatatccttgtcagataacagaattatcgctgaacttgaatgtatccatttacatatttttacatgaaaaatgtgaaatgaaaatttacattcatgtcaagggaaacaaatcacaaactctattaatcgtcttactcaatattttaaatttagtaaggtggtaagtttgttgaaagaatagataggcaaataaattaatagacctttaagttcacttttttctttttaagaaatcagtttcaaatgtacagtgatgttatgtttctgagagtaataaatcaaatatttttgcaaacaaatgaaatacatatcttttaccactctaaaataacttaaaatcaggtgtctaattggttgttattagagaattgtatggaaaacatagatttgaaagaccgaatttttattttaatttgcctacatttctcttctttattaaaagaaattaaatagcatcacgaacaaaattaactataggacaaagcctgttatttctattattgtgaatatgccccttctgcgtcattttccaaatgtaggatttgctcgttaaaaataagtagtggcacactttatgatattggcaaagaaaaacatgatctagaatatgatcttgtaaaatagtttctacccttttctaataactcatttaatgtcttaaagagatctttaatgttgaaaaattaaatattaaagtctttaatttccttctgaggctgctaataaaattgggtaaaatgaattcataagcatttttacagagttgtcataataccagcactacaaatcatatgatagtttggaattttgaatctttaggtattttattacactctacctgtgaaacatttagttatatcaatttaactcttctttaacagtcccacgaccttttcctcgtcaccaatttcccacctctcaccccaagtttgggaccttgagaagctcatgattccacatgtcagggtcaccagcttggatgacaataactatcctcttagtcctccctcagatttttatgtatctgacagattatttattattttggttattataataatcatttcaatatttacttactgagacccaaattctaatataatccttagatagaatttagactcaaatttttggatctttgcatgccaagagttttgttcaaggttttctctatttctccagtttgctaagtatctcttctgaagttctcttgatgtttttaaatttttttaatttgtatgggtttttaaattttcatatgatcatagtcatatgtcatatgtcatagatcatatatctatatgggttacattagatattttgatataggcgtgcagtgcataataatcacattggggtgaatggggtatccatcacttcaagcatttatcctttctgttaccaacaatccaattacactcttagttatttttaaattataattaaattatttttgactatgatcaccctgttgtagtagcaaatactgggtcttattcattctttttaactattttttgtacccactaaccatacctaccctccacttcatattttaaggtcttagttttaagtttttcacccaatttgatgtgatttttgtatgtggcaagagatagaggtctagttttattcttttgcatataggtgtccaattttcccagcaccatctattgaagagtctgtcctttccccagtgtatgttcttggcaccgctggcaaaaacaagttcattgtagatgtatgaatttatttctgggttctctgttattttctactgggtctatgtgtctgttctatgccagtacaatgccaatttggttacaatagctctgcagtataatataaagtcagggaatgtcattcctccagttttgttctttttgcttagaatagctttgactattctgggtcttttgagactccataaaaattgtataactgttttttctatttctgtgaagaatgtcttaggtattgtgatagggattgcattaaatccatagatggctgtgggtagaatggacattttgataacaatttttcttccaatccatgaacatagaatatatttccatatttttgtgtcctctgcaatttcgtgcagcaacaatgtttgaaagtttttattgtagagatctatcacttttgggggtaattcctgtgtatttaattttatttgtagatattgtgtatggtattttttttatctctttttcagatggttggctgttggcatatagaaatgccactgaattttgtttgttgattttgtatcctgcaactttactgaatgtgtttatcagctctagttttttggtggagtcttaggttttttcaaatatgagatcatatcatctgcaaacaagaatggtttgacttattcctttccaatttggatgccctttatttttttctcttatctgattgctctagctaaaacttaagtattatgtcaaataatactggtgaaagcagtcatccttgtcatgttctagatcttagaggaaaggctttcagtttttccgctttcagtgtgatattagctatgtgtctgtctcatataaatctgtcgaatttggattataggagggtatgttccttctatacccaatttttgaggatttttttattatgaagggatatgaattttatgaaatgctttttcagcatcagttgaaatagtcatttggtttttgtccttgattttgttgttatgatgtatcacattgattgatttacatatgttgaaccatccttgcatcactggcataaattccacttggtcacagtgaagatcttttgtgtgtgtgtgtatgtttgtgtgtgtgtgtgtgtgtgtttctcagttctttaatttaatcagcaaaattaattagcactctttccaaagaaaatctacatttttatgttcttttatctaatttctttctttctttctttttaatttccaaagcttattggggaacaggtggtgtttggttacatgagtaagttatttagtggttatttgtgagattttggtgcacccatcacccaagcagtatacactgcacccaattagtggtcttttatccctcacctctttcccactctttcaccctgggtccccaaagtccactgtgtctttcttatgcctttgcatcctcataacttagctcccacatatgagtgagaacatatgatgtttgttattccattcgtgagttacttcacttagaataatagtctccaatctcatccaggtcactgtgaatgccttaattcattcctttttatggctgagtagtaatccattgtatatatataccacagtttctttatacattcattcattgatgggcatttgggttggttccatgtttttgcaagtgtaattgtgctgctaaaaacatgtgtgttcaagtatctttttatataatgactctcttcctctgggtagatacccagtagtgggattgctggatcaaatggtagttctacttttagttgtttaaggaaactccacactgtttttcatagtggttgtactagtttacattcccaccagcagtgtagaagtgttccctattcaccacatccatgccaacatctattttattattattattatttgattatggtcattcttgcaggagtaaggtgatatcgcattgtggttttgattcgcatttccctgatcattagtgatgttgagcattttttcatatgcttgttgaccatttgtatttcttcttctgagaattgtctattcatgtccttagcccactttttgatgggattgtttttttcttgctaatttgtttgagttctttgtagattctgggtattagtccttgatgcatcatcaggttatttaaagttttctctttttttaatatataagcacttatagctgtaaactcctcccttagtacggcttttgctgtgtcccacaggtgattttagaatattgtgtttccatcatcatttgtttcaagaaatttttcaatttccttcttaatttctgaattgacccccaatcattcagaagcatattgtttaatttccatgtgtttgtatagtttataaaattcttcttgttattaatttctagttttatttcattgtggtcagagagatgcttgatattgtttcaatttttttgaatgttttaaaacttgttttgtgacttaacacatagtctatctttgggaatgatccatgtgctgaggagaagaatgtatactctgcagcttttgaaggaatatctattaggttcatatattttatagtacagattaaatctgatgtttctttgctgattttttttgtctggaagatctgtccaatgatgaatgcgggggagtctccagctattattctatgggagtctctttctctcttcaactctaataatatttgctttatatatctgagtgttccagtgttgagtgtgtatatatttacaattattatatccccttgttgaattagcacctttatcattatatagtgacatttttgtctcttcttatagttttgtcttgaaatctattttttcctgaagtaaatatagctactcctgctctttctgggtttccattggcatggaatatctttttccctccgtttattttcagtctatatgtgtctctattgaagttttcttgacctttacattatccaacccctattttagtggcaagaatattgcatggaaaactgtcattcaaattctactcctagaaccctctgatatctgttgattccatctcacacacactgagtgctatagcatttataaagtaccttaatgtgtaattatttttaaaaatttgtgaggtacaatttttttcaccattttcagaatgaggaaaattagactcagaggagattaaaagatttccccacggtaacatgatcctggtatttagttaagagctacaccaatcctgtaggtctttatgctagagatatcacagtaccttcctaataactcttccaggctcattactggcatgatttccatctagaatatcttcaggatatttctctcttcacatttatagtacaaatattagatttgtccttctcattcaccacaaagagcatatgtttttcatattaaatctgcctacttaaacataaacaactcaaaacatacacaattgggaggacttttgtacttaatatccatccatgagttctgttttcaggtcaggtttctggccctgaaatcaggcttgttgaatactttattttactatgtaatttacaagtcatgttgggaagttggaccctataattatatgtatttttagtgcaaaatatcatcaatcttttacctttagaacacctaatttagatctaatgaaatatatttaaatgaaatgtagaaagtactcaaacaagtctccccaattctgttacctataccaatatttaggatttttacaataaaaatcttcaaaaagtattaaatttttactgtcattggttaattctagttttttatagatgcaaaaaaaaatcatcagtggtatttttaaaagttccagccataatgtatgttgcaacagaactttgcatttacagtaaacagcttttctgcaggccatcagtggtgagactccctttctctactaagcagactgcctccttggaaaagagagagccattttagcttagcgcttcagttcagttttgttttgttttgttttgttttgtttttctagaaggatgtaaattgttctgtttgttcaaatgcagaacagtgaatgaacagtgaatagtaactttgtagtagagattgctgtccaaagggaacaggggaaagaaacgtcattttaattgaactcaaaaatcaagagtgtatctttaaatacaattgcatgtatgcaacaacgcaaacacttacacagttaatatcatttggcttcatctttagtcataatttatattcattacatatgggtaatgggtatgacttacctcaactgaaaggaacaagtaggggctgcctcaattttaatgactctgagttaatctacacatacttgtaactgtgcagtgctaagttgtgtagaacacatcaaataaagagttacctggttcagcgtagcataggagatgtttataatctgacaaattgaacatttaattttaaataaggctatcataaaactaagttaatgatttagaagagaaaatatacaaatattatttatgtgctcctagctgtgcacaatactcaaaatttggaaactatctcagagatttgggctgtatagacattctaattcaacaataaacattttcttattaaaatattcatggaaaagttttgaaaagatatatggtaacccattatttttctctaacagagggtattataggtactttttctcttctttctacatttttatttttctcaatttcctatgctgagtacttatttcatgagctttgaaaagcttcttcagaaaatcactagagatcaaaattgtaatatttacttaaatgtttaatgttaattaatattctgattagaagcgatgaccatattgtttggcaataaattctgcttgattcctctgtttggaagctccattattagttttacattaagtatatattacatataataaaagtgaaggaataactaattataagtcagtgtcttcagcaaggaagaacattagttaaatttatggaatagagttcttttcagtttaacagttaagagtaattgtcatttggacgccaactaaagaactgttcctagattagcaagtcctagtataaagaaaaatatgagattcttatattcaattatatatgcatatagtcaaaatacaattatttactcatggcctttcattatgttatattctccttaagaaatatgagtggtcttgacaatagacataaaagcatagtcataattaataaatttttgatttattcttcatgttggaattagtctttcaccataatgtaacaacagcctagacagcaatactgccccggatgtacctgcctcatcatgggaaggcagaagagtgaagtgataagagcatcagttccagggtcgggtgtgagatgaattcttagctgtcccactcactagctttctaaaattgggcaagctctttaatctctctttgcctccgtttcttgatctgtgaagtaggaacaaaaaaaggtaaagtggcttaatagtgcttggcacagtaggaagttcatgacaaagtttaactatttagaagaataagtgggaaggaatgcacactatctagtgaactagggcagaagctttttctcttgatttattcagataactgaccccagaagtatgctttctgttttcatttgagttatagtcataattttcgctattcccaatacagtgtgtgtagtcagcctaggtgttattcaatagacctgttccaacatctactgtgattgatttatttagaaatacctccaggccaaaatgagaatgaaaataaatggaacagatgaaagtgccctgctgcaagcaagagctacagattgaggttaagagtaattgctttggcataattgttatttgtaatcttagaacaaatgcaaatctcccattaggagcagtaaatccggtgcttaaagtagaagatgagtatttcactgcctagcaatgggaagccataactgaatgctaagtgcaacgacataaaaatttcctcaggcctttcattcagactaataatgcagggaatatggtggacacaggagtaccttcagaaaaatgaatatcaaagatgatttatttctcctgtgtattttttttccaagatacattaaaaaaactttgtctttagatttataaattcgtgctgtgctctgcttcataaatactttatatttatactgagcctgacttccagaaagcctgatgtgctttttatggttattagtctttacaccttcattactgaagtagataataaggtgaagatattagctttactttaaagagataagaatagaggcatataggaggtcagtgactttctcaaggttatgaaatcattctgtggtaaaaagaatacatgattcaaattcattttaactaccacatcatcttttttcagattactttttaagtcagtagttattattaccagtgaaattatgataatcatattgatgagccaaaggttgtcattagatttctcaaatatccaacaattcctgggccaagattactacataagaaatgttgtatttatttttaaatgaattgtttgccttagaatagaatactattttaaactattaagttaaagcctagataagattaaattgagttcttggccacacagcaggttatcttattatcttgatttaaaaaaaataaatgaaattccaaggtccatgtgtacctgtagaaatatttagaaatgtaagtagttgaagaaaagagtagataggtaaagttgaatatgtgtgtttgagaaagtgaagggcacaataggatagaaaatatattgcagtattgcaatagaataatgaaaaacatcagtattcagacagcttctgatgtatacatagctgaggtcaaatatcaagcggattttttttgtctcccagactgagatcacaccgccttaatattgtttgttagatattggcagggaaaaagtttagtatggtataaatgtattttttaacttaaattatttcatagatttttaaagaattccatgttaactctggagaggaaggagtacaatatgtagtctgttgcaaaaccagagtagtatatattttagataaatgggtatttttgaactctagaaaaattgaatatttctgggggttattaccccaagactgaaatccaaatgtcatctcagctttctcacaaggcccttaatagttgaagaatagaactttaatttaaaatccatctctaagaagcagcatccacaagactaccctctgataaactttttaacctgtgacctgttcctatagatctcatatggtgatacgttttgatctgtgatcctagttaatcgttaatggtgccccggatttcgagggacattctttgcaaaacagtgatagaattatagcaatataatcccaagctggttcagtaagactgtctatttttctttagtaaaataaaagagctgtcaagcactatttatgcccctagctgctatttctgtaacagtcccttccttcaacttgctaaggaggcgaaagagtcacagaagagttacaaatgaaagaaaaattaaacacaatacaaaagtgagagtgccttttagcctacattagggaggtgggagtaaagtatcaaggacacagatatcaccttcaatggttccctcacaaaaacaaatggccagtaattcggagctttgtagcttcctcactttctgtctctttcctgtaggctacaatgtgttgtccaattttagtgtgagactgacctagacaaataattgtatttagataacaaagtgaataaacaagtgcaattttgtttttgagctgtttctagagaaatgtcatgtaattattgcaaaagcaaatgtggaatttagaaatattttaatggtacaaatggctttaatgaggggcaaaggttgctagtctcttctctcttaaagccagttctgagttattaatgacttatatatattaagcaagtttggggaaacaattcacttttgacttcattattttaaagataataactctcacttttaccactaattatctacttatttcagtaattaggaattcagttaattctttggagatgatagatgtgttcttgtgtgtctactctgtgccaagcatgatcaactgaaatgcttatataaatgagtaagataaacattttaacttcccacagatcacaatcaagtagaagacttagactttaaagaaggaaagataaatgcatgaaaaatgaggtacaaacaatgtatagaactatagacaggagagaatggatatggacttgcttctttgggggaaaaaaaagaggtatttaaatcagttttgaaagattattaagattctaacaagtgattggaatgcagagaaatcagatgtaaatttgatttacatcactgcaggcaaagagcaggggtaacactaaattgccatgttctccatgtcagagacctgtgttgcagaaaatactgtgtaccttgatctgaaataaccacatccgggacactttagtattgtcctgtattcttttcagaatatcagaactcctcctggccctgcatactgctgtcacatggaataatataaattcatcaaataaatcatatatgtccacactctcaggccttctgtacctacctgtgtcttttatgtccataagtctgctttctccctgcctttttatccacagaacatacctacatttacctggctatttattaggctttaatgactcattgtgggagttctgtcttctgagaagcattgtccgatgctaccatctcaagtttaaattaagtacccctcctcaggggcacagagcccatcgctgttacctctatcacagcacttacttcatgctctctcaatccacaggtttttcagatctcctcctttagactataatcttctgatagcaaagacaataatatcaaacacctggaagagagcctgccctgcagaagaccctgattcaattaatatttgttgactgggaaacattcagatataaaaatgtagaaaaaatgtctatagtcagccgggctcagtggcttaaacctgtaatcccagcattttgggaagccaaggcaggcatatggcttgagcccaggacttcaagaccagcctgggcaacatggtgaaaccctgtctctccaaaaaataaaaatacacacacacacacacacacacacacacatatgtatgtacacacaaaacttagccagcatggcggcatgtgcctgtagtcccagctacttgggatgctgaggtgggaaaatcacatgagcccagggaggtcaaggctgcagtgagccatgacagcaccactgcactccagcctgggcaacagattgagacttggtgtcaaaaaaaaaaaaaaaaaaaaaaaaagaatgtctccgaataaacttggactatcattttcattgtgcagcaaaatgagtaggtgattgtacacacctaacccatacattctgtacttgtctctccccttcacttttcatatccttaattagcagagcctaccaatctttttttctaaatatattttttattatttccacttccattttatctccactatcattgccttaatataggacttcatttttcacttggacaatattgcaataacctcttaactcgtctcccagttgcaataaatgtctattaaatttaagtggttgaaatgcttaaagtaacactccctattttgaaaataaatcaactagcaagtacctgctgcccacctacaatatgttccaaacttattatgtgctatgagggagtcaggagaagcagagcatacaaacttccactttacccccaggacactataatgtgggcatggagaactgaaactgtgcttctcaaagtacatgatgcatgcaagtcacctagggatgttactaaaatactgattcagtaggtcttgggtaaggcctgagattttgcatttctaacaaatccccaggagacgtgggtgccactggtctgtaggccatcctttgagtgaaaaaatattaaaatccattaaataccatatgacatacctcatagtgaagattctaagtgcaggcagacttcatgaaagtagtaaatgatacaatggaaaactctccatgtaagagaagaatggacactgagaaaatgcaagcccattccctgttcctactcagcttataagatgactcacttctcatcttctctctaaagcctttctgacacaatctcaccttcctggcacaatctcacattgccgctgtctctctacccctttctattcatgctctaaagtattaatacattcagaaagatctttctaaaatacaaaaccgactttgccactcttaggcttaaagttctttaattcctatcacctgccatttaaattccacaatggaaggcccttcccaattggcccctttcctgactctctagactcaatttccaccacttctaccacatgtcacctgcattcgcccagcttcaccacactctttcttacctctgcttgtcataggccattgcctgtgcctggcacctcccgtccccattgtctactaggcaacagtgcatccattcttactggaagctcaaaagttccctcctccacagggcctgccttctcctgccaggcagagttatgtatttcaacgcctttttgagtccatagcatataaaacattattgagttctatttatctctactgatttcagtactcccaagagagcccctattttgcaaggatctgaatctcatctttctttataccttctacccatattcaagatgtgaaagatgttttaataactgttggttaaaagaaaaaataaataaataaatccgaactagctatttactcaaacatccctttttaccaagaaataatttatgatggcactaataaacaaaaccaatgtgttctgtgatgagatttcagtacacaacagaagtaaatgttagggtgaagggaaaggagaaaaagaagacagaggaagaaaatgctaagaaacactgcaatgaggaaaatagatatttactacttacatgttaagtcttttctgagaacacacatgtgcacacatacacaacattcataatttaaactgccctaaaaagtccaaccaaattttagctcattcccagaaagcagtagacaagacaggaaagtgtgttaatactccttcttttccagtcattattcacctaggtactggaagttgtgtctcagatattggattgaatggaaatgaaagagggtctcttggtgagagcagtcaatgttcctcctatttacagatggcatggctgtgcttacggacaatgtatgtgaattattatttttcagttgaaagcaaaactcaaccatgaatttcagggagcaattaaaagataatcctgaatacaaataaatcatgccccacaactcataagaaagccacataaatggtcatttggtaaaagagaaggatatctttagaattttctttagaacattgctcaataaagaaatacaaaagtcaataacactagacaaaaaatatgcagtaaaaccaatgaaatatttaaaagactgtcatttatactgaaaaaaatagaccatcaacattattgttactcagaaatctcacattcttaatataaaagaaacttggcaatgagtaaaatgattaaaaattattcagtgtgtcaaaaaacactcagccaaatattaatgtaaatagaaatatcaataaaaaagtactcattataaataataatgtcacattacataaagattaacttcagtattacatcaaatcattcttctaaagctatttatattaaatgtcatttaattctcccaaaattttaatacttttctatatcatcttttgtgtccatatttttaatccccagataaaaagtgagtgcctaccaggttataagttcaatatgtgttgaagctgaataaaagtgagttatcatcagccactatatcgatcagtcagccatattttccagagcatctgcctacatgctcagcactgctctgagagaaatagaagaaacagggagcctgaagttggtctcctttcctgggcattaaggtgtagtcaggagacaatactaaatgctaacagtgggatcagtgagaaacggtggaagctagtttataagctatatcatgtagttcatgataaaattgctgtataggattcagagtagaaaagttctacccagacatggtctcatgagttggggatggaaagattaaaaagatgtccaaagtagcaggcatggagtgaagtccagagtggacagatctgaggagatgttgcactcttcagattcaggaaaaaatatgaccacagatccaagggcaggaataataatgcacagccgggcccttgtaacacaactaatataggaatgggaccctatagagctgcaactgcacagcctgcacagtatgcaaaggccctgctatacagctttctcaacctgttgtgctgtttttggcttccttgaacccacttgattccatcctttgagactcaaatgttattgtctctgtgaagcctttccctttcccaaccttccgtcacactctacatgtattaacaatttatccatatgccataattacatatcaataattgcatgtaatctttatcccaccagttcactcctcctcatcccacacattgtctaaatcagcagtgaccaacagaactttctgtgattatagaaatataatatctgcactgtccaaaacaagatcctctagacaaatacggccactgaacgcttgaaatgtggctgatgtgacagagaattcaattttatttattttagatttaaattaaaatttaaataacagcatctggctagtggctactgtactggacatatggttttatactatgaacttcttgaaggcaagaatgatgtattagcatccatatactttagtatagtcaatcatagtatgtactcagtaaagttttgttgaataaatggccaaatatgaatgaatcttagtatatagttgacaaagtaatgaatataaagatcagacatatgaaaaagtaacaaatttaatggtgtctaaagataattattgaaagatgagaagagaaatagtgtgatttgaatgtagtctgctttttaaaaaaatgtcagtaaaggtaccctaaaatagaaattaaccaaaaaaaaacaaaaacaaaaaacctgttgaaatgctgatactctatcttctttatatgtttatgttttgcactaactttttccactattttatactgtcttaattatatctaagtcttcaaacactagactgtgacctccttgaagcaggtacttttattcccactgtgtacccagttccaaatgtaagcttagaccacaataggtacccaataaattttacagggagagtgaaatgagtgataagacaggaaataaactattttaataaaactagcagagttgatgttcagaaagaaaagatagctgttagaaaacatcctaagtgactgtgaacaataaggcattctgcaacatctacttcatgtgtgcatttatgccttgtgtttgagaaacctgtgttatttcaaataatgttttcctaaaacaaacatgactgtcttattctccctgtctcctacctgccattctataaagtcccattgcttttagctttaaatttggtttcagcctctttgactcttttactattttcttttagtatttccattaccttaaaagagtgagtacagttgtcttcactttctcgtggtagaaagttaacagtatagaagtatgaaaatgtcaccaaagactaatcagaacaaattgcaagagtttttcctaatgtctctgcttcagacctaccatgtagattagcatatcagatttatcattctgatacatcagagtctggtttatatttgccagccagtgtcacttctcagagcactgttttttactctgagtcagaacaggtttctgtgatatctcccttaagaaatgccaagtttggccaccatctatatctttttccctttccctgggtagctcagaaatcaataaaagagcaggtttatgattgctgatgcttaaattatacttgtcattctaaagatatttattgcacacttactatgcaaaactgtgttctaagtgctttaaaggaaattgagatgaatcatgcatgaacctgacctccaagaatatggtcatcactgaaagataagatacaggtataatagataaaaagtagcaattgctaagtacaattatccctccatatctgagtgggattagttctagaactccctccagatactacattgccatgatgctcaagtcccttatataaatggcatattatttgcatataacctatacacatcctgtatactttatattatctctagattatttataataccgaatacaatgtgagtactatgtaaataattgttatactttattttctatttgtattatttttattgttgtattattattttttatttattcattttttggaaattttcaatcaatgattggtagaattcacagatgaagaaccctcagatatgggggtcctactgtagagcatatggatttagagcagccttggatttgtattttgacccccatattaggagttacatgacattaaacaaaatacattaacctctctgtgctttactttcctcttttgcaaaataataccaggttttgtctctggattattgacttataatctggatgaacccaaaacccctggtggaggatgagagagaccaagcatgtcaataccttaacattgttttgtccctggcacacacatgaaaatgcttagccaatgcctgattataagcaaaatgctttcagagtttagagagataatgcttttgctgtatggatgacgtggattctgtctgaaactgaaagattgttggatttagacatagaaaatgcaaagtcaaaatctgaaaagaagagtatcaactatccacaataattcacaaggccaggagatcggaaattattaattttcttcacaattatgtttattgaaacattgtctaaaatctatgaagtaccatgctaggtgccttagggaagaatggcacaaaataaatggtctctactctcacaggagtcattgaactagtagaggttcctgggggaatcacgccacctttaacctacagcatgtttttctcattggtagaagtaatattgtgggtttgttgggagggtggactgctagatgtcagggactgtgttttagttaactttgcctccacgttaagcacaactcttagcacatagtaagtactcattacatgtttattgaatgaatcaatcaacatattttgcatgaatatgttctagtgcttacccaatagtaaaattaagacttttataataattcttaaaaatagctacttgagttctacactgttaatacctaaatgatgtttatcaaagagtgtagcgcttcaaaggcaaacttaacaactgctgaatgattttaatcatgaaataacattcatgataatattaccacatttgtgtaacactttatacccttctaaaaacgtcttttggataattttcctggcttttggtttttgtaatttgtacgtttatgaaatgtgatatgtttgaatttgagtaaactctgctcacctagaatgtttagacaaatgaaaaagtataaaataataaccaataatagtaaaaatcataacattgatgacaaaaccaggagcttccattcactgcgcagttgctgtgttccagagcctaactaccagtgctttacaggtgtcctcttatttagtcctcacaataatcctacttaacaggaactactgcaagttccctgctacagtgaaggaaacccagagttataaatcttagaaagaatgtcaaagatcataaagcaaagaaatagcaagaccaggattgaaacccaagtttgtcttctcccaaagtccaggctcttcacaccctactactaaactgctacctactcctaaataatgacaacagagactatttataaactcaccctttttttccaggtattagacctttagggaatcatttatcctcaaaataacactagaagaatataggttttgatattctattttccagatgagaaaactgaagcttaaagaatcttggctgcttgcccatgtttacagaactagccatggcaaatagagaatagacccaaatttatttaagaggcaacagggtccttaatcactatcttctatcaatggtaattaagtgttttggttaggaaaaaaatcattgtatttagagtaagttcttaccatagttaaaatgaaataatgtacttacacttaacattaaagtcacaccaaatataatttcctcttttcacaatgattagaaaggcacttcagaatcttgaagtgcctcattatcatgcacataattagcatataataatatttttaaagggtgggtgtttgaacctttggaccatttagcttctggacatgtgggagtttgtttttaatgttttcctttactaaacaatttctagctaaattatctggaaatcaggtctgaatgaaagacgcagagcaaagtatactcttaacccaacccctatgccctcagatgagagaaataaacccatctttcctcagtggatagaagaattatggaagaaggtgagcatagctccagtgttttcaacatcttaagttactcatcaacatctatttcatttcattaataatgaattcaaccaccaaccaatttgagtaattgtcagtaatcagagaatgtttccccaaccttcaaatctatgtcatggaagtgaaaatttccctagcgccataacagaggagaaaatcttaagttatataatgtgaaaatatttgccattttatttgaggtactgggatataaattatatatatgtccatcattcttcagcatgtttccaaatctgcagtgtattgtattttttgcaactaatagaactcattacactaatagtctagtattatgtaaatgcattttatccaaatatctagtatccataagtagtttgttctctatatccctaatgtaatatatcaaacaataactcatttgtcaaagggagacagttcattaaaattcaacaactgtttggccaggataaaacagcaacagtataaaaattgatgttgcaaaacttaacaaatgagggaataagggaagtgagaataaggaaattgcaggcctgccctccagggccatttttgggccacttgtctgaattttaatattacaattgttttacaaaaagtctccaagttattaggctgggagggaagccaatttacagctaggtgacttgaatatcaggggcattcaataaatgagaacatgatatcacttaggacatagagtggaaaaggtacaacacttgagcactgtgctacaattcagtttttaaaagtgagttattatatgacttagcacatatcatcccttgttgagttgtatttaagtagcatagtgaataagagttttagactgttttgtttgtgttttcaaatgtagtatttgctccatatttttttaaagcaaaataccaagcatagaaatagcacctaccagaggtttagataatttgaaaagcaaagaacatgaacctgttgatgagctgacacccattctatcgcaaaacagttttaggaaaggtgaaaaaaataaaaacatgcaatttttgaaggtgcctggagaagtacatttatcatttgggatgtatctatgaaatctgcttaaaattaaaaataaaagatttttaaatatttttaaaattaaacttattagacttattgtaaaaatattacacttattgatacaactatgttcactgaaatcactttattcaaaaattactatattaacatatgcatgtatattaaaatattagacttattgatataactatgttcatcaaaattgccttattcaaaaattactatattaacatatgcatgtatatacatttaagagggaaagttctttatgtttacatgcaagtgctgctttgtacttatacattatttacttattagctgtatataacttaactgaataacttctcatcactttaatattacctacatacttctagaactttttgtttctaaacaagtttttctccatatggtgttatcaaggaacatcatgtttgactcttcatatagccaacaaaaaccctgattttcaagaaatctgtctttccaaaggcaaatacgaagggtttgactgggggccgagatctcttatagctgaggttttatactattctctcctctttctaatggcagtagtgtgtgcgtgtgtgtgtgtgtgcgtgtaactttcattttcccacatgcacccaatgtattaaatttattctttcagttagcagaagcctttccataggataaaaatgacaagcattatgaaaggcattcaaagttcccaggcttcttaggcccattcgaggatcaagtattccttcaaaatccactttcaagattccacaagtttattgcaagatattcatatgtaaattaacagacctgtgtagtgatctccctaacatatttttgctctatcaaagttctacttgctgttagaaagtagcagttaatgtcacaactactgttctgttatgcatgcgagggaatcaaagtacagtaatcaaagtacagtagataattattttttagtacatagtagagtggtataactaagctttcttttaagctgttagtcaaattacacagctaataagcaaaagacaaacgagcaaagctatatttgctacactgtttgtctcttaacggagatcaaagaatgaagctggtttgcaactctgtgacctgtcattctgtgaaaagtgtgtctctcgccaaaaatgaaactacaaatcacatgctgtttgatggtgtgcctgtgcttgtgtgaacaggccaccacattcaagctatgaagaagctgctaacaggtgtcatctgctttgcaaaattacagtttccacaaagcaccacgaattgggatcattaagaatacccagatgctgtatcccaggcttcagggcttaaacatgtacttcagattttcaggttgttttgtttgtttgtttgtttgtttgtttgtttttgtctttgttttcagtttcaatgatctatctccaaatgagatactctgagtgtttgagctttgcacctatctatgaaatttactttaagtaggttccttattcaatgctgaaaattaggtcagctagaacttctagtccatttgacttcttatctattaaaacttcttgtttgacagaagtctatgaaaagaaatgaacaaatatgaatgtgacttatgcaaagccaataaaattatactttaatctattaagcttaaacccctgaaattccatcatattccgttgtatatttccggatagccagggcagatacatgttttgtttttgatagtgttaaaagctgaaaaaacattgatttgtttgaagaaaaaaaaacataaaaggcatgctgtaatgagatttttgaaacacattagagaaattttaacttaaaaaattcaaaatattaaacataaaactcatttactctaaatttattatttgaaaaatgaatggatttaatcaagtaaccaggattttttgcgtgcttgatggctaataatttctttgtgtgcaaattacctttcaactagttgcttcggtgttctaagatataattaaagagattaaatgcttatagaaatcagagattctatgcagatgttattactcataaattttgttttcaacaagttaacagggcaaatacttttatttatctatgcattcaatattcattcagtaagtttccactttgtgcttagcattggactggctcccagagaaatgtatatgtaataaaaacaatgtaggtcctgtcacgatttactgctgcttagtttgtgtgcgtgtttctgtcttgtcttttctattggcctataagctcttggggctagttatatagcatcatgagttccccaaagtgcttctcacaaagagctcaattaataaatagttttatttgcctatgaaaagcatctgttataacttactttccttgcctcattttttccccaatttccctccctagcaacttccactctgtccacactgaactgttcattattccttggagtgatttgcatttccatatatctgggcctttgctattactaaactcctgtgtgttttgttttgttttttaatgtcgtttatccatacacttaactcctccttcaaaccaagcagaagtagttctcttctgaatgtaccactattaaagcacttattacattggtatataactaattgtcagctcctgtcactaaactactaaaagtttggtatgattttattttcctctttgtatctgtagtgccatgtaagaccttttataaaggtgacatataacagttggtacaaaggaacaaaataaaatggcatacaatagttttaaaaagtttactagagctttgtctaacaattagtcattgcttactattgagcaggataataatgccttgcgactgcttccaaatccctctttctctgatctctctgcccttcaacttttcaagagtaccttttccatatactctctacctcaaaagcttttcacttaaaaccctcctgccaaagttgggagagggattattggtgtagtgatggtactttttctgggagtatttgaatccaaacaagaaataaattaccttaaaccaaaaaagtaggttttgaactgcgaggtttcaaggagtatcagaaacaaaggaaacagttttgtcagaggccacacacacaaatccaaaatcttcttacgactccattgatcttcgtcctgtgcctcttgatgttttcatgaaagatggaggagttgctattacatgagaaataagctgttactaagattattccattctaccatggcaaagtagtgcagatggccatatgggaaagctgaataaataattattttataaagataaaactaaaaatagtatccatctctcattcctgaaagtagcatcactgtgctatcttgtgtaagattacatttttaaggcttggtttaaaatattttcattacaaattcttctctgacattgtttaaaatattttcattacaaattcttctctgacatttgtaaaacattttctatttgttttacaaattttatttttaaaaattaatttaaaagccaatagtcactgcagagcttagaataaatttcatcatttttctttatctacaattaccaagggaacaccatagcataccattgctaaatggtgttttcattcactagatgaccatcctcctctacttatgttattttactactaaagaaactgcaatatttttttattgtgatataatatttatttcccacatattttccaaaagaccaaaattttaatcaaaatttaagaaacaatctcctggccaggcgcggtggctcacacctgtaatcccagcactttgggaggctgaggcagacggataacgaagtcaagagatcaagaccatcctagccaacatggtgaaactactactaaaaatacaaaaattagctgggcgtggtggtgcacctgtagttccagctactcagaaggctgaggcaggataatcacttaacctgggaggcggaggtttcagtgagctgaggtcgcaccactgaactccagcctggagacagagctagactccgtctcaaaaaaaaaaaagaaaaagaaaaaaaagaaacaatctccatcattcttttgtgacataatccacctatatacacttctaactaaatcaagatatttagattatagtctaagttaaacaaacccagatgtacaaaaatcatcaggctatttgtagagaaagtattgttttgataaatatagttatctcaaaaaaaagcaaaaaaatgaggatatgtttaagaagtaaataaacatttgtgtgtgtgtgtatatatatatagacatagatagttacagatataacattatcttttagacccataaggaatgttgggataaagaaaatataacctattcactaaaaaaaaaaaaaaaaggaaatgagacccagaaagaaagtttcagtgaaccattcaagatttttttttcttttttcttttttctttttttttgagatggagtttcattcttattgcccaggctggagtgcaatggcacgatcttggctcaccacaacctccgcctcccgggttcaagtgattctcctgcctcagcctcccgagtagctgggattacaggcatgcaccactacgtctggctaattttgtatttttagtagtgatgtggtttctccatgttggtcaggctggtctcgaactcccgacctcaggtcatccccctgcctcggcctcccaaagtgctgggaatacaggcatgagccaccgcccccagccaaagatcatgttttttactcacagtcatagctagacccaaacacagaagtcttgacctttaaactagttcccttcccatcatatatagtaattgttgaagagttatgttcaaaatagaatatacaagcaagtttaagatctctattttagaaaattgaatctttgaaaaatatgtttgatgatatttcagaggcattattaacatcaattatcactgtattaataaaatttacatttaaaaagtccagtaagtagacttatgaataatgaagagtttattaactacactcaaagagacgatctgaaaaaacagactaataaaccagaaaaataattagattaggaagctaatctgtgtatgagattgctcctcaaaccaaatccactctgaatttggacttggacttagtgagggattagagaaatctctctaggggccaaattcataatccatggcagccaatgcagccgaagtgtctgtgcacaagaaatattcttgcctgacttgcaatattatcttgctgctacatgcttcactaagttggaagagatgccgctaaagagcagggggcacaggaaacctgattcaacttttggaaaccattagagaagcatgctgaagtttggagaaaaaaaaactgccttcttcaggggaaattaagtataatcagaggtcaaggtagaaatttactaacatagattgggcaaccatttacatggattagggcatggactcactccagtttcaccaaatgccacacctggagagtaaacgtaactcttaggcatcagtcacctggagtccccgggctccttaatgctctgtcaagattgatgaggataaagcaggaggggcacagatttaagcctataaattgaatcttaggtaagcctatagtcttagacagactatattttagaagacagaatctggcacactttaaaatctgatttttagaaatgtttttattagtttagtacattcacttaacaagcataattttattcacaaatgcctatcatgtgcctggcaatagggtctgaattcttcataacccagaactttgtcatactcagtttttagcctcagaaactgacataaatttatagttattgataaatcagaagataattctgtacatctattttttttctctttttttcgctgcattgatagtctgaagatcaaatttcccaagctctcccaatagtcatgcaaaattatacttacttagattttctattacatttatttgtaaacttaagttaaaatctattttcaaaagttctcattttgagttttattcgtcttgtatacactctgcacgtaatgtcatcaattaaaatgagaatatgcttagaaaatctttataaccatctaccatggctaatgatcttaactttaatgcacaaaatgttatttcattggaaatttggtgcgttcttagagtgacccttgtttctgtaacattttcagcgatcttagatcaaaaagcaccaacaaatatttctagatttgttttctataacaagtactcatatggcacttaactatttgaaaaataaatcagttaaattttaaataattgctaacaatcatgctgtcatgatctacaatgtatagaaaaaaatagctaacacaagtagaactttgcatacgccaagattgtacttgaaatgctttacatatattgactttattcatctttacatcaactctgtaagaaccattattatccccaatagtaacattcccaaggcctttcagcttgcagtggtagaagtagggcttaaccccagatggtcaaactccagagtctgtgctttcaataaatatttaattttgtcaatttataacaaagtcatttggagcgtctcctgttgctgggatgcatggatggcaaaaatatctctatcttttagctatcacctttgctgaaatgttgggtggtccatgcccacagaaggtgagaaagttttatatgcttatttttaacaactagaacataggatttaaaaagacaagggtaaatttcaacaatgtagtgtatatgttgtcttctaaggagcaatagaagacaactctgactatcttaagcaaaaggaaatgttttggaacaatagtggaaagccacagaattacaggaaggctacagaaccaagcttaaaaactaacaggaaccaagccgtcttggtggaagaggaaaaataactataggtatagtttatatcagatacagagtgaataagtgagccgtactaggataaatgaattccaaatattttcagtctatttgctgctctactcaagactttataaaaggagaatggctttcttgagctacggtacttaacctcaaaaaaaaaaaaaaaaaaaggagaatccagttagcctggcttgggtaacaataactcttccttgactaagagagggaggtgattggaacgcagccctgccagtctatgttcaatgaggacaatacttttctaaatgcaactgaggctgctcttagaaaataaaaataggtacgggcagtcaaaaacccacagacatccatggttgtgactttcaaaataattcccattatctcgtgtgtgtgtgtgtgtgtgtgtgtgtatgtagataagttaatctgtcctaaaaactgctttaaaatcatattttgttaagatttatttctgattataacagtaacacatatttactgtagaacacttggaaactaaatgtgaaaagtcacttacaatcccaagaacgatctagtattgacattttgatgttattctttttgtctttctacaagtagttatacatacacatatatctatatactctatactaaaatttgagatggttcctgtacttttgtgttgtacatttgtcacttagttgattgttactatgtttatattattaatctctaagaacatgattccatgaaatcgataatcatctataatataatcattctacattgttgtacctttaggttggtaagtaataatagtagtaacagagaagaaaataaaacagctaatatttatcaggtatgtattgtaggtcagatactctgtggcatgctttacgtgcagttttattttactaaagcagaaactaaagctcagggagataaatttccccaaggtcaaagagctagtgactatagagtttggatttgagcccagatactctggatagcctgtgttcttggtagctatatctttgtgttattactaaatatattgtgctgtacatccttacatataaatatttgcacagcttatttactttagataaattccaagatgggagattgctgaatcaaagtctaaacatttacaaagcccttgatacattttgcctgtacaaatatacaaatttctattttttctggcagaatatgaggatgcttatttcataatagtcccatcattggataaaattatttaaattttcaaatttgaaaaagaatgtaatgggatcttatttttgttcgttttctttttttaattgataatgagactcactatgtttcaattcattatttttacctttatggtaattaagtgacattcactgaaccgtatttatctgagtgcccacacttctctcccctggggtattatttaatgacaaaggtaatgtgcatgaatctcttttgatctggcctcatgactagattcttttttttttttttttttttttgagacggagtctcgctctgtttcccaggctggagtgcaatgcactgtctcagctcactgcaacctccacctcccaggttcaagcaattctcctgcctcagcctccagagtagctggaattacagccatgtgccaccacgccaggctaattttgtgtttttagtagagacagtgtttccctatgttgaccaggctggtctcgaactcccgacttcaggtgatccgcccacctcggcctcccaaagtgctggaattataggcgtgagccaccgcgcccgtcctgcatattcttatattcattttatggagcagcttttctgggagtcaatctaaccttgctacgctgagagtatgcaatgctttgacaaaggatgtaaacctcaggttccgtatttgtaaaatgataagaataacacataccccgtaagtttgttatgatgatttaataaaacataaaggatttgagacaatgttcgattcattttaagtgtttgatcaatgttggctactatcagtaataatggtaatagtagtaagagtgagagtggatatgtggccaaggtgatcttttctaaaaagcactattttctaattcttggggatgtggactgccttacagaggggagtaagtctgaacagtgtggaagagttcacctagagctcacaatctatgagggtccttttcaagaggatcctctcaatgggcagctatctgcatcagtaaatgaatacgatgattagataaggtttgcctgaggtaaggacagaggtggaggaacagtcaaatacatgctccgaaaggctcagggaaagaaactttctcctcattatcattttggtgccataaattccattttacttctgcagaaattcaggttagaatggcatttattagatgcctatcatgtgggaagcacagttctacaagattttcaaacatctcatctcaaccttatataaaaagacacccaatggatgtgaaagaagtattgttacttacagagcagcattatgtgcagaggaggaaataaataccataggagcttagtaatttacccaaagcccacagttatagccaagtttgtctgtcatttttttcctgccaatggccatttctggacatctaggcctggagagctctctctggagagtagatttaacaggaaagtttcatagctcctcgtgtgatcagcagtgggatgctggggtctaataataatggaccaggaaccctgagtttgacttcagctcctttgcctctgccgtttactcattttatcactttggaaaaattacttaatctcctgtttcctcatctgtaaaatgcaggtagtgactgctaccttgcagtgctaatgcaagaagaaaaggtaactgctgtaaagttcctagcacataataggcaatgaataattaataattataaataatggctcagaatattagctattcaacttctaaggcttgaacactgtgttctcaactctataacctcaatattaaaacccaaagcttgagtcttcacattctgacttagaaagacttccttcattgttcctgtcatttatacaccaaatgtaaactaagttcttactgtgcatgaagctctttttaaatgctttgagaggtaaaagattcatcagacacagattgttcactggagggccctacagtatagcagacgaggtgaagcatggccatcaataactagtatccagagtagaaagtggtaaatgcttcaataggatagatttcatagaaagtgctatatgttgcagaaatattaatttcaactaataaacatcacaaagcaataatattaacaatcttttcttttatatgcacttttacctaagatcaaaatttcatttcaacctccctgtcagctattgaatggggcaactttatcttacttgaccctaaacagaccagttattcctcctccactatatattttccttaaccatcagacacaactattctaattacatggagcaaaaatcactgctaatctttttctctgatcctagagcagtagtgtccacagactatacaagtgtgtatagcctgggggtagaaattgagccctgtcagggcatggttgttcacgcccgtaatcccagcactttagaatgccgaggtaggtgaattgcttgggcccaggagtttgagaccagcctagacaacataatgaaacctcctttctacaaaaattacaaaacagtagctgggtgtggtggcacacacctgtaggcccagctacttgggaggctgaggtgggaggagagcatgaacccaggaggggaggctgaggctgcagtgaactgtgattgcaccactgcactccagcctgagctacagagtaaaaccctctttcgaaaagaacaggaacaggaacaggaaggaaaggaaaggaaaggaacggaaagggggagggagggaggaagggagggaggcgggaggagggaaggtgggaggaatgaaggaaggaaggaaggaaggaaggaaggaaagaaggaaggaaggaaggaaagggaaagaaagaaaaaagaaattgggccctgtttgctcttggcctctcctaatgtcctatttacttagaggtactgctgggactgattctgggtctcccaccttccagctctgccttctctttcctgtacagcatcaccccctctcagcaataggcaggttacaaattacagcctagtgatctagaaattgcaaactcaaatgaatgaagtccaatgagaagcaaggatcaagatgtcagaaaatcctcaagttcattgagcttaaatataaaaggagagggcaatattgaaacaaatttcttacatataaatgtcacccagcagcattgccatctgctcccaaataaagcttgtgtctagataaggaaacctcatttatatggacaatataatgaatctaagtatccataatagtgttccacagcacttatttccctctcaccatggttctcctttccctaatttgccctgacctttttaggtgaagtttcttattgaaggcagatttttttccttgtgttctctttatcattcaaattttctttcatgcatttctctgtgtacttcttattctttaatccttatttctttttcttatgctttcctctcttcccatttcttcctccttctttccttttttctccttttatgctctcaattcacttctttatatctcaacatgtccccgtctctctaagtctttatgtctctctacctttcatcttatccctctccgttgaaatgtgttttctgtgcacagtactatggtacttgaggaattgggaataaaatgacctggatccaaacacaaaccctcttgcccaactaagctaaacacagaagagttggtattttattcttgttccctgctcctcttaaatagccatgtctatttccaaatgaaaagtctgctaatgacctagcaggttcccagtgtagataggatccaattatctgctatttggcacacaatggcctttctgtctgccagccatgtaccagggggtgaaaatagcatgtctactttattcctgagcgtcagggtgtttttctactagaaaaaaaaaataaaaccctgaaaaatagttttgaaactcagagtattttactcaaaaggtcaaagattcattggaatttaattttctttttcttgttatttttaagttgtcatttttctgtaatattagttgtgctgtgtgtatattttcagcctgagttttctttgttccttactactagattttgccttaaactcataatcctgactgcttttcacaatgttcattttcccatggcaacagagatgcaaatgaataattctggtgttactgtggggaagaaaagaagaacctgtgtgtgactcatacaagaaaatctgttattcaagaataaatatcgcagcagtaataataaaggtcagcactcccatctcacccaaggaagtcaatgagagatacacacaggtggttgaggacaggctgttagtcctcagtgagtggtgaatcttgttggtcaagtgaattgccctcatttttctgttagaggttgtggactatttttctttacaagggaagcactttatttatttatttattcattcattcatttacttatttatttattttgagggtagagcgtgtcattgaaaggtacctgacccaaaaagataagtctatctaatgtgcttgcttactgaagcacaaacttaagctctctcctcctatgattatgagagttcttcgccatttctacccatcagctcacattcctgacatcagcagaagttcactgatgcttcaatgatctagacaagagcagtaattttctgccctgtgcagtctctcaaaggttaaaaattctaattgctactaaggatttcctgcaaaaagagatgtttaaaatccttatttgaaggtccacttcaccgtgcacagaggaagtgtattcgtgcacagaggaagtattcattccttctgtgaaacataaacactcacccctccagattagcccgtggtacatttgttcttgggcagttcgatgtggatgaatcttgtgagacagggaagccatggtaagtatgctgtcctgggtgttctgtctcaggactttcttctgctgcccagggcactgctattccatcatctagcatgctgctacagctgcagaaggcagacagagatctgatacattcagggcacccacatctatgaggaaaatggatgaaagatcaaagaacaccctcccatcaccacgcttccagcatcaccaacataggatgccatcttatgtgaatatcgactagggtttgtgtaattgtagctcataaagcaggatcttttccatagatacatatttttcataaggtatatttcttcagaatttctagatttgaatgatatagctgtggctattctgttattattagaaacttaatccaatcattccttattaaaaaaagatttccatagcaacacagacacaaaacaaatttcctgggtagatattataatttgtttcagataatatagaaattctattggagtcattattttaaaattacaattattatacagacttttttatcatagcattaatattaacagttttaaaatgaattcatgccaaaaatacaattttatatctttctattagacataagagacaacagacttgtatctacataagtaaaattaaatcagatggtgatttttaatgaaatatgtgtttttctccaaatctttttcttttggagcagtagggctttttgttttgttttgtttttaattttacaaaattgacctattattaccccaagtattttcttgataacttctaattccagagcaattttgttgttctttaaaaacaattaatcagaatagattttaacattgtacaacactgtaaacttgtttccagaggaagaaatattctttgcatatcaaaaaaattttaacctaaaatgtgattagcaaaagcatggattaattgtgtttccactgatgtaaagaaatcttcattgaacattccagccgatcagccactggattagtgcataggataaatgcatccacggatgttaactgaagtcctacatgttctcagtagagtgtgtcagattctgttggtatttgctccactaaacatagggttggggttttttgataataaagtttggggtgaaagtcttgagacagcataagctcatgaggaagcaaaaatgtaatctgattagcaggatttgtatctatgcatggtaaattatagaagattgtggtctttccgtgactaatgccctagaaaagcttcacagatgaaaactttgatcgttaacacggatactctttcatctctaaaacagcttagtatattacctaccacaacttttcaactttttaatttctaggcaagtaaaacattaaaatgcatattaactaaacttcaaacaggttttttttttagatgtcacctgaaaatctttttggattactcatttccagttatcatatcctagtctgcaggggcttattaaagaaggatttaaatgtaataggcaccaatgagttggcagaaatagaacacagaaaactagtcacatgatcacaggatcgtgaagtctcttgatccagaaattatgtaactgtactgaacacaaaatagttagcaaactattgtggcatttttattaatttgaatatgattcaaaattttaaaaaaaatttttatatgttcaactaatatcttaaataacatgaaaatacattgtggtttttctaatcttaggaatccactgaaatttcctcttaagaaaatttagatattcaaaacaatacacttgaagatttagcattgattgtatcatattctgtttttagaatacaattagcttgaggttaaagttaaatattataacattgcaattttcaaaaagaaaatggagatgtttagatttgcattactcactcttacttcagcacctcttctacacttagtacataaaactctccaaatgtaatataaattaaaagttttaatttttgttaacatttaaaaatcaaagtaattattgttattgcagaaaagaatatgcatattatggtagtaatttttaaggttttcaactcctcaggacttttcagtgattttgctgtcatagtatctgtatatgtgttggtcttttgtatatatttttaaattgcgttaatatagacatttgtaagttatgctttacaatagcaaaaatgaactaaatcacctgtaagtatgtcccttatctaatttctgtgtttttgtatctgaaaaggaaatacctagacagatgactaatttgtatatattaaataggaaatacagtggcacttaaattctgattagacaatgtgtatcttttttattttaatatgtttccacaatatatactagagaaagcctatttttaagtatgtcccagaactgctaagttcaaccttataggattctcgtgagtatcactgaaataactacatgtaaagtgcttcaattcagtgcccagcaaccagagcccagtaggcatggccactattatttgtattaaatattttaatcaacatagatggagtggacatgaaaattatgtgattaatttgttcactgtagaacccaaaatcaaatttagcaactgagaaaatacttcaattattaaagtccagatgaatctggtaaaaatctcccaataagatgacaacgtttgtttcaaaccagcaaataagaacatggactctgattttagatcaagaaaatgcagcatgtattctcaaaataatcacagataatcttctaagcaggtaactccaaaatccctgaggaggcattgtgttcctttcttcacttggtctcctctgcatgcagtgacaggggcgaaatcagatactgggctcgaggatcacaccaacttcaagccaccaaggtcaaggaggcaacatcaggcaccttggaagcagatcaatccttggcaaaactgaatttcgttttagctagagcacctttttatcttttacctcatactacaccagggggttcatagcccaccccctcttatttgctcaagacctctcatccctgctgtccaccaaggcccccagccaagacaaggaaagagggcctgtgtcctacactcagcccccactgctgttcattttaaactgctttgcaaacctatcagtgctctatagaagttacctctcagagtctccctcggcttgcttttcagctaccggtaaaataatttatgataagttcttctttgatgagaacagtctgctgtgcttcccagcataactggtattctgaagacctgtgtggaatggggaaaagagcattagaacctagggagtaccacatgttcctgtcattgtgaaactgatagactcttggaagcaagggtgtgcctttgtttacccagcaaaacccagcgcagggtctggcaaaatgtagacagactctcaattggagtgagcctcttgggttcaagagtaagtacttctggttgaaagtctgaagtatgatatcctccatacttgccttattccccctggactggtctcaggattaccatggaaacacacacatcaatcaaagatccacaatgagtaaaacaaccccgcccagccacagagactgccagttgacttgtgggagaagtgaaggaatgttaaaagttctttttctttttcttcttcttccagagtggtgagattttgaaactgaatggtgctcatgtctggaggtgttttatagattgtttttttgtttagctcattcatgaaaaaaaaaaaaaaaaagacaagcattggatacaaaaagtgcaatattgagtaaagataacatgcttggctggtgtaccgctctctccccattgtatctcctggtgtaatggccctgcccagatcctacacaaaataagaccctaacaggttcttcagccacaggcacaggatttggcataaagtaggcactcaatacatttctatcaaatcaatgcacctgtactaagatacagacagaatgcagatttattctcagctcaattagaaataaaatgaatatgtttttcattacaaagaaattgattcatgtcatattgccaagccaaatgtgtgaactgaatggactttatgatagtcaaaatgtatatggcttctatatacagaggccacaggctatgagaaatttccccaacaggaatattttgtactctaggatatttttcttatctcattcttcaagtaagacagtcagagacaattgtccccaaagatatttgcttgtaccttttcatagctattaataattttttgttcatgtgtcttgctgtctcaacaaacgacaatctcttatgcctctttcaacccctcatggtgtcaagcacagaaatttgcacattctaggccttcagtagaagttgaattaatattcttgttagagatgtacaaatgaatttctcttaattgaaatatatgcaaactagaactgcttgccaagttctaattggtaaaaaatgcaaacgctgcatgtatttggtttgctttctttgaatactgcctgtatttttcaaaccccttgacacattataaagcaaacctttagcaaaaagcaaatcaatttattttaacagagactccttaagaatgccttttgggggcatgaatggatgatataaaatgggcatctgctccccattatttccaggtcatgaaaatatcattcaattccaattctatgcttcctgcgtgaccacccaaatcaaagcagcagtctgactttacattcccatttcaaacagagaatcatctgtgggaggtagggagatatggttgaattagattaggtcaaacttttatttcacttaagaaacgatgtaccaaatctgcaaagcaaagggcaggggtgaggataatctgatttgttactgtaacttaataagtttattcagacaaaaagataaaacagcaggtggtcactcaaatggcaggtgaaggtagatgactcaccattactgcagccaatatgacccccttccaaacacccaatttagatctgattggcattactttagaaagctaagtctagggtcagatatagggcaggttctcactggaattttctagtgctctctaatattactggtgcatagctggcctaagtagcttgtatttataaatctgacagcctacttatatgttgccttcaaagaggtacaactattgcaagatagcgccattatagggaaaaaaaaaaaaaaaaggagaacaataatttatcaatcatgaggcccagaaggtaaacacaatgcctagaacctcaattcaatcagcaaaggcccaaaggatatcatcagcagacctaaaagaactgaatgtttatctttctattcctttgtttgtgagggtgtttagtattatatgatgcagggagcaatgtgtgtaacgtggtgatataggcaggtggtaattctgtattttattttcttttgttttccttttctgttgttgttgtttctttttttagacagggtctggttctgttgcccaggctggagtgtagtggcatggtctaggctcaccgcagcctctgcctcccaggctcaacatcctcccacctcagcctcccgagtagctgggactataggaacatgccaccaggcccagctaatttttgtatttttttaatagaaacagagttttgccatgttgcccaggctggtctcaaactgctgagctcaaacaattcacccgcttcagtctcccaaagtgctgggattacaagtgtgaaccaccgtgcccgacctaattctgtatttcctacttaggcattgctacttttgttttgatttgttaaaacctacctccatccttccttctgactgcactataactctgcttctttcttattgtattttatcactatgcattatatacactttagatcagtgtatagagcatcacgaggtttgttgcttgtcagtactcgttagcataaaaataatattcatcccgtattttccagtgggtatctccatcacacagtggcaagcaaattcctgcaggtaaatgcctaacaaagttgtgaggtcagatgagaatatgtatttattggagtagacttatattgtcacttgagaaaagatgctgttcaccacattggtacatgcccacagcctaccctggtgtctatcaacctttctttcttttttttttttttttttttttttttgagacagagtcttactcttgtcacccaggctggagtgtagtggtgtgatctcggctcactgcaacctccacctcctgggttcaagtgattctcctgcctcagcctcccgagtagctggggttactggcacccaccaccacatccggctaatttttgtatttgtggtagggacggggttgcgccatgttggccaggctggtctcgaactcctagcctcgtgatccacccgtctcggcctcccaaagtgctgggattacaggcgtgaaccaccgcgcctggctgtctatttacctttccacctgcatcctctatcaccctcatccaaaccacaatgtcctgggcaccttggcattatctttctttctaggcacaccaagatcatttttatcttacagatgttttgatgccttttcctggaaagttcttaccccaaatcatcacattataggttccccttaacacgtaagtatgagttcaaatacctttttcataaaattcacatcatctgtatcctccaactccatcctcactcacaagcatcagtttttatttgtcatatccccttgtttgaaagtcttcatatcacttatcactatctgaatttaccacatttactttcttatttgttctcagtgtatttgtgtctccccattgtgaaagatacaggggatgaaggctgttgtctatattattcactggtgtagttccagcaccttcaggtatatctggcacacaatatttatacaacaaatatttgttgaataaataaatatgcccttcaaagtgtatagtaggccagattaatggaggcaactggtgttggcaatggtggcaggggatggaacaggactgcctattgtccacgatgactagattttctgaggccctgaaatgtcacagaatttaaaagctgcaaaaagcttgaggcccaaagaaaacaagatcttccatctctttattaataattggcagaacagagatagctccaaagtctttctactgtttttcttctccctaccagctctcaccttcagagcttgggactctaaactgttcctagctttatatcaagtagcagttaaaaaaatacagttacatgccacataatgacattttatcaacgccagagcaacaggacaaatcttctatatgagggtggtcccataagattataacacattctttttactgtaccttttctaggtttagatacacaaatacttaccattgtgttgcagtttccttcagtattcagtacaataacatgctagtgtgtccggaattggtgggttcttgctctcactgacttcaagaatgaagccgcggaccctcgcggtgagtgttacagctcttaaggtggcgcgtctggagtctgtcccttctgatgttcagatgtgttcggagtttcttccttctggtgggttcgtggtctcgctcgctcaggagtgaagctgcagatcttcgcagtgagtgttacagctcataaaagcagcgtgaacccaaagagtgagaagtagcaagatttactgcaaagagcgaaagaacaaagcttccgcagtgtggaaggggaccccagcgggttgccaatgctggctctggcagcctgcttttattctcttatctggccccacccacatcctgctgattggtagagccgagtggcctgttttgtcagggtgctgattggtgcgtttacaatccctgagctaggcgcaaaggttctccaggtccccatcagattagttagatacagagtttccacacacaggttcttcaaggccccaccagagcagctagatacagagtgtcggttgttgcattcacaaaccttgagctaaacacagggtgctgattggtgtgtttacaaaccttgagctagatacagagtgccgattggtgtatttacaatccctgagctagacataaaggttctccacgtccccaccagagcagctagatacagagtgtcgattggtgcactcacaaaccttgagctaaacacagggtgctgattggtgtatttacaaaccttgagctagatataaaggttctccacatccccatcagattagttagatacagagtttcgacacacaggttttccaaggccccaccagagcagctagatacagagtgtcgattagtgcactcacaaaccttgagctaaacacagggtgctgattggtgtgtttacaatccctgagctagatataaagactctccacatccccaccagactcaggagcccagctggcttcacccagtagatcccgcactggggctgcaggtggagctgcctgccagtcccgcgccatgcgctcgtactcctcagcccttgggtggtcgatgggactgggtgccatggagcagggggtggtgttcgcccgggaggctcgggctgcacaggaacccacggaggcgggggaaggctcaggcatggcgggctgcaggtccctagccctgccccgcgggagggcagctaaggcccggtgagaaatggagcacagcgccggtgggccggcactgctgggggacccagtacaccctccgcagctgctggcccgggtgctaagcccctcactgtccggggccagcagggctggccggctgctctgagtgcggggccctccaagcccacgcctacccggaactccagctggcccgcaagcgccgtgcgcagcccgggttcccgcccgcgcctctccctccacacctccccgcaagctgagggagtgggctccagccttggccagcccagaaaggggctcccacagtgcagtggtgggctgaagggctcctcaaatgctgccaaagtgggagcccaggcagaggagatgccaagagcaagcgagggctctgaggactgccagcatgctgtcacctctcactaggctgtatcatttaggtttgtgtaagtgtatcccatgatgtttgcacaatgatgaaatcacctaaggatgcatctctcagaatgtatccctgtcattatcaacatacagagatgtttattagttttctatagctgctacagtaagttaccacaaatataatggattaaaacaacacaaagttattttattacaattgcacatgtcagaattctgacactggttccattagattaaaatgaggcatcaacagagatgtgttccttcctgaaggggaatccatttctttgcctcctgcatcttctaggagctacctacaatccttggcttatgacctcttcttccatcttcaaatgctgcaaggctggtcaggtccttttcatatcataccgctctgaccttctcttctgcctttctctttgacacttaaaggcccctgtgattacattagacccacctggataatccaggatactatccttatttaaaagtcagttaattaaccatcttaattctataagcaactttaactctcctttgccacatatggtagcatattcacaaactctgaggattaggatgtggacatcatcagaggccttttttctgcctatcacaagaagcattatgaaaataattgctatgtttccctctttcaaaataactatggtttaaattttggagcatacggtaccatttgagttgtgggcaattttgggtgctaataaattctgctataatagttgtccatagccatagtcaaatgttttgttagagtataattttctgaaaattaaaaataggactttccttgaaatttaagataaacacatgtcaaatatttcattcaacttattaattattaaagaaaccatgattctaagactggttcaaaggaatatatgaggaacagagatgtataatcaatcaaacaatgttgaaataataatagtaagcaataagtaataacaataagaagcaaaactgtttaatgtcccatgtgataataaaacaataacctttgtggttattcttttctaccaggcagaaatctactagttaaaatgtagcattccagtgtctgcactttgcattcttttagacaattttttaatccatggaagaacctgtacaaacaattacattgaaaagaactgcattcattcccttgctttccaagttttgaataatttttcttaatattttagaataaattctgaaaggagaatcatgggattaaaagtaaaatttaaattactgaattattttaacgttataatttacttttgaaaactattacatttttaggtgatgatttatagcatttgtcttccttggatttaagattagggataaaacactggtttcatgatgctattttaccatatttaatttataattatttgccttaaagggcttttatctcccaaatattaacataacaatatatgtgacatgcttttttagcactttaaaaataaatcacttaggacaatgttactcaaagaattttgacttaccgtaaggggtttttttgatgttactctgagggtattagctgtagttttgtatatttttaatgtctggaattttaaaggatacaaaactacagccaatactataaattgtgttgcaattttgcaacacaaatcagagagtatcagaaatgaaattaagcaatgcccattatgttctcagaatttaaatttttccattatttttattgtttcttcagaattatatttgccatgtattgagtttctgaattatgcagtcattttcctggatttcattagcttttctgaaatgcttagtaaattacagtgaaactagcttttagaagcaattactagtgaattcttagccttctttgctcatgcaacaacagtgttccctattaaatatgttaataactactttacctatttataggcacatattttagtgttatcttctgaaataatacttatacctttaagaatggacccatattcacaagtccttttggtgcctttttttggttatccatgatggtaggtaccaaaacattcagttacttagtttttagaaagacttctgggctttgtttgtttgtttttaactatggcaataatctgtgtgcagttaaaattctccatattatagtatagaaagctgaaaataaaagtggcttttaaaatagctaatcatagtctctaaagtaaaaagagttcacagatggtcagtagggtgattggtggtcatcagggacccagcattccataatcctaccctgagttccttcttcaaggccatcttattgtccaagatgctggttcttaggacagtccaccaaaaacttaaacttatatgttattgtctaaaatttacctgaagcaatgtaattttttttggttagttacattattgctacccagaataaaatctgtaaaagaaggggaaaatgggtattcagtggcaatgaacagtttctgccacacttatttaattatttaaataattagaaactgtcagggaactgacagggaactcaaatgaaagtcaaaatttctgaatatcaagtccacctactattaaccaggagtttttctcggttgggttacctaaactttgagtttcagatcatcacctctgacttaattatttctttggtttcattcagttcagaaattcaataatcttatactgcaatttatatttagtctaagacacaaatggtgtttagatttaactgctatcatataggcctctggtatgctcaagacataaattgagaacttcttggagaaatatttgagcacacagagtgccacttgctgtctcactgacaaaaatgtgacactttcaaaagcctgtgggtaagcctcaaagcagaaatatctatttaaaattatacctcctgcctattattgagctgagacactgaatgcttcccttcatctgaaactttagggactatttgcatattagtagcataaatcttaactaatccagcaggagggaaagtatttattttgtactgagaaaactttgtttcaggcggagagaagatattcgagtgatgattgtcatcttttatatgccttgtaactgtgatagatggtcttgagcttcagtgattcataatggcatttggaggcatgcaaaaaaagcagctaattcaaatgaacgagtcagtaaaacatcacagcaaatgtaggtcgcagaaaactgtggaaatctaacagaagggcagtgtgttgccaatgaatatatttgaggacagtaagagaaaactatttctacactcgtcactggctccaaataaaatggtgattttatcttttctactgcagcctcccagtgggacaaccttcctctctccattccttttacctcctaaacctcctctccccacagagccaaacggctttatacttgctccctcttcaacagtcaaatcttcttaacattcagaggaggaaaatgtgacccaaaggagattcatgacaacccaaggggtaggttattggcagtacagagattagaaatccaattttactggatttccaatccactttcaattgcattactgtgttctttaataattcctattaaattgtgcgctttacaaatttaggtgttgcattagtagctaacctgaggccaggatctggactcctcccactgactctttagcaccaccctctgtacatcttgtcctcacaaatgggttttcattgtaaggacaaagaaggcttcacagaatgtgtgagagagacaaatagagggacataggactccccagaaaagaacccacgaaattacaacatatggtgacttcttgtcatgaggataagccagttcaggctttatggatcaattattatttcattctttctttcaaatagcttttgaacacatactatgtaccatcaactatgcaaggtgctgaagattcaagggaaagaaaatcagttcttcccatctttcagtcgtgttagtcttgggaaactgagtagatagatgtgcccctttctgaaatagaaaagactgtatgaggagcaaaaatgcaggacaagagcaagtatctaccagagtgagagataccctagactctcaaccaataactacctcctttgccatgttccttcctgtctttgcattacttaggaagtgaagttccaaacaggatagtttagatgtcaggttgtaatgctaggtcagctcagaaaaccctggaatcaggacctgtcatgtgaaattgatgactgccccagatccctttccatctcaaaacacctttcccattgacctgtcagttacctgagtcacatcattagtggtattgcttctgcaatgtcattgtctactgaaggccttattataataaacatatgtaagttattcagaaaaaaacatttgaacaagttagtctctgttctagtttcctagggctgctgcaacaaagtaccacaaactttgctgcttaaaacaatgcaatttcatatatcatagttctagaagttagaaatctaaaaataaggtgttggcaggtcatgtttcttccaaaacccctagataaggatctttcttccgttttccggttctggtagttgcaagtggttttcagcttgtgacagcataactccagtctctgcctctgatgtcacatggggttcttcccttatgtatcagtaaatattctctttttataaggaccacatgctgcattgtcatgctacatttattgcccattctaatccagtctgatctcatgttaactgattgcatctgcaaagaccctatttccaaatgaaaacataatctacagtaatgggctgtcctagtcagccagcctgccctgacaaaataccatagactgggcagctcataaacagcagaaatttatttctcacagttctagagactgaaagtccaagataagggtaccaacatgattgggttctggtgagagccctctatcaggttgcagactactgacttattgtatcctcacatggcacaaaaatcccatgagacctctctgtgggatcccttttataagagctctaatccccttcacgaaggcccactttcatgacataattacctcccaaaagctccactttgtggggaacatgaaattcagtccataacatgagtgttagagcttcaacttatcttttggagagaaacagtttttatgaagtgtaggggcaggatgagagagaaagagtagggtgaaggcacctagaatgaagtcgatatagcaggctcaagtaaggcgtaacgacagacaatccttgttcaaataggggactatatacatacatcaggcattggagggaagcaccaaaagaataccccagaaaaagtactgagggggataaagaagacaaacttcacctaactcataagtttgcctgagccagaaaataaatgaactttagaagtagagttttgcaatttaaagtaaattaagtcaatgaataatttccttggaaaattgtctttggcccactcacagctcttttatggcttataccagctttttcatgggaaaaattaacgctttagacaagttgaatccataccacttaagttccctttaaataatcaagcaaggttaaaatgaaagtattcatggtaatagaatctgccaccaggggattatagcttactaagaaaactatgactaataccattcattgattaccctttaccttcccaagagtaatatggtaaaattgcagtagggaggatttaaggcagacaataaaaatgttcccagtacaattttttttttccagtattgctgcatcatcttttcttcagtgaggttaaggaattggaaggagattatcagaaagggttgaagtaaaatgataccttacttcattcagtcataaatatttcttgattcacccaatatctttcccaccatgaatattcttattctttgcttctcagcacaaaccgatagttgctttttcaataaatagctcttacagccttgagaacctcacctcataatggtattatagttaaggtccgtgcagcagatccccttcaagacaaggaatcctcttctttgggactctcttagatgagggctaaagtgaccctttaaaatgagaaccctctctggaaaattgcatcaggacagcatgattgaggccttgtttgttgagccgaatatcagataagtaagctatatttatcaagttatctttcccctcatgagcttcattgtacttttgctttcttggctcttgacattctccatgtttcccactctgttcagggatccagctgacagtagcccattttctattgtttgggagcatgtcttgagtttcccaaagtgggaggattgcctccgggctgttattgccatttattgagattgggatgatgctctagttctgacagaacagtcctgatttatgttcagctggtgattcattatgacctagatcattttctaccatatttgttcatattcaatcttccctcattttaaaataaggacaaaatacccaagtgtatttcaggcaacttgtcaggatatcaaaaaaatggtttcctattttctgaaattctggcaaatgatgtcaatagcaccagctagtgccataagtatgtacagtttatctgggagaccaccctggagtaggaaccaggaacccatggaagatattgctaaaaggttctctgaagcagtaaagtggggatggcaaggattttcaagccacataaactgggtttggatcctgcttcttccactcttcacttgggaaagttacataactttccagtcctcagtatcttaatctggaaattgtggtttattaaatctgctgcattgagttgttgttagacagtattcctcaagacatggtcctcaggctgtcaatggcataatcacaggggttgcttgctaaggcagattactagaccccagagctaaagatctgattgataaatctggaatgaggcctagaactctgagatattagcatacatttcagatgattacctgctaagcttagagaactgcagcaaggagacttaagtgtaaactgcttagtacatcgtaggagtacaacaaaatagatctatccctggacagataatcagttccttgaaagcaggttggtgtgtgttcaccgttgtatccccaatagtccaatgccttggcacaaatcagatgttccataaacgttcattgatgtgaatggttagaaatcactagtcagagctgaaagcaaagaccaaagaccaaaatggtcagggaatgtttggttcaagtaaaataggaaacagaagcaagatacaccatcagaaaataagcaagattgcgggctgcagttcagtttttccagatatcagcattagtacagaagagcagccagcaggtgtcagacagagagaagctgttgggaaggcagcaaaaaataagttagagaatataatgaagactgtagtgggaagggaccaggcagggaggcaatgtaaggctctggcaatcaggacaaaagtgtccacaaagtctaaagagagagacaacactaacgaaaacagagaccttgccctgagagtccaaagcagaaagtttgagcacctggatgagtttgggactatgtgagcagattctggtagaaaaatctaggtggtttcaaggatggcactagacaaagtcaaaactaaaaacataacaaaggaaagtggcagaatcactggttctgtgatgaaatcagataaactgagtggaccaataaaatcaaaattttggttctaaatcagtatggagatctcctacagaagtgaacctattaggactgtttcatacactctggtataggcctagagatatataattaatattttataactagagctaacgtggttgttattggaatcataaacagcaattacatccttatgtgcaacatttcctgacaaagatattctttggctacacacacatacttgaagacaaatttagaccaagacgacattatttcaaaaataataatgaattgggcatgtgaaaattaccttacatatttgagaaatacacttgatgtgtgcatatgtaaaactttattcctctttcatttttacattgattacctcagacattatgcagaacagtgtgtagatccattttttgaatcctaacataatatagttttctagggcattatttacacatggttgtgctttccctgtacctgaattatagccttatatcttattatgcatgtgaaatatgtagacagcaattagcccagcaattctgtgtattaattacttgccttttagaaagcaacacgtctgcaatctgcaaagagagccacaaaaggaattctatggcagtacaagcatttgtgtgtttttacagataattccattacatagagtcattcatgaagaataaatggcaagaaaaaataggatttatcagggtaaagccctaagggttgaagaaaacacaggaaaatccaattagaactgcagggagttggttcaatctcttaatcggcactgcagcacagcagattaatattattgcctactatttaaactttattactccatttttctgtctgtggtcctctgttttgccagcccaccttgaaaagatggcaggcagaaccatataatactttttatggccttggcaacagcactgttttgtggtttgaaaggtaagtaccattctagaaatgatgaggtgaggaagcaggcgacactttagcttgttttataagccagagggtaaggctgtttgccctgcatactaatcacaaaaaccatcagcaccagcactttgccagcttctactgactgacagcaaaatttacagcagtcatttttctatagaattatcctcataaagttagaggcatctggagacaacgactacagcaaagactccaaataggtcttggtcttgggttccagttatgacacagacttaccagatgatcttgagcactcaatttttggtgtcatgaacaataagtttattaaaagccagattcttagataagttatacttaaataaacatacattaattttttttttttctaaaaactggggcatatgagtttcctagggctgctgtaacaaattgggttgcttaaacaagagaaatttattctctcaaagttctgaggctaaagtccaatgtaaagttgcttgcagggccatgcacccttttaagcttctaggaaagaatcctttcttgcttcttcatagctttgggtggcttccagtaatctctgctgttccttgatatgtagctgcgtcattccaatctcttcctccattatcacatggacttctctgtgtctctgtgtcggatctgaatgttgctcatgttttttgttttgtttttcattttataaagacatctgtcattagattttggccctcttctaatccagtataatcccatcttaatttcactaatatctgagaagatcctatttacaaataagtttctgagtttccttgcagatataaattttggggggaatctattcaaccagcttcagtgggaaatcacatagccctgtatctttgagtattttgagataagtagctgtgagcattcaaataacttaaatcatgagtgtttctattaatgagttattgcgtgtatatactatacacaatcatgcggtctgtgattttatggtatgttaatttattccacaaacatttattttacctgaaacctcttagatagttatagtaaaagcatgttgtatattattttcctgtttattttgcaaatacttcaactaacaaaataattctagaattaagagtttattttttactttatatagatatttggtaggcaaatgttaatcttggttagaaaagttagaaactaaacgtaagttttccaaacttttatccccaccacaaatcaatgcacactttattttatatagtaaatgggtgttgtatatttcttacaaatcaaatcatctcttatttcacaatcaacatggttctctgagctaatcatttttagaatgaaagattcctaggttaggtttggggtttattttgcattgacacaaaatctcattagattcagctcagtcaatatatctggcaaaataagattcctgtttgggcaagcaaagttttcttttctctgagtttgcagttctcttccagttttcagattcataagacacatgtaaatgtaatctcccttctgcacaccactggctcatttatttcatttgtttctccccaggtgttgattagaccattccagttgctatctgtatctattttacagtatagagttgttcaattgatataaatggaagtgtttgtttgaaaatataacttttttctttctacttctactcttctgaggttgtactttacattttaaagtgtgctactaatatttttttcacattttcaaaatcaatctcactttatctaatttatttccctagatgcttatatgctttgtgccaccagagaggaggtcagacaatctcaactccgtcagggattttatatatctcttctgtaaatcactgaagatacttcaactctcctaacagagttctcacaatgatcagaggagagctgacaacttcattttgttagcccttgtagcacctcccacttcacctcacgcccctaaatatgtgctttatctagctcactctccttttgtgccaaattaccgtgccaattctgctttttatgtttattcttactctgattaatgtctttttggtccttcatgagaagtccctacagggaaagctcaaatctttgtaattttcttggcatgaaagcaagcaaagtatcaaacacgattaagtttctgacaagcttggtcttctccctcggatttcagtacgcctttttcattcatttttctacctcttttactctgtctgttgcttaatattggtattctctagcatttatttccttctcacttttcctttacctaatctcacccactcacctgccttcaactaacacctgcccctggcaactctcaaatcagtgtgtgcagctgaatgtcttttcctgacttctaaatgtgtatcctagatccagaataacaactttgttgacaactgcacttgaatatcttatatgtacctttttaataaatgtttttcaaactttatcgcctgctgctcacagaaataaatgcatatttgcatctcaaatcaccaagtatgtccaaaggccccaaatcaccacatgacttggtgcctacagtagcatgaccaaaatttaccaaatcattaacttccaaattgctcctccttctgcattttctccctgagttaatgagactgtattgtagaaatctgaaagttattttagactcctccctcttgtatttctcatcaagagccacaaagtcctacacattctacttcctaaatgtctctctagtttaacccaaactttccatcctgcttcatgaactattttgtatgataaccctgagagttctgcttatctcttttctatctcatgaatatttagtccatcttctatactggtatataaattatttttcatcactttctgtttgcttatctttctcgttccatagagcaaccactttcagggttctagaaatggccaataaagaatgcttcttctgagttacttacaatccaatagaggaaacataattataaactaattactatatcatacagaaaatgttcttattttgttgagcataagatattcaagtgcagttgtcaaatgttctcaaattgttgagcaatttcaacatctcaaaaaaggaatgacatgggaatcaaaaagaaccacctaacatggcttaaattttctcacttaaaaatggaaatctggccgggcgtgatggctcacgcctgcaatcccagaactttgggaggccgaggcgggtagatcacctgaggtggggagtttaagaccagcctgaccaacacggtgaacccccgtctctaccaaaaacacaaaaattagctgggcatagtgtcaggcacctgtaatcccagctactcgggaggctgaggcaggagaatcgcttgaacccaggaggcagaggttgcagtgagccgagattgtgccattgcacgccagcctgggtgacagagtgagactcggtctcaaaaaaaaaggaaatctatgcactcacctgccatcaccacatccacctttcctgctaggaggtgcatcaagctaaccgaactttttttgcactaggctttcatcttgagatggtcactgaaatacttttccagaatccccaggatttcaataaacaagctttgcataatgctgatgtagtccaacacactcagtttagagataagccaaagaggtcaactgatgggtctaaatttagaagcttgttaggagtttagtccaaaggaaaaccaaagtcttccaaaagacagtccaagtttttatctttatgtggactctttcctttccctcctactcttccctcccaccactagaatggaaaaatacaagtatcttaaatatctcagtaatcccttactttggttgggaagggctacctgtgaagactgagatattagtcacagcataatattctcacgaaatcccaataccaaagtttttaatcttgtttaaaatatcaataaaacatatggccactttcttcagacaaaaatatgcctgaaaccttaaagtttctcagatcccactaaacgcttccagggatctcatgtaaagaatctctgccctaagggcttaatgggcatttactttgtgtggtagaaaaagaaaatttagcaaccggtatctggtccagccagcctgtaacatgaatatccaaagtgatataacatgtcttatactatggctttattcctgtaatattagattattctggccgggcgcggtggctcacgcctgtaatcccagcactttgggaggccgaggcaggcggatcatgaggtcaggagatcaagaccatcctggctaacacagtgaaaccccatctctactaaaaatacaaaaaattctctgggcgtggtggcgggcgcctgtagtcccagctactccggagcctgaggcaggagaatggcgtgagcccgggaggcggagcttgcagtgagcggagattgcgccactgcactccagcctgggggacagagcgagactccgtctcaaaaaaaaaaaaaaattagattattcttgcaagtcagagaaatgctaagggggaggaaaaatattatttataattaagaccatgaagcacctttactatttggagtatttggggggttttgttttggttttgcatcattacaattaaactctagagtagcaaggtttattaaacaagtcaaggaaaaatttctagagcagaaatacccatataacatctagtaaaatagcagaaagatctaattttattaggagttgtgtggtcatgatcacagatttccatagttttctcttttgtactgaaggtgatgttctctttatgaaccaacattgaagctcactaatggccaccaagaccagttatgcctcagatcatcaaaatgtattcaaagagatgattaggaaacatatggctggaagtgcctcatctatgaagaaagcatggaagttctttatgagcacagctatgaaataattatgagtgccaaaaaagtacatggtttctaattgaaggcatatgatagtcctaggagcaagaggtagaccattagctactccccctacccccttacccaccacccctggttatctaggtttgcttttgaccatccatttcttatactgtgccaaaggctggactagcttagtataaagagtgagcctaacaggtcataggttgagagggatttttccagttgttttgggggttgtttgcttggtggcattattgcatttttcttgtacaagtagcataacacggaagtaatgattttaagttctagtctggatatgcctttccatattgctgcaacgttggggaactattgaagactatatataagatgcttttaggctagtttttgtcaagctcagcttttaaaaagactcatgatgcactgaattttattgttacttcctctactttttaagtattttacaacataagaaccaggtgctatatgtctgttaacttaattaaaaagggttatataccatccactaaaatttaaaataacactaaattttttttaaaaatgacttgctgaggtgttcctttgtgaatactctccccattccttgggctgccttattatggccattctatccaaattggcagttcagggaattattcatttctggggttgatgactttttccatttgccccagctacaaaggagtacatgtgttttaatgaagtcatatttaaagacctggatatttattactggtatacaaaaaatgaaagcaagtaggcatacgattgttgacttttagtgattctaatattaaacataattttaggcctggtctagtaaggtttatgtaataggtgagtttttaagagcaatgaggaccaattgcataagctttgcatgaattgataaatggagaagagaaatcattgtacttaacctgccaggttcacatagtcttcaggtataaaacacaaagccatgtttattacctgtacagttagctaattaaacatctacggcaactttaaatattatgaattcattacgttaatccaaattcctgtgaaatataagactgaaaaacaaaagcaatccaagggaatattcacccttgccacatagtggggaaaacatatttaaaattttactgccttttccatttcacacatgagggatctgagactcagaaaggttaaagagaaggccacagaggttgtaaaaaagttacagcaggattcaaacacaattctcttcagtttattcatatcttttttatttttccttagtacccaaatagccatgtcacttagtataactattttgtttttacttcaaattatttcataatttaccaggaaagttatatttttaggtagatgtagttttcataacacaaaaaggccctcataatttatctaatttagaccttttattttacagatgagaaaactgtgatcaaaagaggcaaagaaaatttcctaaagattcataaatgtctggtggcaaatgtgtcacctagatttccaaaaatctttcaaaaatgtttgtgaaatagcattacttaattaattcaagtagatgtatatttcaagtacaaataatgaagaaagaagttaatgttagcatcatctaatatttatttgacttatgaaaatatgtggtgtattaaatagataatttgactaattgcctttaaatttggccactgtatgagcataaataatagaatcaaatctgatattatttgcatattatatatgcttaagtgatttttaatatatagttgtacatattcttaggaaaatttgtgtatttcatactgagacatattgttattcgctcaggattattgtgtttttctctctccattttttttttacattgaaattgtttatcaattggttcttccaaagagaattcttcagttaattatgtaggtatttattaagataattgattcatgaaattaagattaccttttgttcatttgattttggaggagcactgctgttacaaataaacaaccttgttatttgccacttttttccagtgactgctcatgaaagaaattaaaatgatacatcatcagtggatcttcctgtagagtaagatagaacaacttttgcaaatcaaatggcatgcaacttcacataaaagagatttggctcaattatgagttcaatcatagttctgttaacataaatcatttttcttcatccccaaaggcacgtatttgcagaatacctgctaagtggtaggggctacagaaacaaaactacagacatcagtgtattttctgtactgtgcatacaagtgtagagggtcataaaatatcttttagaaaataggttagatatagacgctattcagcactaggtaactatatagttgtcattttaattctatgttaatatgcccctgcaaataaaattccatttgcgctttatctaagttgggtgaaaaaaagttttatttcaaactacagcaataaatgtgcccttccttttcataactcttcttcagagtattccctgcccacaaacaagcatttttatagaaatctagtgacaggacaaaaaagtggtgtttctattctattaggtttctgtgggaaccaagaaatagtacaaatattgatcatgtaagtagactattatatttattataatatagacattgattacttcctggagagtttttaccttgtaaaaactaggctacagtatcatattcccactgaagacagtatggattccatttatttccaaagcatgtcaagagatgccacagtgttgtatttcaaggtacagacttaagtctcaaattgcctgggtttaatttccagctctgctacttcctggctgcgtaaacctggacaaattcttcacttctcagtcttttaacttcttcactgtaaagcagtggtaattacagttttcattatatagaattattaagagaactaaatgcactactatttctaaaggacttataacaagatcaagtatgccaaaagtgaaaaagaaagaacgtgaactttggtgccaggcagaagtagatttgggttatgaatctgtcatttaactagtggtgtgatcttgtgcaagtttttttaaaatgtgcaatctcagtttcctcatatgaaaatgaggactggtagacatcaaacctcactcatataatatacattcatcctcttctctttccgcatctccataaacagtttacaaacattactgcttatgccaacatcaaattatgccctccccaaattaataaaagtgaaatgttagatttgttttcatttacttaatttgactttacttaatttcatttaatttgaacattgtatgctttcatgtctttgtcttaggcaaaattttcttgctaatgaatactaaaaagtaaaagaaaaaaactggcagatatatgtatttgcaggatttgctcaacttccttaaaacatgattagaattttagtgaattaatttaaggaagttttaattcggaataaagcaagaggacataacaaaattccattttactgtaattgcgactatgtgatgttgcttttgaaataatttcttttggtgggaaggtaactgcaatttcttagccttgttttacataagcctcttgctttttattgactgtgtgtggaatctatccacttctgtgtgaatagaatacacttgagcctccagttcttacgtgctgctaatctgacaagaaatatactcatcccaaaatgattaattaaacatctagagaaatccttacattccttctcaaccaaaactatgcttttccccatttcattgtagtcttcagatgcatttttaaagggaaatttcctacaagtgaaggtctcacaggtccatatatggcagtgtggtgaaatgcaataagactctcacactgatacattgagcactcactatatgcagagataggtgccccatgagacctgacccgggagaggaattacaaaattgaaaaagcacaacttgaaactttaaagggtgactcagaagtgagatgaatattttcctaggaaaattttaatcatgaactcttaaacttatttgtgaaaaacatgtaatttcattaaaaattaatgatatacaaattaaaatgagatgtcattttccccaatgaaactattaaagatgaatacaaaatgtataatacccagtgccaagagtaatacaatggtatgtatctaacattcactattattggtgtgtaaactttctgagaaaaaaagttgtaatatttacctatcttaaaatatgaatagattttccttcagtgttttcattatcaacaattaaaaaatgagaataggaaaaaagatttatgcacaaaagtattcaccttggcattatgtgttttagtgaagtatcagcattggtctaatgtacagaaatagagaaatagcctggcatggtgacacaagcctgtagttccagctactgagggggtggaggggaaggcaagaggatcgtttgtgcccaggagtctgaggccagcctgagaaacatagcaagatccttctttttatggataaatatttaaaaaaaatagagaaataaattaaaaaattatagtacatttataagagaaactattatcctctcattacatactatattgtatattgtaaatggctttaatggtgtagggaattgttttcttgttttgttcaaatgataattttgaattttgaatcttgtgactaatttgttagtcctgcaaaggcagtctagtcctcaggcaggaagggggtttgtttgaggaagggctgttactgtccttgtttcaaagttaagctataaactaagttcatcccaaagtgagttctgtctacacccaggaacgaacaaggataccttggaggttagaagcaagagggagtcagttaagtcagatctctttcaccgtcataattttctcagttataatttttagggcagtaataagagaaaaacttcagccgaattaaatttaagaagttaagtgagtaatgaatgatttgcgaatcggagagtcccagaagcacaggaaattcgccgagactccgggtgtgcctgctggtcagaacacatttatagataaaaaaggtaaagtgacctacaggaattggaagcgaggtacagaaacagtgagattggttacagctcagcgttggacttctttgaatgcagtttgaacattcagcagtctatgagtggttaatgtacggtcgctgggattgcccaacactcagctattgttacaggtgcatactactaagctaggttttcaattttgtctgactattaagctagggtactgcttatccacaaggactcaaatacagaagtacgcagtccttctcaggccatatttagtttgcggtttcaatgtggataggatttggtaattcctaattctctgcatagcagcccttttccaaatctgaatgtccctgggctcatgatccctgatctccagggctctcattcctgttcccccagcccagaatcttagcctggcatgttgctcccaagtcacgccagcctagctggtgttgacacgctttcaaaattgcttcccttttcgtattggctctactctgcaaggttcctctcctaggtggttgtttagaggaattattttgcctttctaagtctaggttttctcctctatgaagttacatatcccttaacttatgggatagtgattgctagccatttaaatagtcatctgttctgtgaaaggactgtacatgcaaagcagcccccggaataatgaaggagccaagaaactgtgggagctttcatgcgcgtctgtgtgaagacaccaccaaacaggctttgtgtgagcaacatggctgtttacttcacctgggtgcaggcgggctgagtccgaaaagagagtcaacgatgggaggtagggatggggccgttttataggatttgggtaggcaaaggaaaattacagtcaaaggggggttgttctctggcgggcagagtggggttcacaaggtgctcggtaggggagcttttgagccaggatgagccaggagaaggaatttcacaggacaatgtcatcagtgaaggcaggaacaggccattttcacttcttttgtggtggaatgtcatcagttaaggcaggaactggccatctggatgtgtacgtgcaggtcacaggggatatgatggcttagcttgggctcagaggcctgacaggagccataggctgttggccctctaaaggtttgctaaaaattactgacatgaagcagattgattaataggagaaaacacatacaaatttaacatgtatacatgggacccttcagaatgaagactcaacttcccaaatacttacagaaatgaatataccatcctgaggccacagtaaataatgtaggctcataatgtggccggaaacaggtaaatcaagtttaatggcaagacaggttgaaagagagagaaaggccgaaaacaggtaaattaagtttaatggcaagacagattaagagagaaaggaagattttggctagcaaaagtggccttgtcatgtagatgaagcctccctcagggagaatagatggtaaatgtttcctttcagattttaaatggttccgactctcaaaagagaaaggaacaagcctgcattaatggagattctctacaaatgcaaatttccccaacttcggacagctttgcaagaccacttctgtcaggctggccaagtggcagccatttcaaaatgtgacaaagaaatatattttgggataaaatgctttaatttccttcaaaaccaaagaacaaggtagacaaatctaatttctcagtaaaggatgttttattgaggggacttacagacagaagggtgctctggggtggcagcaagacaggaagatctttgcactgttacttcccagattctgggtttatgtaccttaaggaaagtgtgtatgtgctccagtaaaaaaagttcaaggtgccaggcacagtgactcacgccagtatcccagcactttgggagcctgaggcgggaggagttcgacctgaggttgggagttcgagaccagcctgaccaacatggagaacctcgtctctattaaaaatattaaaaaattagctgggagtggtggcgcatgcctgtaatcccagctactcaggaggctgaggcgggagaatcgcttgaacccgggaggcagaggttgcagtgagctgagatcacgccattgcactccagcttgggcaacaagagcaaaactctgtctcataataataataataataataataataataatataaaaaataaacagttaaaggcaaacctcttgaacagacaagaatgctatatgtgtcatacaatttgtgtgataacatcaaggttgacatattcttacactagggacagtcatcaataaagttgtaatcgggaggcattctggggactgaggttaatcagaagtcaccatggtgtattagcattcaagatggagtcacttttgtctccacagcatcttttttgggtcaaagaattgacttaaagatgtggaaacttcaacagaactagttcactgaaggcatataatttaatggtattattaagtccacaaacgtagatattgccacaaaatattaccatctttgccatttaattctttagtagtgataaaaatgcagtatttattacatactaatttctaacttattttttgttgtgtctattatatgttgacatacagtttctttttcttttattctttatatgggcatttaaactttagttttctatagctctttccattaacctattttaagttccatgtgaatagaagtgttttggcagtgaatctatttgagtctgcagcaacctcaattcttgcttcctcagaagaaagaattcaaccaaggggcataaggcagaatgagaaactgaggcaagttttagagtaggagtgaaagtttattaaaaagttttggaggaggatcaaaaggaagttagggtacacttggaagcagggtacacttggtcaagcaggtgacttgagagatcaagtgcactgtttgacctttgacttggggttttacgtgtcggcatgcttttggagtcttacatcccttctcccctgattcttcccttgggttgggttgtctgcattcacagcatcctgctagcaattgggagggaagcatgtgcagtgtgtttactagagttgtatgcatgttcacttgaggcgttctttccttaccatccagatgttccaagaaggtcatgtaacagttaaactccacgattttgcctcttaatgcacatgcttgagcccacttgcccaactcctgagatcttaccatgaagctgatgagcactagttttaggttttttctatctattgggagactgccttttcttggagctggctgcaagcaattattttagagaaacaatgtaacaactgcctatcacctgatggttgcctgacattcctggtgggagttgggggagccctctcctgctctgttcatgtctgactagctacctagtgaaacaaaagcatatgaaatttagtcattccacactaaatcattcagttatgcttttagcaccaaattaacgtaaaacaaaattatatagtttataacctctattttaaaatatataagaaaatcctctttttccaacattttattttgaattttttgatactccctttgatgcattttttatatatatatcatccttctgagctttgtaaaataaaggaatcaccttttttttttttttttttttttttttttttgtaaataagagtaccaccattctagtgacagccagttttttttagtattaccacagcatcaaaccaacatgtggagcatctgacctgcattctcttaactttgctgctgacttgggctgagaaatcagatttcatatgtccaggagtttgcagttgtctcttccaaatttatttagaaatctactcttgataatgtttaacccaattacacaggagattaaataagaattatctacctccttacccctccttcatatacaccaagtctgtaactcccactcttaccatctctcttctcctgaacttttcctcttggctaagacctcagtcctagagagtaataattaatttcagcaagcctggtgtgaggaaaaaggaacaacagaaagcacataattcttaatacagttgcttgttcacactccagttctactctatatctgtgtgagataatgtgattctagcttagtgatttagcaaaccatttttagtacatgtcatccagtgatttccttttaataccctgggcagacgcatcttacatttagattcctaagacatagaaaaagtaaaacagaggatctgttttaatacaacacccttctcaactggcttgatattattttatctatttatgttgtttgtgattacaaataggacatatagttgcactttccttttaaaaatgtggatttgttaacatattttctgtgttatagatttagtaaaatcataaaaggcttaaatctaaggagactagtgtcttctaaaagagtagaactaagaacagaccaaattcccagtaagtttgaggaacgtgacctaaaaaaggcaagaaatagagttaagctctttaaaactccacaactccaattcccctcacgcttctttattatctctatagcatagtcttctatctgatataaaatatatttgctggcttatttatttactcctgtcttcctccacctaaaatgtaaattccaagtagtcagggagttggactcttattcactgctctttcttcaatacttagattgtgctggcacagagtgggtcctcaataaatatcaataagtcgtgatcaaatgaatgttactagtatgcttttttggaatctataaagatttgaggcctaccatacaatcagttttgataaatatgcctcaggtgcttgaaaagaactgtgttctctataggatacatgtggttcaataccagtatgttactcgaacctattatccaaaaaacatgtaattcaaatgatgaaatccaaattctctatgcctatatatatttttttcctacctagtctgttaaatgctcaaagcattatatgaaattcctataattgtttttccagatgtttcccttttattattaatatttaaaattactgtatttctaagagtcttatgttacatgttttaatgtaacatcagagacatgtaaagattggtgacaactattttcattgtagattgtaactctgatccaaaaaatgtccctctttttaaaaaaatttaagttgttttatattgtctttcttgaattttactttttctagatttaatgctgttcttagtgcttgctttgagtctgtgtttacttgtgaagttttgtccattcattgatttttacatgtctttaatatgttacaatcaatatgtatttggattttgtttcttaaccagtcacaaattcttcaccatttaaaagtagaatttataacagttacatttattgtaactgcactctatttagtcttatttgaacttttgttattttattatttatcactgttggtagtttattttcctagtttttattatatagattctatggcttacttttagtttcccagttagtacacaattttcaaatctgtaaaagtaagtacatctatatacactctgcttctaaatctaaagttcagttcatcaattcattaatctactatttattgagcacctattatatactagaaaatattctaggcagttgagatacatcaacaaaatacacaacacatggaactttgttctagtgagttgctttaaataaattagaaataattatcatataattaatttattgataaagtagaaaattaaataaagtcttttttgcttttctaatttagtgtaaggaatttcaaatactttatcctcacttttattccctgccatcccaatttaaagtcattgtcaaaacaatctatgtgtttagacctgaaagcttacattaatatttatttacagcttacacagattctattccaatattacattttgttttgttcatttgtctatccaaaaactacaatttacttatactgttaattatgtttaacaattttatatcacactaatcctttaatgacaccattttcctatgttaaaattcttgcttttgattcatcattcagtcagctgcaattcaccttcaagtaatatttgcaaaatgaacataactttctgagccaagcatatctgaagttagcattctattgtttttatatgtaaataaatatttggttaggatacatttttttttcttcttgagacagtcttactctgtcacccagctggactgcagtggcatgatctctgctcactgcaacctctgctgtatgagttcaagtgattctcctgcctcagtctcccaagtagctagaattacaggcacccaccataatgtgtggctaatttttgtatttttagtagagttggggtttcaccattttggccaggctggtctcaaactcctgacctcaaatgatctgcctgcttcagcctcccaaagtgttggggttacagttgtgagccaccacgcctggccaggataaaatttttaggttgtaagttgatatcctcccctgaaaactctgtagcaccttttctattgcctccagatattccatgtggcaaagaagtcagttgctaataagacttttaattcctttgtggacaacatttttacctgtatagttgacagtaggatgtgctaaatatcttgatgaatcaaatattttgttccagtaggtatctatgtagatttgcatattttcatactaggccactggaataaggacagttcttttcacctctatactcatttgtttttgttttattttgccttcaaactcaggtaagtgtcatccatgtactttctttttttccttgctaatttgtacttgctaattgcctcctttgcagctgccctaatgtcttcctctggaatgtgtgtctaaactcttaaggttaaatagacatttcttcaatctctactttctgttttttcttttttatttttttttatcatttcttcactattatgaagttcttttttttttgttgtttgtttgagatggagtctccctctgttgccaggctggaatgcagtggcacaatctcagctcactgcaacctctaccttcagggtccaagcaagtctcctgcctcagccttctgagtagctgggactacaggtgcgtgccaccatgcccagctactttttgtatttttagtagagatggggttttaccacgttggcccggatggtctcaatctcttgacctttgatccgcccaccttggcctcccaaagtgctgtgattaaaggcgtgagacaccgcgcccagcctatgaagtacttcttatgtttttttctccctcttacagtttccattttcagttcaggctctaatttatccttatgactttgaacccaatttcatagacagaggatgcaaaatagtatgtctatatttgttttccaattcttgtagtaaatcagttttaaagataagcactcactctcatttgtacagataataagatgatatcaactgtctgtctctctctttctttaattttctatacttaaacaaaaggtcatctacactgattatatgtttgctactcaatggggttggtggaatgtcttggctttcattattgactacctgggagctcattagacatccatttcttacctacagctaaaatgcagaataatatattgcctagttctttctttcttttttctttctttttttttattttttatttttgatagagttttactcttgtcacccaggctggagtgcagtggcgatctcagctcactgcaacctccgcctcccgggttcaagtgattctcctgcctcagcctcccaagtagctgggattacaagcatgcgccaccacactcggctaacttttgtgtttttagtagagatggactttcaccatgttggccaagctggtctcaaactcctgacctcaaatgatcctcccacgtcggcttcccaaaatgctgggattacagacataagccaccgagcctggcctatattgcctaattctaagaacttacatgtatgcatctagcacgcttgtactgtatttctcttggcccctttcatctagaatttatgcaagagaaggtcctgttagtaggggttaaacatttggattcagctattcctaattgcattttagttattacatcatgtaacccaatacatttcttttgttgttgttactcttttttgcttgattcatttttaatgtttccttttgtattaattttttaaatcctggataaaacaatagttattatttcttcatgtgttttagcatggcagaaagaagggtagtcgatataattgtaaatgctaaaaactgagtcagccagagtgtacaccaatcagctatccagccttagatctaagaagagggtttggctcttagacaaattgactgagtaggaccaagaacaagtcaaactcatattttgaccaactgcagggatggaaaccatgctcaaggaaaataaagaaaaagaaaacattaaaagtaaaataatatttttccttttaaaaatattatccagcaaaaacaatggattatcttagtaaaagaaaagcagatctctgaaaatgatacaggaaccccagaatataatttttagaaattgacactctttatagaatgtatactacattaactctgaaacagaggcataaatcagagaaaatagatttaataaaaagacatgaggctgatatttaacaatgggtgtgtataataaggaaggataccaagagaattaaacagtaatgatagattttaaattcacaaaaattgatgctaataaagagtggaatcaatacaatagaaaactgattcattgcatgcaggtcatacttaaaaagttctcttgtaatatagaagaaaaaacaaagttgaaatgaagagaaagaacataatacatatgatattaaacatatagatctaactttagaattttccaaagaaagatataaaattggaatataagtataataaaatgtaatatggaagaattttcttgagttgaaaaattggctcaattatccaaattgaaagagtcctccttataataagcaaggattaaaaagaaatatctacatttagataaatcctgaaaaatttttaaattaccaagaacgctgtcattatacaggccagataggaaaaaagtccgtaagaaaaaacaaaaccaacaataggatatctagaaagtaacaaaaaatcgcacacccagtctctctgcaactgtatttcagaataggatagagcagcatccatagagttttgggagaaaacatcatgacccatggatattacacttaagaaaatttcttttctggaatattcaagggctcagaatatatagcacccctgaattcattttgaaagcaaagtaggggttcaagcacatgttatatgtaagagaatttgtgggtcttttcattctttgtttgattccaactcaggaatccaggtggactgcttcctgtcaggggaattttgcaacccaggggatatacatggctctaccatattcctctgctgtttcttttctgcttccacatttccaccaatttccaaaatctcttccttgtgccacgtcttctactttaccattgagatggcctcttgtaacttacttcatagtcattaagtaagtagtcacttaaaataacaggtgccatcctcatccaaccccttctaacaatgacaaaacttagtttcaagagtttaaaatagctttgaaccctacatttttatttatttccctactagaaaaacagagaagataaagtctctttatactcattttaactgctaggaaattttattataactctctgtaactttttaaaattcttattcataaccggagtcattgtttttttctaatatgaaacaggtagtttatttttgcctgttttatatattttttctttttcaggttttaaattttattgagtgtactgcttttatagtaaatatatacttgattaaaatttttaaaaatagctttcccacagtagagatatggatgcccaattaggtgtgttgaccttggacttctgagccaggattcttagaagccgagttttctagccatcatttagacctgcacttatccaccaattaaaaaaaaaaaaatgagcaccttcctaatacttcgtatatatagaagaacaaaatcaacacagtctttattctcaaggatattacaatcttttgggcacacaggtagtaaattgataaatccctaccccccaacatccaacatatctttttttttttttttctttttgagacggagtctcgttctgtcccccaggctggagtgcagtggcacgatctcggctcactgcaagctccgcctcccgggttcacgccattctcctgcctcaggctcccctcccgagcagctgggactacaggcgcccgccaccacgcctggataattttttgtatttttagtagagacggggtttcaccgtgttagccaggatggtctcgatctcctgacctcgtgatccgcccgccttggcctcccaaagtgctaggattacaggcgtgagccaccgggcccggccccaacgtatctttatcaatgtggatgtgtgccagcagagcacagtagctctgtttcatgaagcacttcttaacttattttctcacagcaaccgagcataacggttttgagcatggactctggagtcagagaatctgggttcaaattaagaccctactactacttaccagcagtgtgattttaatgtgttgataataatactggcctagtagagtgcatcgggattgaatgagtcaacagttgtaaattgtttagactgcttggtacaccataaatcaggggtccccatcccccaggccatggaccgtgccagtccatggcctgttaagaatcaggccgcacaagagaatcgcttgaacctgggaggcagaggttgcagtgagccgagattgcgacactgcactccagcctgggcgacagagtgagactgtctcacaaaaacaaaaacaaaaaatcaggtggcatagcaagaagttagctgcaggcaagcaaatgaagcttcaaatgtatttacagctgctccccattgctcacattactgcctgcgctccatctcctgtcaaatcagtggcagcattagattctcataggaacctgaacccaattatgaagtgtgcatgcaaaggatctaggttgtgtgcttcttatgagaatctgatgcctgatgatctgtcactgtctcccatctctgccagatagaaccatctagttgcaagaaaacaagttgagggttccactgattctacattatggtgaattatataattattatgtattacaatgtggcaataatagaaataaagtgcgtaataaatgcaatgcacttgaatcatcctgaaaccattcccgcccccatccatggaaaaattggcttccacaaaactggtccccagtgccaaaaatgttggcgaccagtgccaaaaatgttggcgaccactgccataaatgatctaacggcgttaaatgaaatccagcatgataaactttataattacttctagaaataaaagattcttgccatagcttaactccctgccttgattttcattgtcatttcaagctttttattttttctatgtcctttttctgaatttgaagcaaagatgaaaaatgatatgttggagttattcagtcagacaccatttttaatcacaagtcttggaaaactgaatagattatctgagcaggcccaagccactggtgtatttaaatgttcacatatagacatttctaatacccaaaaagaaagtatgccctttgcctattgctttgataaccctttgctgtaaggaaggagatcatatttaaattcctcctttcaaacatgtctatcttcccagatccagggctcacaaaatgacttaatgtggcttgttaggctcgtgggtgggcaggctggagactcagtcactatggcaatgacaggtttaaataaacagtgctagtaatataaataagctgccgccacaaagcaacacttttaaaccaaacacagaaccacattttaatgacagtaagcttagaaacttttagttaatattaaattaactaggtctctatgcttcagctttctctttcttacaaaatcttaaaaattcccctatgtaattccttttctattccagtttctttttatacatttctaatatttttttctggaagtcccataaggttggttatattgcagtttctcgtcaattacagtatacataattccttactcttaagaaaagggctgcagaatacttgttacagagagataaaacattttagtagttcttctgacattctatttgaatagtatgtaccctacaaaaacgacaactatcctgagtatacacaatcaacacatgttgacacatttattccttacaacttgttgagatggtgcctcatgctacagagaacactgtttcacagaagtcaaagagctcaccccaaattcataccacttttgggtgacagaactctcatttggactcagatattctgactttttttaggtccagggcctctgacacttccatcattatagggaaagaaaaaaagctgaatttgctttacttctgattcatttttgtgtttcatctctaagaatacataattcataactgacagtagactcttttctttcctaataaaataaatgtggatttctttatatttcagtgtgctttttaattcagctaatggctaaagaagggaaaagaagtaatagttccaataaagctatttttatttattaaaaagtttatgttcttagtcatatgttctagattctgaaagaagaaagtattcatttaagaacagataaacaagttataaccttcctgtttaatttgtgggaagtttaaaaaggtcaaatatgatgcacaaaattttctgcatgatgcttgttatctactaagatgaaattttaatttgggaaaacagtaattaagaatctttcctctctttactacaaacactgcattttcttattgttgagagttatatatgctcactgagatggaaataccatacagaacaatgtttttcaaataaatgtcttttaattattactttattgaagaaaatgccctttaatactaagtacaagagaagaattgaaataaaaggaaacagtgtaggtaaaataatttttaaaaggagatgattaaaattgactattactacaaacaattgaggttggggaaatttaaaaaggggaagtcatggatgtgtaaaataggtatattgagtcttttaaaaggcaaatttaaagtgttgctagtttctgaccagatattaggacaagaggtgacagagagacccccattaaaatgcttggtgagcactccagaggccgcctttgagttaatcggtaatttttcacagacgacatctaatctgtgagtataaattactttgcactcttattattccttaattgaagtgcaccaatgtgaaattgccatagatgtcgcaggaatgattctagcctcaattaacttgggtggaattgaagcccttttttcccttaactgggattattgtctgacatcttgtatttatttaaattgttgctagaaattagagggagactgtgtgtgactaggtgttttataaggatgttctggagccaaaagagcatctgtgcaatctatttctattttaatctgtacccattgtatgctgctgttttgtgtaatagatgtactgctagcagtagcttaacctccctagattccatttgggaagtggagattaatagcactcatattttttttaaaagtggcatttacagtctttgtaatttttagttcaaaaggcaatcaccctattaattttttaaactaagtctcctacatagctatttttgtttaatatataaaacatgatttaggctttctttctagattgtggggaagggcaacatgagtgaactctactgtgtatcctactttacccatcctaaaaactattggaaaaatattttaccgatagctatttaacattaataagtaactgaattcaaatatcttcttctgttttttcctaatgagtatcatttgggaaaatattcttggtttgttggttttcacctggaattaaaaaccatgaagaaaataaacccggtgtctaattacacagtaaccaaatagatacatgtaaaattatctctacaaagactataacatgctgataaaattactcccaattctcaacattactaataaatattattgatatcatagattatatataactggaggtgttttctaaaagtaaattttatgaggtctctgtaataacaaattgatcaatttgcttcaaatattctgcccacttactttacacattcttaagacctataaccagccttgaatgttgtctctgaaagtctcctattagatggaaaggttacctaatatggcaacctaataacatattgtggaagttaattggcattacctggagactgacatcaaaggtgattttctctagcttcgatagaattgtacccattgtcaatttgattcaatgtacgtttattgagtttctattatgtgacaagccctagggagacacattacatgatcctttttcattcaatataatttagcataagttcatttaacagattatttagctagtctcaaacaaatattctaggaatgagaattgtagtactgtttccagacgtcactggatacttgctgaggctagaagaaagcagaaagacttaaaagaaatttagaaatggcaagattcccactacatttttacttacctattttgagtcagtcaaattcaatgaaaatcattaatttttcagtatattggttgctctgtatatgatcttatctttaaagccaactgtttattattccaaaaccagctttctatacacatgcaagatttttgagaagaatagacaaggccattattcttgaggaaaaacttactaggatgaccctaattccatttttttaaaaatagagacaggttctcactctgtcacttaggctggaatgcgtggcctgatcacagctcactgcaaactcaaactcttgggcttaagtgatcctccggcttcagcctcccaaggagctaggattacaggtgtatgccaccacacctgattaatttttcaattttttatggaaatgaagtctcactatgttgcccagactagtctcaaactcctggcctcaagtgatcctcctgcttcagcctcccaaagcgttgtgattacaggtgtgagccactgtttttagctcctaattccatttttaataaagctatttttttttttgaagcttagaggaaatacactcatgaatgaatggatggttaaatggtttgcactgggggaaaattggtcttgataatctgctgatggtcacattgatggattggatcagcagaaaccaaagaaagcatagctggttcactctaggaatttgacaagtaaattaaactaatccaacctaaacacccattgatctcattgatccttagcctcattatgctatggtccatgtagacatacagagcaaaacaattcctaagaaccaatagcatagagcctatataattggagtatctccaaatcttaaggttgatacatcttaagcattctctaaattactatggctcatttctacctatcttaggaaagactgtgcatgcctcttcacaatgccaataacatttttgaggtattattattttttggtgttacttggagatcaatatcaaaggttcttcctcagttttgacagaactgtgtccattttcagttgaagtcaatgtacagtcgttgaatgactattatgtgtcaggttctgaagatacgtatcatctggaagctgtacaactagtccctgacctcaacaggctcaccagtcattgagcttccatttaacacaggttcttcattattatctggctgaaggtagtgtggatggctgtgaaagataaacctacctacgtttttctgttaagagtctgtctctcaaaactcttccgaagagccttttaacaggtctttcttcttcctgctgtctctcactctacctctacaccgtattcagacttctcatctaaatgattttgtcagttcagccagaagtctgtccaatcctttaactttacttacagttatctatagcctcttggtagttgacaactgtcagctggaccaacttgcattcattattcactcatcaagcaacccagcctagagatgagataaagagcccaagccaacaaacagtccattaaagctatctcaggaaaccaaaaacagccatctcagctggaaaccaccctggctgtgaaagaccagacgttttcaggctccacagtgatggctactgctctgctttgctccaatgtctgaccttatctgaacaagaactgaaagggtctgtaaatctgcctgaaagtttgcagatgtgtgatgtatattaattaggttcttgaaaaagataataatccataggacatgtttttagcctgtgtctgtattcaaaaaataagcagaccaggcatgactaattcattcatattggctgttagcaattgacatggatcactgcacaatcagtttagctttggcactgataggcaccagatttctagctccaacttcagatttgcaagtggaactcagctagatgatagaaaagtaaagggacatgtagagaggattacagtgctcagaccccattttcacttgggagaaatgatagccagattcactttttttttattctataaatttgtacatatggcatactgtgtgtagagattggcaggagatatatggatgatttcttttctttcccctcaaccttctcaaatgtttatcttctaatagggaacagagtcaggcaaatagacagttgtttataaagaatatccaccattaatatgcatagtcaccaattcagcatttattgagcacataatatgtgtagaaagtgtgctagggatgcattgcataataaagagcactaaatatggactgtataggctgggcacggtggctcacgcctgtaatcccagcactttgggaggccgaggcaggcggatcacctgaggctgggagtttgagaccagactggccaaaacagggaaaccccatctctactaaaaatataaaaaattagctgggtgtggtggcacgtgcctttagtcccagctactcaggaggctgagacacgagaatcgcttgaacttaggaggcagaggttgcagtgggccgagatcgtgccactgcactgtagcctgggcaacggagtgaaactctgcctcaaaaaaataaaaataaaagactgtatgttggagctacagctctataataaagaactctaaataaagactatatagtataggaaatcaaaacaaaagtgggcattataatccaatatacaattttcatattcgagttttttaatactacttccatcctgtcatcctctccactcctgcttctctgcttcctactctgtggcttccccacatccaggaaatctgcgatgctgctatatttaattaaaagtttcagatgagatttgttaggaaccttagaggggatgtagcaattccattagtgcccatatatttgtctcttaatggtacagccttagactctgaataaaatgatgcacatcttgagtcctattttgtagatattaaaaacataccttttataggtccttcccttcccccatcttttctatgatgtcactgcttcatttatgtatagccataagctgagaactgcatttattcctacattttcattttcacatgactgctctaattcacaagttacttatttcccatgcctctctacacttggtgccttctgtggtacctgtcacatgctgccgataaattttcttttgaactgaactataagatatgttatgaacgtaattaagagagttttttctccctcttagaaccatatagtactaaacaggagatgcaaagaatggagctcacagggcaaagatccaatgtcagtctcttcacattgcatgataagtgaatatggtcctttcttgaaataaggctagacagttctgtccccaggagctctgacagaacactttctttgagatgagtgctcatatcaactgaagctagttcacatttcctttaaaattaatgtaaagttgaatgagtactttatccacttacctactttgtaaaaagtgagtcctattctacttaaatgaaagctaaagaaaccacaagtcattagcctggaaatacttttgatgaaagaccaattttctattgagttatgtttaaaaccaggggagttttctctcactttccttttttgcttagttatttttctcttctttgattgtgcctttgtattataagaaggaggctgctgtgtttcattgtcacaaatgggtcatgcatttgttccaatgtgtgacctctggaaaggagaagattatattatcaaggaatagaaggttgtagcttggatgatttgttaaggaagaaaaagttaagtgttcagcagagagatactgagaagagtaggaaatcttttaggttgttacagcagaggaatattttgttcaaaaaaaagatcatacataaagccacacttcattattaaaatattaagtgcacacttttttttcaggacaaagcccttaagtattactctgtcattaactcactagggaacctaaactcttatcttctaatcagggctattatatcaattaaacgaaacatgatatgcaagtacttagccaagtgcctagcacagagtaatggtctcaataaattctggtgatacaacataggattagtcaccattattattaattgctatatgatagaatgggcattactaaaatataattagttcatattctggaaagatcagacaaatatatgtattcaaatgagttttttatttgaattgtatttatttgatttcagttaagggggtttatttgtttctggggaaagcattgcaaaagacaaaattattgcttgaagagcgagcatctgttgcagaggaactttaagatggcaaaggaaacacaactagaaggacgttggcatcactgaaagcctagaggaagactctgaggtctggaaaaggaagaaacaaaagcctgcactgcctgagtcaaagagacagaggaaaaaagaagggagaaggaggtcatattagtgaagcagagttggtgctgggccttgaagctgagtttgagaagttaacattctttacttctgatcataaacaatttaaaaactatggcccatctcgggggaaagaagcagctgtgacccagaatatatagataatcaaatattgatcaccctttctacccttagagccttgcttgttcctttgagtgaggtttctctgggcagaatctgacatgctatttttaataagaaaaagccttttttgttttgttttgttttactgttgagcacaatatgactacaccagcttagcctaatagggaatcaaggtttcctctgattgtcaaacgtgcacctataactggtgctgatcattttttatcagtcagtgcatcacatgtgctctggtggaatccatcttccatcacagcaagatcaatcaactctaattttaaaaaccaaaaggaaactatgtacaaaaataggaaaatgctatatttataactgtaaaatattcacagaaatggttaatacaaaatgaacatttttcaaataatgtttatttattattggattttcagttcacaatgtatcatgagtaatgatgtaagaaaattctttgtaagaaatggttggatagccttccttaatatttaggaaaaaaagtctaagcctgtttacgttcaaatctaaagctgaacacctggccagagcttgttgtagaccttttggtgagctgccgctaattcataaagtaactttgtgcaaattagaaaaacatacctcctggaggcagactgtcttgtgccattacaatctcctcaaccaggaggtagccctgttacatgggctaccttatggcacctgggcaaagctggacaattgcaatataccagcaggcctttcctcttagataagcttggaaaaaaagttagcttgttgcatgatgatatttcttttggcatggataacaggtaaaaaccctaaagagcacattattttctgtagaatttataacattgattttgttacaattaactttatttaaataaattgcaaattaagctactataatttggctctgatcaacaaatatccatctacattatgtatttatacacttacataaaagttggagactagttccatgcaacacagacaaaaaaagaattagattgctttgcctgaagagtaaagaaagtattttctttgaatatcctgccagaggaacctgccagatgttttccatcttttctgagtgcagaaaaaaaagaaaactggcttaagctacgtagatatttcagctctggaaaaagtttcctgacaaagagaataataaaattagtttataacaaaacctttttttctcaaggtagatagaattttaaaggcaagaataagcattttattggcccacattttaaaacccagtttttcctttcctttagaaatataaggataatttctagataaaatcagcatttttaactgtaagaaaaattaataaaggtatataaaacaggcctcacatattcatttcttatcataaagaaacggatttttgcctggaaaaatacccctacttgtctaaaatagttaagtgtggataaaatgtagtctggaggaaagggcaacagagtaggtagtttcaattactagatttttgccatcatgtttctataacaaaaaacaccattacataaaaatagtagattagtaaagcgaaaaggagaggaaatgtataaaattcatattataacaaaatattgttatctagaaatagtttactagtaaagcaaaaaagaaagggaacatacacaatatagtgagttgtttgagtaaagaaatccacaacctatttttttttccttgactagcactggactagaaaacagaaaaactagggtcctaaccagctatgtgatatcaggcaatttacattccctctctgatcctcagttttctcatttgaaaaattatatggtcacactagttactgaaggctcttccagccctaatatttttgttggaattctttacattctttatctttaagacatcagagttctcaaattttaggatacatcaaaatcacctgggaatttgataagacagcagattccaccccagagattctaagcccctctccagaaactctgattcagtacataggctccaaagcatcattttccacatactgtctccacggtgagattgcaggaaggtgcaaaagagagaacaggagacatgtcttattaaaactataaattgagtaactagcagagtgtctggcaaagaatagatggccaacaaatgttgatttaatgaactatttttcattaaaagattcctttatgttcatgatattaatggattttcatcattatctgattctctaagagaacgagggcttatttctaacagagggaaaatagtctaggttgctcagtagctacaaattgatgtagaagtgctttgtaaaattagcaaatgttttaaaattatttctttttttcaacatagctcccctccaatcttcaatgtaaaagaaaaaaaaatgaattctgtacttgtatactttttgtaagtggcataataacaatatgctctttttattctgaaaaaggactcactctttacagtaaagtgctggaaaatcaagccatcacttcaacccacagcatctgtctcttgcaccatctctgccaaatgtcacccttcctctcgggtttgattgtgctactgtatctgggagagtatgcctcactgcatagcttgtaatatcagtctctgtgccttccggtctcagattccctctcatttcacctcatgtatattaatacagagattagtttcactttttttcttgaatagctaatcacttggcagccaacatccaactgtggcattacaggtcaaatcagctgaaaaggacagtgacttcaagcaggaaaatataatgcttagtgaaaactgcacccagaacaggacctcagacttgtcacccggacatgaaagatttattttcaattacaaatctgagcttaatgtgagggcaccctgggggagattcagatcactgcctcttctaaattgaccttctacttgttttaatatttccttctctgctgaacagcattccatgaccctctgagctgaagatccatattagctgctgtagtaattccaaccctaggaaaacttttgaaaaatttctctaactgaaggccaagttacatgaataattttctccttggtgagccttcactggctaacacagcaatagattgggggcttcagacagtacctccagaggattgcggaagccaatatcaccatgttgcttaaatttgagtggaatccaaaagccaaaaattattccaattttcaatattaggtggattaattgtaaacagctaactcagaactatcatatatccccttggcgttggtaaacaagattccttgaggctagctgctgatactgctacactggctgctggaatcaggagtttgcctcaggatatttcagttccttgttttagtgcatttatgcgcacttaccagatgcaccaaaatacataccatatggccctaatatagggttcgcaaacttgtctcttaaaaagtactgattgtgatttcttaggaaaagtcctttttaatttttttttttttttttttttttttgtaatttaaagtttgggatagtgagaaacttgaattatctttcaagttttatcagagacctgattattgaaaagtagcttagtgtaattttctttcttctatagctttcattgcatctaacttgagacttttctctctacctgtgtttctagatcatttgttgtagaatacttacaccattcttggttgtcacctttgagtctaattattatgcccataatcatggataattgtgttagatgaaaataaacatattaccttcacttagttaatcttatcgatatttaggttttccatagtgattttatctacgtaatgtcaggaatggtagatacaatctaccattgtgtctaccaatacaaaaaaaattgggtccagtttttcctttcctttagaaatataaggataaaatctagataaaatcagcatttttaactgcaagaaaaatcaataaagttatataaaacaggcctcacatattcatttctagtttttgtaaacacagtgtagtctaactatatttgtatttaggctatgcataaaaagaaatcattaactaattctcccttgttatatatattttaactactttttttccagaatcaaaggtgcttagaaatagccacctttaacttcataagtatttatgatacacctactatatgtgtggcactttgccagatatagggatggtgttaaacaaatttccaactcagtgttggtacacagctacaaatgaacgtctagattaaactgggtgtttagaggaaggtaggatagctatgtttgaagtactcccaaaaaacgtttaagcgaaaccttagagacagaaggagttgaccatttaaataagtcaaagattgggaggccgaggtgggcggaccacaaggtcaggagatcgagaccatgctggctaacacggtgaagccccatctctactaaaaatacaaaaaattagccgggcgtggtggcgggcaccttgtagtcccagttactcaggaggctgaggcaggagaaggccatgaacctgggaggcggagcttgcagtgagccgagatcgtgccactgcactccagcctaggcgatagagcaagactctgtctcaaaaaaaaaaaaaaaaaaaaagcgcaagtcaaagagcagtggtactttgcagagaggaatctgtgaatgagagtgacagtgataaaatcagccaaactccttctgactgcaaagactagaatattttgatcaattttgagatttaaagagaatatttaggttattatagaactaagtctttttctctttctttcttttcttctatttatttatttatttatttatttatttatttatttttgagatagggtctcactctgtcgcccaggccggagtgcaatagtgtgatctcggcttagtgcaacctctgattcctgggctcaaatgatccccccatttcagcctcctaagtagctggaactacaatcatgtaccgccatgcccagctaatttttgcagtttttatatagacgatgttttgccatgttacccaggctggtctcaaactcctgggctcaagtgatccgcccacctcgccctccccaagtgttgagattacaggcgtgagccactgctcctggccttcttcaacagaaaatttttattaaaaaattataaaggaagttttaaatgtattgagcatagtgtatgttaatgttctcccattcccagagtatcgtgataagtcaaaggccaagttcattaagttacatgctccatcaggcaagagagtatagtaatagaagtcctatcaggaagttcattcatttgttatttatttattatttcatgaaatatttattccatggaaattaagctaggtgtcaggaacacaaagatatactctgtttattcaggggacataggccaatacacccagtgacaacttgtcaagagcgccaatggaagtaaatccagagattggttgcttaatcatcttctctacatctctccaaaatgctgtcccacttctcagacaatatttgaaatgttcaaagaaagctgattccttgccctgctcattatctttattttttctagtgacataatctacataactcatattaccatgctgtttccataatctatgaaatttaagccattaataatattttttagctaggatgaattatagacatgagtgctttcaatttttatttggtgtgtgcatgtgtgtttgtgtgtgtgtggcggtgtgttggtacttctatgtgcaacgtatgtgagattatttagtactgttctagattgtggttttaccccattttatgcctcttttttggaaatgaaatacccctatactccaaaacttaggaataagcttcagtttctgtttcctgtaattactagaatttttaaataattttcatatgcaaaagtcaattcaagatggattaaagacttaaatgtaaaacccaaaactgtagaaaccctagaagaaaacctaggtaatacgattcaggacataggcacaggcaaagatttcatgacgaagacaccaaaagcaattactaaaaaagcgaaaattgacaaatgggatctaattaaactaaagagattctgcacagtaaagaaattatcaacagagaaaacagacaatctatcaaatggaagaaaatgtttggaatctatccatctgacaaaggtctaatatccaacatctctaaggaacttaaaccaatttataagaaaaaactacctcattaaaaagtaggcaaaagacatgaacaggcacttctcaaaagaagacataaatgcagccaacaaacatatataaaaaagctcatcatcactggtcattagagaaatgcaaatcaaaatcgcaatgagataccatctcacatcagtcagaatggctattattaaaaagtcaaaaaacaacagaggctggtgaggttgtgaagaaaaaagaatgcttttacactgtcgatgggagtgtaaattagtttaataattgtgaaagagaatgtggcaattcctcaaaaacctagaggcagaaataccatgtgacccaacaatcccattactgggtatatatccaaaggaatattaattgtcctattataaaggtacatgcacacatatgttccttgcagcactattcgcaaatagcaaagacatgaaatcaaccaaagtgcccatcaaagatagactggataaagaaaatgggggtacatataggccatggaatactatgcagccaataaaaggaatgagttatgtcctttgcaggacaggatggatctgggagccattaccctcaacaactaatgcgtttgtttggtttcctgtgtcaaatacatgttgtattaatcagagttgtctagagggacagaactagtggaatatatatatatatatatttattcagcttctgtttcctgtaattactagaatttttaaataattttcatatgcaaaaatcaaaacgcatgtgtgatggttaatactgagtgtcaacttgattggattgaaggatacaaagtattgatcctgggatgatctgcgcagcaactttatatctccttatatatatatatatataaagttcgaaaaatagtaatttttataattaccttttgtaattttaattcacattcattaaattttttgtaaatttaattaatttgataattactaaatatttaggaattatatatgagaagaccattcaaaaattttaactagacaaataaaggaaagccaaagtcccctaactactagttagaggtttcttgtaaaattgctgtatttattgtgccaaagaaaagatgtgttcaaaggtaatgggtacatgtcaaaatgacataggaaccagctttgaggggctcccattagccatatgtgggacaattgtagcatcaaaatatggcagtaaaagattataaccactgaaataaaataagaacccacgagtccataatggtataaacaaatgaataagtgaataaaagttgaaaagaagaaaaagcttttttaacagccaattccaactaataataaaacaaatgataacattaaattttcttaaagatcatcaacagacgttaagattagtgtgtaaaagtgatgaaaaagaaaatgttcatagtttcaatgtatctatatactttatacttaccccatgcaaagggaaaatagtaactttctaatggagtaatggcaaaattaccaccctaaccaaacggtcaatgggcaaagcaacatcatgtgcctcctgttgcagtgcatggagatgatacaacatttcttcactaatcttttaccagaaatctgtaacctgaatataattatgaagaaacatcagataaaccctaattgagagacattatatgcaataacagacctatattcctcaaaaaatgtcaaagtcaagaaaaataaagaccaacgaactgttcaaagttaaaaggactaaatagaaaactaaattcaacatgtgagttcaggtttgataggagagggagagaaaagaaagggaagggaggaaaaggaaggaaggagagggtggaagaggggagagtaaaaggtattatgttgaagatatggttgaagtttagacagtagctctttccaccattttttaaatgtttctgtaatactgaaagtattgaaaagttttaaaatcactaaatcagtcagaatagcttttaattgagaagattataatattatcagcatgtaataaataccaggttttcctagtcattcattagggggacatttatcctctcaaaaaatcttaagatattagaaataaaatatggaaaataatctagtctagccaacattcttgctaaattatcttgtcatttttatacattacccagaccttatcttatatatttctctttttattatttgtgtctgtctcagggatcagctagtgtggaattaaagaccatagcatccctctttcccactcagacccagctattttcagttaatccttgctacctcttttatgatgatcagatttctcacacatcacctctctctcttgctctctctctctccctcattctccctcaccctcacactttttttggaggagatggctttttttttctactctcttttttcgatagcctaagaattacatcaattatgtgtattagcaattaaaaaaaatctattctaaagtaatgaattgccagcaaatcaagacacaatgtcctctatttcatcatcatcatagtattttggcttacaaaactgtttttattacaatacaattaaatgtttggtttcaattctaagaaactacctacagtgaatacaaacatgtttcttacccttagtagaattccttttttttttaattatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtaatattccccttcctgtgtccatgtgatctcattcttcaattcccacctatgagtgagaatatacggtgtttggttttttgttcttgtgatagtttactgagaatgatgatttccaatttcatccatgtccctacaaaggacaagaactcatcatcttttatggctgcatagtattccatggtgtatatgtgccacattttcttaatccagtctatcattgttggacattggggttggttccaagtttttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgacgatgagcattttttcatgtgttttttggctgcataaatgtcttcttttgagaagtgtctgttcatgaccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgtgtgcagaagctctttagtttaattagatcccatttgtcaattttggcttttgttgccattgcttttggtgttttggacatgaagtccttgcccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggtgttatttcttagggctctgttctgttccattgatctatatctctgttttggtaccagtaccatgctgttttcgttactgtagccttgtagtacagtttgaagtcaggtagtgtgatgcctccagctttgttcttttggcttaggattgccttggcgatgcaggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctcttggaagcaattgtgaatgggagttcactcatgatttggctctctgtttgtctgtttttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactattgaataggagtggtgagagagggcatccctgtcttgtgccagttttcaaagggaatgcttccagtttttgcccattcagtatgatattggctgtggggttgtcatagatagctcttattattttgaaatacgtcccatcaatacctaatttattgagagtttttagcgtgaagcgttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttggttgtgtctctgcctggctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaccagctcctggattcattaatttgttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatgtctgttcttttacatttgctgaggagagctttacttccaagtatgtggtcaattttggaataggtgtggtgtggtgctgaaaaaaatgtatattctgttgatttgggagggagttctgtagatatctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttatattgagcctatgtgtgtctctgcacgtgagatgggattcctgaatacagcacactgatgggtcttgactctttatccaatttgccagtctgtgtcttttaattggagcatttagcccatttacatttaaagttaatattgttatgtgtgaatttgatcctgtcattatgatgttagctggtgattttgcttgttagttgacgcagtttcttcctagtcttgatggtctttacattttggcttgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaagtcttttttttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttctagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgcagctcagagtaatttgatcgtctgaagccttctcccctcagctcgtcaaagtcattctccgtccagctttgttccgttgctggtgaggagctgcgttcctttggaggaggagaggcgctctgatttttagagtttccagtttttctgttctgtttgttccccatctttgtggttttatctacttttggtctttgatgatggtgatgtacagatgggtttttggtgtggatgtcctttctgtttgttagttttccttctaacagagaggaccctcagctgcaggtctgttggaataccctgctgtgtgaggtgtcagtgtgcccctgctggggggtgcctcccatttaggctgctcgggggtcaggggtcagggacccacttgaggcagtctgcccgttctcagatctccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacctagttcgagcttcccagctgctttgtttacctaagcaagcctgggcaatggcgggcgccactcccccagcctcgctgccgccttgcagtttgatctcagactgctgtgctagcaatcagtgagactccgtgggcgtaggaccctccgagccaggtgcgggatgtaatcttgtggtgcgccgttttttaagccggtccgaaaagcacaatattcggatgggagtgacccgattttccaggtgcgtccgtcacccctttctttgactcggaaagggaactccctgacgccttgcgcttcccaagtgaggcaatgcctcgccctgtttcggctcgcacacggtgcgcgcacccactgacctgcgcccactgtctggcactccctagtgagatgaacccggtacctcagatggaaatgcagaaatcacccgtcttctgcatcactcatgctgggagctgtagaccggagctgttcctatccggccatcttttttccgaattccttaaatttgtttattgtataacaaaatactcttactctacctaaaactaagaaggctatatatatatatatatatgtatatatatatatatatagccaaagtatttttatacaacatctatatatatatgttgtcctcttagttttaggtaaagagtattttgttataatatatatatacgtatatatgtatatatgtgtatatatgtatatatgtatatatgtgtatatatgtatatatgtgtatgtgtatatatgtgtataagtatatatatgtatatatgtatatatatattgccctcagtgcatatatatgtgtgtgtgtgtatatatatatatattttttttttctttccaacttttattttaggtgcagtggctatatgtgcaggtttgttacatgggtaaattgcatgtcaagggggtttaatgtacagattattttgtgagcaaggtaatgaacatagtatctgatagttttttcaatcttcaccctccccctagcctccaccctgaagtaggccctggtgtctatagttcccttctttgtgtccatgtgtattcaatatttaacctccacttacaggtgagaagatgcagtattctgttttctgctcttgtgttaatttgcgtaggataatggcttcaagctccatccacgttgctgcaaaagtcatgattttgttcttttttatggctgcatatatttccacagtgcatatgtacgacattttctttatccaatccaccactgatgggtatctatgttgattccatgtctttgctattgtgaatagtgctgcaatgaacatacatgtgtatgtgtcttcatggcaaaactatttatattcctttgagtatatacccggtagtgggattgctaggtcaaacggtatttctattttaagttcttcaagaaatctctaaactgctttctacagtagctgaactaatatcattccacaagtagtgtataagcattccttgtgattcacaaccttgccagcatgttattttttgaacatatgtattttgagatgctttgccaactcttttccatggaatagtttaaaaatgtggtaaatttaaccctattttgtatattataaatatttaactttttgtaatttttaaaaacttttttcttttaattcttcttgacttcatttttttcagtaaaaatggataagtggtttattctacttaatgaaataggtgacaataaagaaaacgtcaaatttgttagttgattatagccacagtatttttatacaacatatattaagccccctgcatactaaaaacattatctcttctaataatgataattttatggggtgggtactattactgatattgtctattaggaaaccaaaactcagagggactaactaattgacacagtaatttgctcacaaacctgtgttagtctgtttgtgtcgctataaaggaatacgtaaggctggataatttataaagcaaaaagatttatttggctcatggttctgcagttctgtacaagaaacatcacagcagcatctacttctggtgagagcctctggcttccactcatggtgggaggcaaagaggaaccattgtgtcatatgaggagtggaacaagccattcatgaaggatctgcttccatgacccaaactcctcctaataggccccacctcctacactggggatcaattttcaacctgagattgggaggaaacagatatccaaactatactaacatcctggttatcctaagactggctgtctttttaccacactaaatgttgggggaatctcaagagtctctcaaactttaggaccttggcctgtattctagaccagtattctgggatagcctactgggccacatgtcctcttatctcatctcggataagccccacccaggattgtcctattttcctctcttcaaaactaatgctacccacactgcatcttagagtactttccctcaagattggctgctgagagggatttttcctaagttctcacttcattgctgccatctaagaaagacacatagacctctttcatttgaaaagtttaattattagtcttcatgtgttaatagaaaattataacattaatgctgtcctttattcagcaaacatgtatataatgactatctggggacaattacagtggatagagcttctagtccagaaaaaaatggaatatgaattacataaatagtacattacaaagcacacacacacatagtttacaatgggaacacttaagagagataaaaataaatattgaacagttagaaaattgcaaaatttgtatagtttttattgttcctgaagctacatagtataattctgaagtatatagttcctgaggacctttcttatatgatagacattgtcgtttcttcaatgtcatgcttcgaagtgcactatgtctttaaatcacaagacatattcccgcacaatcaaagcaattagaaatgaagaatatgatttcctttgattcaaaaggccttttagaagagatattcttcttttttcacttctttgtgaaagcagttattcaaactgcacaggaacttcgtgaactttgaataccaggtttgttgtccagatgcatatagacaggaagtacacaatagcctaaatcagggagtgctggataaacttttcttaagatgcaggcccagaaaacgctaacagccttaaattgtggtgaagaatatgtggttggtgatggggactggagctgggggttactttctccctagtatcttggggcattcttgaaatgggaatggtattcatgattcagagctaagtaaattagggcccttttttctaaccattacaacctaaattgggaagaaatttggttaaaataaatacttcggtcttatttgggggaaagagttacaagatgttaacattgagtgtaacatagaaggaacaatctcacctctttaccttgtagatggtgaaagtttggaatttggaaactgcaaaccaaagaaatagctataggtgttttctttccaggcatctatttacagtcatcttcttctttcccactgtactcccccgtgtccagctgtcggtaatcagaagccatgaccagcaacacagtgtgttatttctgagacaagtcattaaagagcaaattgtcttagaacaaattgataaatagattcaccaaaacataaaattttggaaataccatcaagttgtttgatgttaagatattaacctcatttcagagccaggtttttttttttccaaaggatacacataaaaaggaaaatatttttactttatccttcattgctttctaagaagaatttagacagtaaccttcaagggaacccaatagcaaggaagccagctatatatggtgaataattaaatgctgtgtgtgtgtgctttaccctcacacagaacacaagttgtccaatttggagaatttttttattattatagtaaaaaaatttaacattaaatttatcattattaccatttttacatatactgttcagtaactgtattaatatattaagtatattcacattgtttagcaacagatctctagaactttttcatacaacactgaaactctatactcattaaatactaattcccccttcccctttctccacagctcttggtaaccacctttctaatatctgtttctatgattgtgactactttagatatttcatatgagtagaatcctacagtatttgctttttttgtgactggcttatttcacatagcacattgtcttcagaggctcatccatgttgtagcatgtaacaagatttgcttcttttttaaagctacacaatattccatcatatgtatattttctttatctgtattttctttatacattgatctgtcaatgaacacttgggttgcttcctcttggctattataaatagtacttagatgaacatggacttgcaaatttctcattgggatcctgctttgaattcttttgtatatatacccagaagaacgatgctgaatcatatactaatcctatgtttaattttttgaggaatctccaaactatttttgataagggttacatgttttacattcccaccaaaacaagggttgcaaatcttctacatcctttcctattttgtgattgatagtagtcatcctgtgggtgtgaggggatatcacagtgtgggtttgatttgcattttttaatgattagtgatgttgaatatcttttcatgtgtttattgtccatttgtatatcatctctttgaagaaatatctatttaagtgctttgcccattttttaattaggttatttgggttttttgttgttgttgtttagttgtaaaaatttctggatattaatactttatcaaatatataatttgcaattgttttctcccattctgttggtttcctttcttttttttttttttttgatgtgcagatgttttgaagtttgatgtagtcttatttgtttatttttttttttttcctgtgcttttggtttaatatccaagaaatcattgccacatcgaatttcctgaaattcttaatctatattttattttaggagtttaatagttttgggttttttcattttgagttaatttttatatggtgtatgctaagagtccaacttcattgttctatatctggatatccagttttcccagcatcatttgttgaagaaactgttcttttgccattgcatagtcttggcacctttgtcaagaatcatttggccatatatgcctaattgtgaggatttaaatacattatattttaaacaattttgaatcaaacagaaataaagagaaactaatcatattctagcatgaggattttatttctgtatagccatgtcaccccattagaagagaatatttttcataggtgagtagtgacagatagaagggatacttgcttgctgaaagtttggaggttaattgactaattagaatgatgatttcaagggtctaagaagaaaagaggaggacctggaataagtccgtgacatgaagtttaaagcaggagacagaggcagaatgcagaggaagacatgactgaacatggcaactgaaaagataaggagagttagcacataggatttcgagttggatttttacctggaagaattcaaggttttatttccacagttttaaatccttttatgtttaagatgcaaagtccttaatgagctatttttccgatccatattcccaagtccctagaaggacgtctcactatcattcagagtctcatgtctgcaaggctggctctttaatactcagtatggtctctattttgaaatacttagcaatgtgactcaaagaacaaaccacagtcatctgtatccaggcaacagcattgataaacactgcaaatttcttttctaccttatagcttgagctacataatgtggactaaaaagaatattgtattctattcagtgtttctagaaattaacaactataaacataggcactcaaatatgctcctaccttaaaaaagaaggaagcacagctacagtacagaatcactgtcatcttaaatttctgacattctagatgtcatctcaaatgtaaacagtctgcatttttttttttaacattctaaagatatttgtacatgcttgtttgattgtattgtaagagacctaagtataaattgagtcaaccaataaaccgcagggctactgcctgacaatttaaattagctcctttcacactccttagggtctgcctgtcagagagttatctgagttccatatacaacagtagcccaagcccataccttgatcacagtaattatctgtttttatttattttccccttgtccggtttatttcaggcctggttatttttccattccaagagcctatgcacccatgttcaattacctggtttctctctagcacttgagactaactctagttgccagatcaggtaaacagaaaattcaagctaagcctgctcagtagatgtaatcaactagtagttccatgtaggaaccacaaatggacatgttttttgatgatagactgagtttttaagtgggaagactggtattaaataaattctatttggacaaataggtgaatgacaattgtaatagacacgtgaatcagtcaaataatttttagcataattgcaattatgaattttgagagttagccttaactctaaaattactaattgttaaagttttacattcctgagtcaagtaaattaagtagttgaatttttggggggaaaattttgtgcatttttctgaaaaggaaaagagttcgctttatagtcattattgttctattttacaaaaataataatatgtcaatgtgttacaataataattagtcacacatcccaggaacttaaaatgagtgtcaagaaaagtgagataaaatagtgactatctgttaagaatgatttaagtgacattaaaggaaaagccttcttctccaaagtaatcatgaagtgaggactctgcaaaattgagttcccccaatgactggactatagttgagcacttcaatgtaaagtttcggctagggtgatctgaaatggttgtgctgttaaggacataacagctaagtcaatttaaaaagaactttaaatgactacttcactagatagcaaggtatagaatgctgtcaatgtacatcacttgagtaattagcaaactgtatctcttttgagacagcaatttatttaactttcctcattttgtgcctttaacttacccacaggatgttgtttgaatataccgtcagtaatcaaaaagtgtatgcaagtatatatctctctaccaggtctgaagacatgttatttgcttggtcagttggccttaataaagacagctgctatcagtttttcctaatataaaacccagcgtcgtcctctaaattcactctaatgatcagttagtttcagatgatgatatggatggatggatggatggatagatagatagatagatagatagatagatagatagatagatatagatagatagaaagatagatagatgatagataacatacacatgaaatacactagaatcaggagtaagagaaattcagtgctgaagggcaaaaatggagcttgactgagtaatcttggacgttttgaggctacagcacaataacttctacccaatgatttactctactttctatgctgtggtttaataatgacatttttgaactgaatttattttctttaaaactctttcttgaatatattacaagacttctttagactgtatataaagtagaagttacttttcagaggaactttttttttttttacagcactgttgttatataaacacaaagctatttgactaaagagtgcatctataactggaattacagtggggatacaatttagttaatgtagaaataattgtctgataccgtggttctctacatgctacacattgaatgatgattattttatgagtaagtgaattctgtatggatgtaaagattcatttgaatgtaactggagtaatttgaatgtaactgcaattacttttgcaccaacctcataacaagagtattatgttcttattctttcattcactctctctctctctcacacgcacatatcctttttccttcaagagtttttctatctaatgtacagtaatgcttccataatattgttttcagagttcatgccaatagtctgtctttatagaccaaaacatttgtaagagaatctttcagaagtttaaactaatgactctgtcttataccaaagttcatgtgatagcaaatagagttaaaagaattcctgccatgcttctattttgtattttattatcctctaatttatatgaatattgagtatttgcaaatacttctatctaagaagataccataaaaatttccttaaattattatgcaaattcaaagagaatgggtatgaccagaaaaatttgtttatttgaactgtattttttacaactttagtcttaaggaaagttaacattttcaggattccacaaacacagacacacacacacaatgagttagagctgcagttttatttcttagaatttttgatcttgtaggaaaagaataactaagcactttcatttcttcaaatttttcaaaattattcaggagaatttgtcttcatctattcttttctacaatgatcctagagaatttcttatccatatattcagtttggttatggatttatttgctaacctgataggtagtgttatcatggttttgttttcataaatgtaatcgatgtcctagcttattttataaagagatatatttcaaattgaataaaatagttgttatcacaatcattgacccattatgttgaatttctataagtctccaataagagagaatgaatttttaaaaattagttctataaacttgttgaaattggaaattatatcccttaatataatcaatttatatctaataggactctaaatattttctacataatataaaatagtccataagatggagtattttatgaaacactttctaaattttcatttatattaaatgcaaaaatatattagagaatagatgtttgttttacaagttataataaacacactaactaactataaaagctatcaggtcagctaaatgagtgaatatgtttaagatattgctaagtaatatgtttgactctcccttctacaactttcatatgtaaaacagttactcagatcttaatgccacaatattttttctatccatcatctttttttcaattgcctttgccattctgtcagttcagatccttaaactctctcccctacctccgttttctctccccctcattttcagattcacctcattttcctactcattttcagatttactacaaagcagagctttgagcattccagaaatatatgtctgaacttttcaaaaaccttcaattattctacaccatttcctaattaattgagtagctcccctcagtttggcatttaaagtagtcctaaatgtggcctcaagtcatctctgacacagtaattctttcttaatcattgatcatcattgataaaaatgtacatattcatatatatgcagagttctatataatttcatggagtttacaaaatctttctctacaagtcttacagaaatacccgcctgctctacacatgtccatcctgccattctgccacacatacatacctaacattccaaccacatttgacgacaagcaacttgaggacagacatggtgttttctgcaagatacacgttcacatgaaccctatgatactatccaaatgtctccactgagtagcttggcccctggaatgtcttccctgaggttttcagaatgtttgccttccctttatctgtccctgttatctgttacctggataagttgggaggcatttggggaagataaatgtcatttttcagatttcagccactactaactattcttgctaaagtaaattcttttgttatagtggaaaataatttttactaatgaacttggactgtccctaccttgattaatacaggcttcatttgtgtttaaatttgatgtctatttgattcacgtcagctcaaaacgtgttttctaaatttatatttttcaggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggtattatgcaaggttgcaaattttgacaattttggtgtctgcatgccaccaccatcagtagtatgtgatgctctgtatatttctctgttcaaactgagtgttaggttgaactcaatagtttaaagctttgtttcttcagtttttctgtgcatgtttaaattttcgtcaaactcttttctttgtctcctgtggagcttggtaaggatgccctttcaagcacacttcagaatagttagcattacagttactcttctttcctttaaagggtgatttgaagaaaaaatcagacaaagacgttctacagttttgtcatctttgtttattcagtgatcaaaatcaaagatgagactttttacatgcagggattgtatataatctattttcaagacaatagacattttaaaccctttattagtatgaagctaacgaagcggtcataagctagtttgtctgaaaacatgtgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgctgaaatccatgaaatatttttctcgtttccattttctggctttgacatattttttcccaagtgcctgtctgtccaaggcttaccatgttgttctttatgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatttgtaaggttgagttttgtgataggagcaccaaacatatggtatttgttttcagtatcaaaaacacatgaatgttgaatttcaaaagaacagccagtcattaaatgaatccatgtatttggagaatcatatatagactcaatttattaacatagtttacataacatttcatttatattagtaaaattctgattcaaggtgacaaaataacacagatgaacatttccaagagagatttcatctgtaaagaaatggcttcttttgaaataataaacttagtgtttctttaattaaacagattagattgttctaatctcagtatttttactaatgccactatgtagctaaagcaacactaagccacctctataggtttctcagggtcgcttgctcaaaaattgacgtgaaagccacctttagctagtatcaaacgggcattggtttaagagatgagtcagttagttcatcagctaacactgccagtcatcaactgatggcatggtaaacagtaggaaatggttatgcaaacagttgaaaatacaacattttattatacacttcagggaaatctgtctatccctggaaaaagacatcaacttaggtttggcctaaacctgtctccaaactaagctgcctgattttaccaggagatgctgaaaaaaatctcttgaaatcatcaagctgattctgcctccaatggagctataaactttaaaggcaataaatcccacaatgctcaggcctggatataccatgagtcaaccccatcttgcatccacataagaggcaatttcactaatatgataaaacaaacatacatttttcccatattttaggaatctaggtggcatattttaggacatattggacatgatgtgcctttccttctcaatctttttcggtatatttagttaatgttgagtccctgagatgggaaataatattatagaaatcaccaggtgcattttagttacacaatttttatttattaaaatattttcctgagcaaatgttgataaacagctacataattttaaaaattatctgtatttgtatcatttgctctagcatactttgttctagtaaactaaaaaatacttataaagatgtcagaaaaccaaaacaaatgtatattaatactgttagatttttttaatatcttcagaattatataggaacatgttacagacatgttgaatatataggcatattaggttaagaaaaatctaaaactttccttctaattcagacagtgcttcaacacctttgtgaaaagagtttttatctcattaatacatatgaataattaagcatgtttttaaataactgaagcacaaagctgtatttggaaattgataaaattgataataaatttaaatatgtaaaagaaaataaactatatttttaaaacaggaattttatccgaaaaataccttaatgagaagataaagtgtgtttgtaaatttgaatgacatgcagcacttaactgcatatggaaccatcatttacaattcttaaatgcaattaaaaagcagtggaccatgtgcttttcatcttttatgataaaaacagtagtgtacattcaacagcggcaaaagttaaatcaccccacactaaatctttctgctgatggttttttctttaacctagtgaaaacacttcaaaggttatgtcttcttctgaaagatgaatattcagaatactatgtctgacatgaagatctggaaagagtatgtctaaagtgatattctgttttgtgtgaattcagggccaaccccagggtataaacaaacagccagccccagtcattgtatgagccttcaagaattctttttcaaataacatctgtttaaaacaaatatagagaaccattttgaaggaagatggacacagccaaactggaggaaatattccaaacagacaatgtagagtctgttggagagttaaataggagaagattggccccatctggttaatgttgatgataatatacgtatttacacactcattgaagaacatatttgggactttttaccactacatcgtctccttttcttcttgcctactacctctttgaggcttcttgatccctaaagcaggtgccactcaaagcacaagacttagatccacctctctaatccattataccctgcggttggctttgtgtacttcccttaagaaaaatatctctaactccctgtttcttgagctgtatctgggtttttatatacatgtctaaaatatcagatgttattgttttaccacaacattacccaaagatcatctaaaattctttgttgattttcccataggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactgggtatgtacctaaggaatgaagtttatttttaataaaaatgttattttaaccattttaaaataatagatatttatgcccagataatgtcatattggattaatacctgcaagatattacattcctttattcaaaattaattctatattatggtgtttttaaaagtcattgctttattatttctggtgttttagaagcttgttaagaaagcacatatctcaattgcattacttaattacatctgcttttggtttttgaattatacaagacttgttattgttcagcagtaataaatattattttatagtgctttgtcattcacaacactctttaatccttccaactacctttctgaatctcgcagatcaggtactattaatcccactttacaagaaggagacctgaggctctgtgagtgtcatagagatgttcacatgtctggtatatagcagagcctaggctcaaaccttcatctgctaatttaaaatcaaaaatcctttccactattccatgtcatctctgctagcttgcctatgagacaactcatacgtatgtgagtatttaaataattctttaaaatctttgggtagatagcagcccatctcaggataagcagagagaacaagaatgtgagacttacttgccttccattatcacccatctaacaatatgcctgctaggagatttatatttctaaattgacccaaattaatgttaaaacacaatctaaagcattgctgagtcatctatttaattattagatgttaaagtagtgtgattttaagtaaaaaataaaatagctttattctcataatttatcttttccttcttagtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaagaaaaaaaggaaaagaagaacaaagaaacatgactgtctcaaagagtaatttttctagattagaccagtcaggtttttgaagacatataggtaacttccacagaaaacacaaacatgtatttaaaggcaagtctcatctaagatgaaactcataaaaattatttaatgtttgttatgaatttaaaag

SEQ ID NO: 2318 - DNA, 7192 bp, Homo sapiens
ccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 2319 - DNA, 167637 bp, Homo sapiens
agcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcaggtgagcgcggcgcgctttcccccggctctgcgcggccgggcggcctcgaagtgcaggcggaccgacccaccgacagaataccgagcctgggctgcccgacgcgcaggcgccctccccaggcccgcactgcagcccccagcgccccggggccccggcgccttcgacccctccgaggacagggggagagggagggcggcgctgcccgacccctcggccgggagagctgggcgcgctccctgcgcaggacaagccgcgctgcagccgccccggagtgccccgtgggggcgctgtggcacgcagcggggacgcccagaccccggccaccgcgacccagggaaagggagacctgttgagcgggtatgcagggtgattcctattccacggacagccgatggctcccccttccctcttcggaacctggtattttcatgcccgtgtcatctggattttgttcttgggtctctatggcagctaaacctccagcttccctatattgtggaagagggagagaaaggggaaggcattttgtggtagttgctagaaaccccagaacaatttggagccgtttggggagaggacagagaaatggggactgtccctggtagggtctccaggactgggggcacaggaaagtgctctcctcagggacactcgcgcccaccctgaacaaacccaattgaccaagtttcaatttgtcataaatcaggaagccacaatgcatctgcaccaagcacacttaaaatcggcctttaaggaatggggcagtcaagagacttcagggacccgtggtcgagagcagagactggggtcagcctgcttgggtttcaaccccagctgtgaagtttacagggttgataacttgaaggtacccaagtatgcctcagtttcctcatctgtctaatgaggatggtaatacccacagaactgtgaggattaaatgagatatggcggccgggcacggtggctcagggctgtcatcccagcactttgggaagccggggcgggcggatcacctgaggtcgggagttcgagaccagcctgaccaacatggagaaaccccgtctctactaaaaatacaaaattagccggacttggtggcgcatgcctgtaatcccagctactcgggaggttgaggcaggagaatcggttgaacccaggaggcagagattgcagtgagcggagatggtgccattgcactccagcctgggcaacaagagctaaactccgtctcaaaagaaaaaaaaaaagatatggcaagtaaagtccttagaacatttccaggagcattctaagattaggtgagttccatggcttgtctttgcagaaatagcaaggagctgctatgagcagtgaatgtacctcttccccagttcagaaagagaggctctccatgggtacgtgagggtggcagataagccacgtgtatgcaactggtagttccatgcaggagtccacacgggcgcagttctccctgcttgctcccaaagggccaacctcataaaaccatgtcaaaataccaacatgggtttatgacctggaatgtttcctctcagtccctgaaacttggcacttagaatcctctgtggagaatgagatacttatggctcttcaccttgcattttcctatctgtccacactttttacttttatttctgccaatagaattcaatctcaggcccccgagttaccaggacactgtcttctataaatcggggctctggggtttcttgttcccaggcaacccagggccaccaaggcctaagcttgcttgttggaggtgtcagagcagagtccaaatctgaaacaccctcgagcagctgtcatgccctaagctcttatcagcgagtgccatatgtccttgtttagcaaaaggtagttaaaagtgtggcctgagatttaaagaaaaggagagatgtttgctctttgaaataagagagccattggaggttctggaaaaataattctacagtttatttagaaacagttctgactggcacctaagagagggcaaggagtgaggtggggagactaaaagggggagagaccggcttaggcctcaggaaaagcaggccgaagagggtgtgacaggtctaacgctggcctgagcaaggtgttgggtatgaggctgggcaagcagtaggagaggtgagtggtttaagaccagtcaagttggcagagagcctctagtgctgcccctggcactcactgccctctgatctgtagcacctgcaggagcgtcccttccagggattccccgtcttctagggaagctatggaggactcccctgtttaaagcatatggcaagataactcaggagggccagggaaagagggaggctgagcatatgccaaggggagaatggggaatgtcattgctgttgctagtgaatggtgccagggaggtccttccaaggggccacttgccacttggagcttcagcccatgaggccatccttgaaccctgccatgtggctcggcagacagccaatactgcctgaagggggctcagatggaatggcagggctgggctgttgccagtaattggtgttaatgactatgacagtggctttgacatggatgagatggagttggggtacaacccaaagcacactgctcttggcacccgaaagacctgggttgcagttctagcccctcatacctgcaaagattttggaaagttacttagactctctgtgcctgacatctgtttcttcatctgtaaatgaagactggattttttgggagaattaaattagttaacaggtgttcagtgcctagctcagaataaatgctcaatatttgttagctatacttactattattgtctgagccttggtttatatcatctgtcaaatgggcgtgatactatgtcatagggttgttgtaagggttaaatgaaataattaatgtgaatttatccaacagtgtgtgaagggtgtaaagtactcaaagtgagtcaattgaaatggaaaatttcacaaaatacctgcatgtaaaaatcagcggctgagcaggtggatcagctaacatttttggaaagttattctaaaagtactgtcagaggaacctttatctacttatggaaagtggggctcactgcccatggggataccctgtagttattttatgttgttgtattagttgcctattgctgctataacaaatttcacaaacatagtggcttaaaacaaccctaagatgttatcttgcagttctgaagttcagaactcttaaatgggttttgtagagctaaaatcaaggtgtcagcagggctctgtggttccttttgtaggctcttgggaaaatgtctttcattttctgacttctaaaacctgactgcatttcttggctcttggttccttcttccatcctcaaagccagtaacagcatcttccaacccttctccccatcctgactctcgtgtctccctcttacaaaaccatacctagaaaatctgggctaatcactgcatctcataattcctaagttaatcacatctccaaagtccccccgtttttttttttcaagacagagtctcgttctatcgcccacgctagagtgcagtggcgtgatcttggctcactgcagcctccgcctcccaggttcaagtgttctcctgcttcagcctcccaaatagatgggattacagccatgagctaccacacctggctaattttttatatttttagtagagatggggtttcaccgtgttggccacgctggtttcgaactcctaaccttaggtgatctgcccactttgtcctcccaaagtcctgggatcacatgcgtgagccaaccgcacccggcccaaagtcccttttgccatgtaaggcaacacagtctggggattaggccatagacatctttgacatattattctatctgccagaaatattagagtattagattgggcatgatggtaagaaaaactatttagaaaaaagaaagaaatattagagtattagagaaaatgatctaaatcaaagagttttagctcacttctgtttagggcttctccctgtaccctcccagttaggtgagtttgttttcacatctctttttttcttttttttttttttcccagacagtttctctgtgttgcccaggctagagtgcagtggcacaatctctgctcactgcaacctctgcctcccaggttcaggtgatcctcctacctcagcctcccaagttgcaacaccatgccctgctaatttttgtatgtttagtagagacagggtttcaccatgttggccaggctggtctcaaactcttgacctcatgatccacctgactcagcctcccaaagtgctgagtttacaggtgtgagccaccatgcttggctgttttcacatgtcttaaagaccaaaagctcaagaccagaggggtcaaggctatggatcaaatgcttcttgaaactcagttcagaaatggctccttcctgtcctttttgggctttctccctccccttgagtaaccctcaaatttgtttcttttttagatttttgtaaaaactttttttttacagagacagggtctcgccatgttgtccaggctggtctcgaactcctgagttcaagtgatcctcttgcctcagcctctcaaagtactgagattataggcgtgaggcaccacgcctggccagtaaccctcaactttggcccttagaacagtcactgttgccccatcaacagcatttgttgacttttctagctgcttctcctcttccatttctagtgaaatagaaaaaatgccctcatgtccagagcaagatctctgtgaagcaaatcactctagtgacgtttgacctccctgagattcccagacggtgtctgtactagtttcctattgctgctgtaacaagttagcacaaacttagtgacttaaaacacagatttattatcttacagttctggaggccacaattctgaaatggttctcatggggctaaaaatccaggtgtcagcagggagaatttgttcccctgccttttccaacttccagaggctgcacgcattgctcggtttgcttccatcttcaaagccagcaatgtcaggctgcatccttctctcactgccacacctcagatctctcttctgccttcctcttcttcttcttcttctttttttttttttgtttgagacaaggttttgctctgtcgcccgggctatcatgcagtggtgcgatcacggctcactgaaacctcagtctcccgggtttaagtgaccctcttatttaggctcccaagtagctgggactacaaggattgtgccaccatgtctggctaaatttttttttaattttaattttttgtagagacagggtctctctatcttgcccggctgatcttcgactcctgggctcaagcaatcctcctgccttggtttcccaaagtgctgggattacaggcatgagccaccatgccctgacctcttctacttttttttttttgagacagagtcttgctctgttgcccaggctggagtgcagtggtgtgatctcagcttactgcaacctctggctcctgggttcaagcgattctcctgcctcagcctcctgagcagctgggattacaggcgcgagccaccatgcctggctaatttttctatttttagtagagatggggtttcaccatgttagtcaggctggtctcgaacttttgaccttgtgatctgtccgcctcgacctcccaaaatgctgggattacaggcacaagccaccgcccctggcccctcttctacttttgaggacgctcgtgattacattggcccacctagataatccaggatcatctccccttttttaaggtcatctgattagcaaccttaattccctttgccatctaacatcacatattcccagcttctgggaattatgatgtagacatctttggagggcaattattctgcctgccacaggacctgagaaggagttccaaatagtgtccgcctgggctgcctcattcttaataaccacccccttccagaatgtgcacaatggcccactcaagagagaacacctgttaaactcttcaaaatttctcccgcagctctcaggtctctcagtccctctgttggtggaaggatctgagggcaatagagcctggaactgcacactttatttgttaagttaatttttttcttttaaatcagaggaacatataaaaaggtgcacaaatcatgagggaaatctcaatggagttttacaagtgagcactctccactgtcatgtaactgcccccaagatctgcacccatagccccctttggaccccaaataaattatcgtcttcccctaaggcaactactattttaccttctatcaccataggttaattttgtctgctttatcttactttattttttatttttattttgctctctggatctgtgtagagtatttgcctgtttttttttttttttttttttttgaggtggagtctcactctgtcgcccaggctggagtgcagtggctcgatctcggctcactgcaagctccacctcccaggttcacaccattctcctgcctcagcctcctgagtagctgggactacaggtgcccgccaccctgaccagataattttttgtatttttagtagagatggggtttcaccgtgttagccaggatggtctcgatctcctgacctcatgatccacccgcctcagcctcccaaagtgctgggattacaggcgtgagccactgcgcctggccgagtatttgcctcctttttaagcaaacttctctttttttcttttgagacatggtctgactgtcgcccaggctggagtgcagtggcatgatcctagctcactgcaacttcctggctctagccaacctcccacctcagcctcccgagtagctgagactacaggcatgtgccaccacgcttggctaattattgtattttttttttttttttttttgagacagagtttcgctcttgtcacccaggctggagtgcaatggcgcaatctcggctcactgcaacctccgcctcccaggttcaagtaattctcctgcctcagcctcccgagtagctgggattacaggcatgcaccaccatgcccggctaattttgtatttttagttgagttgggatttctccatgttggtcaggctggtcttgaactcccgacctcaggtgatctgcctgccttggcctcccaaagtgctgggattacaagcatgagccaccgcgcctggacaattcatgtattttttgtagagacagggtctcacaatattgaccaggctggtcttgaactcctgagctcaagcaatctgctcggctcagcctcccaaagtgctagcattacaggcttaagccactgcgcctggcctacaaacttcttattgacgtatacatacaaaaaagtacactaatcaaggaagcagctggattagttttcatgacataaacccatgtgtaaccagcattttgatcaataaatagaacattgccagcacccagaatccccgctcaggctctttctgtgcactaacaagccaagtctaaccacaatcctgattcctatgattgtggatacattttttccatttttgaatgttattttgttcaatgttatatttgtaaatttctcatgtaattaatatgccgtaattaattcttttttattgctgcgtaatatcccattatatggccacaccacagtttttctgtactattgttaagggctgttgagattgtttccattcacacttctttttttttttttttttgagataaggtctctgtctgtcacccaggctgaagcacagtggcatgatcgtagttcactgcagcctcaacctcctggtgctcaagcaatcctcccacctcagcctcccgagtagctgggactataagtgtgtaccaccatgctcagctaatttaaaaaaaattttttgggggggccaggcacagtggcttatgcccataatcctaacactttgggaggccgaggcgggcggatcatctgaggttgggagtttgagacctgcctgaccaacatggagaaaccctgtctctactaaaaatacaaaattagccgggcatggtggtgcatgcctgtaatcccagctactctggaggctgaggcaggagaattgcttgaacccgggaggcggaggttgcagtgagtcgagatcgcgccattgcattccagcctgagcaacgagagtgaaactcagtctcaaaaaaaaaactttttttttttttgtagagatgaagtctcactatattgcccagactggtctcaaattcctgggctcatgtgcttctcccacctcagcctcccgaagtgctgggattacaggcatgagcttctgctccttgcctacttcattttgaaagggagtgactacctacccatatctcagttgtcataaatgcaattccacctgcagaaattcaggaagggaagattgtatttagcactggtgccaaatgcattcattaggagagacttaaaaacagtctactggttaggattaagttcagctgcaagttacagaaaaaatgaaatgacagtgggttaaagaaagaagtttatttctgtcttgtgttcaagaagtctggagacagtgagtgtccaaagtgtatgtggggtaaggccccatgccctgtgcctggttgcttttagcatgcatagcttccatttccatgcagtctcacccaggatttcgggatgactgctgagtactaaaccaaaaaacaaaaacaaaaacaaaaaaaaacaaaaccgatgttagagaggcaggtaaggcatttgaaaacattgttttatggaaaaaaaaagttatggaacatttataaaatgaaaaaagcagttttttctaaattaacacattattttataacttaaaatgttttaaatatgtatttgtgacttaactgatacattattataagtagatacttgatatttcatctatatcctttaaaatattcaagctgaccaagaaattgtatgtggggtcttccaatcaggaaaaataggagccaggcacagtgcctcacacctgtaatcccagcacttgggaggccaaggctggaggatcattgagcccaggagctcacggccagctggacaacatggcaaaaccccatctctacaaaaaatacaaaaacgtgggggtactggtgtagtctcagttactggggaggctgaggcaggaggattgcttgagcccaggaggtcaaggctacaatgagccattattgtgcaactccaacctgggcagcaatgcaagactctgtctcaaaaaaaaaaaaagaagaagaagtccaggcatggtcgctcatgcctataatcccagaactttgggagagcaaggcgggggaatcacttgaggtcaggagttcaagaccagcctagccaacgtggtgaaaccccatctttactaaaaatacaaaaaattagctgggcatggtggcgggtgcctgtaatcccagctacttgggaggctgaggcaggagagtcacttgaatctaggaggtggaggttgcagtgagccgagatcatgccactacactctagcctgggcaacaagagcgaaactccatctcaaaaaaaaaagaagaagaaggaagatgttatcctcctattacagtcgcctacattcaggcaaacatagtacgtagaggaagacatggacttgactttggtactttttggatgcagaaccagggccattttgcttcaactaatattttgttaattaatgaaagatcaataaatatgtttgttcaaattaataattttaaaaaaatttattcacacaatttggtacctagcacaagaagcaaacagaggtgacaaggtgcatgctgcagcagacaacaaacccattgtcaggggtctatgaagcagtcagttctcattagaaaaccgagagaatattttacagcatgagtgacatgtgagctgaggcttgaggactgaatgcaatttcgatgaatgtagaatgtagaaatttcagggtgagggaccggcatggatggaggcgccccgctatgacaagagtctgagttcttcaagccctaatggggaggctggggtggatgtgggggccaccatggtcagagaggtgggcagtggccagtcaaggagggccttgaatgttaacattgcacagtgaggccacaggcagattcaaaatcacaagggaagggccagtagatgagggacccaaggcagggagggcagttctgaggctcctgggagtctggctgagaaagggtgtgggtagaacattcgctgcagcagtgggaactgtcaggaggcctggacaggggagctgtgcagaggtgggaacaccagaatttatccactcacaaatgtgttgaggatacagaggacacgtggaagctggctcccaaatttctggcctagatggctgggcagatggggttagcatgaccatgaaaggatttgaggaaaagatgactttgtgtctggacaggctgaattggcaagcaggcctgcaccactgggtggaagttacagacagcatcaggtcaacatcgcggagaactgaggtctaacatttagagctgcctgaagattgtggatggccttgaatcctagccagaggttgtcttcccatttgctagggattccaggattaggtggaagacaggaaggtacagcctgaaattcacacagctccagtattgtatgattctctgtgaactcatagaacagttggtgtgcatacctggtatgctgacaaagagatctttggcaaaactattgagcctgatgtctaggaatttatcgttagaaaaatctttctttcttttttttttttttttttgagaccaagtcttgcattgtcacccaggctgcagtgcagtggcgccatctcagctcactgcagcctctgcctctcgcgttcaaatgattctcctgcctcagcctcccgagtagctggaattacaggtgtgcaccaccatgcctggctaatttttgtatttttagtagagatggtggaacaggaattaaaagaaattaaagaatatgtgtaagcagaagctcagttgtatataagaaaactcaattccccctgagaaagagaaagagctggagtcctttaaaaattaactgcctgtttttctgtggctagtgagccttatctctcctcctctcccaggcattgtgaagaccctgtttctctagctgtgcagctgcaaggttactagacagataaactcaagtcataaaacatgtttttccttggaaagtaagaaatgatgtaatgcatgtctctcaattaattgaattattgtctttgtttcttgctgtaatatgcttccccctgcacagatctccccacaccccacgaaatgcttaaaagctaacttaactctttgttcagggctcagtcctttggatgttaatccgactgggctgatgcacacctaaataataaatatcctcctcaaccccattggtctctctgattccttaaaaaatcctgctacaatgggatttcaccatgttgtccaggctggtctcgaaatcctggcctcaagtgatgcatccttcttggtctcccaaagttctgggattacaggcatgagccaccatgcccggcctgaaaatcttattcttaacaagtagactgactgcctgagaggtgccagggtagaatattgtctctgccagttaacaagttctgaggccttggagaggtctttccacctataaatcttagtgttccatccatcaaatttggaactcatccacctcacagaatgattgtggggatcaaatgagatgatactgtgaaaaatgcccagttcactggctgtcccatccagacacttaataaatattagtgtcctgtcccctttctctttttgtctggaggtggggttaccactggagaggggatcttgccaccttcttcaggatagcaggatcttgccaatggtctggtttagattgagaaacttggctcccaggccatgcctcttattttatggatgactagttaaagcccagagagttgttacctaggtgaggtcatgcaggtgtgcagaaccaggcctctggtctcaaggcccacaccatacagttctggctctggagggaattctattcgcctgtggatttacttgcaacagtgatgcttagaagaacccgtagttaagacagaataatcttctctctcttcccccacccccttggtgaagttaaatgaaaagactcattgtcccatggagaagagaaaaactgttaaaacaaaagtcaaagccgttgtattattttaaaatattctttccatgttcccaaatgcttcatggaatctgttcggactgaattaacctctctatttctcagcacagaaattcttctcagatgcccaaaaatgaaaggaactgttctcaaatatcattccattttccagttagaaatgggtcctgatcttcaaatgctgacagctgtaaatgccaaactgagaaacaaccattgagatggatacatgcactgacttatttttttcttgtttcactgccattgcagtttttaggaaaaaatctatcttgtctggtactgatattgccacactgattttatgttggcatctatatggtatccttttcccattcctttattacttatctttttttttttttttttttttttgagacagagtctcactctgttgttgcccaggctggagtgcaatggtgtgatcttggctcactgcaacctctgcctcccgggttcaagcaattctcctgcctcaccctcccaagtagctgggattacaggtgtgcgccaccatgcctggctaatttttttgtatttttagtagagacggggtttcacaatgttggccaggctggtctcaaacttctgacctcaggtgatctgcccgcctcagcttcccaaagtgctgggattacaggcatgagccaccatgcctgacccttattatttgtctttttcacaagcccacagttaacatcataattcctttttttaatgtattatttttaatttactttctttaaaaatattttatattaaaaatatttctacttaaaggaactttagaagatttcatgttagttttcaagtcactgtaagattttctttctttttttcttttttttgaggccgggtcttgctctgtcacccaggctggggtgcagtggcagtgatcatggctcactgcagctttgacctcctgggctcaagcgattctcccacctcagcccctccctcgagtagctgttctaagttttcttcctttgtgccaccatgtctggctaatttttgtatgttttgtagcgatgggatttcgccatgttgcccaggctggtctcctgggcagcatgacctgcttaccttgacctaccaaagttctgggattccgagtatgcaccaccgtgccgagccaaggttccagtttcttcacatcttcaccaacacttggttacgtcagtcttttaaaaattgtttttaaattttttcatattcctaggtcactattatactcttttcaatatactcttttcaattttatctattccagcagatttgttgtggcgtcttattgtgcttttaatttgtatttttctaatgactaaagatgttgaacgtgttttcatatgtttatttttcatccgtgtatcttctttggtgatgtgactattcaaatcttttgcacattctgaagtgggtttatcctcttctaattgagtgataagagtttacatagtcccggccaggtgctgtggctcatgcttgtaaacctagcaccctgagaggccaaggcaggcagattgcccgacgtcaggagttcgagactggcctggccgacatagtgaaacctcatctctactaaaaatacaaaaattagcctgtagtcccagctactcaggaggctgagacaggagaatcgcttgaacccaggaggcggaggttgcagtgagccaagattgcgcgattgcactccagcccgggtgacagagtgagactctgtctcaaaaaaaaaaaaaaaaaagtgtatatagtctggatagaaataatcgatcagatacatattttacaaatattttctactagtctgtaacttgtcatgccattgcactttgtttgtttgttttgagacagagtctcattctgttacccaggctggagtacagtggtgtgattatggctcactgccacctcgacctctcgggctcaagcaatcctccagtctcagcctcccaagtagctgggactgcaggtgtgtgccaaccttcccagctaatttttttttttttttttgagacagagtctcactctgtccccagactggagtgcagtggcatgatctcggctcactgcaagctctgcctcctgggtttacaccattctcctgcctcagcctcctgagtagctgggggactacaggtgcccgccaccacacccggctaattttttgtatttttagtagagacggggtttcaccgtgttaaccaggatggtctcgatctcctgacctcgtgatctgcccacctcagcttcccaaagtgctgggattacaggcgtgagccactgtgcctggcctaatttttgtattttttatagagacagggttttgccatgttgccctgccttcgcctcccaaagtgctgggattatgggcatgagccactgcaccccagccttttgccattacattttgataaaaagaaagttttaaatatttttagatactaatgtgtatttaacaattatgggtttgtatgtcattattaggataatatacataagtaagcataaaatctgtctaatatacattaagtggcttaatatgacaaaattagcagtgtatactttcttttttttctttttttttttttctgagatggagttttgcttttgctcttgttgcccaggttggagtgcaatggtgcaatcttggctcattgcagccttcaccttccgggtttaataaattctcctgcctcagccttccaagtagctgggattacaggcttgcaccaccatgcccagctaattttgtatttttagtagagacgggatttctccatgttgatgaggctggccttgaactcctgacctcaggtgatacacccaccttagcctccaaagtgctgggattacaggtgtgagccactgcacccagtcaacagtgtatactattgattggtttgattacagaataataccaaaaataataacagcaacaacaggccgagtgtggtggctcatgcctgtaatcctagcactttgggaagctgaggtgagtgaggagttcaagaccagcctgggcaacatgatgaaaccccgcctctactaaaatacaaaaaattagctgggcatggtgtggcgcaccggtagtcccagctactggggcggctgaggcatgagaattgcttgaacccaggaggcagaggttgcagtgagccaagatcgtgccactgcactcctgcctgggcgacagcgagactctgtctccaaataacaacaacaacaacaacaacaacacggaatagctaacacttaaattcagcactttctatgtgccaggcagtgtttgaagtgctttaaatatatctacatatgaaccgattgattctatataacaattaggtctactgttatctccgttttaaagatgaggaaactgaggtcaagagagggtaagtaacctgctcagggttggacagctagcattattttgctttgtttatttttaactcctcactcttcacctatcctcagtgccttttggttagcaatggtgacttgaaaatacaaacatttcttgaaatccacagtaaacccaaaccacatgcaatgatgtttgttttttggaaatgatcacacaccacatcatattccaagtgttgagtgcatatgcctcggagtggaagtgggccttgagagcatgttgtatacattttgaaacaaataagcctagactttttatctgctcggtttggagaaaggggaatagcaataaaatcataaatcacatataaatgatgtaacacactgaatagtgttttataaaataaggtgagggcatgatggtgcacacctgtagtcccagctactcgggaggcttgggtgggaggatcactggagttcaggagttcaaagagccagtgagttattgtgccactgcactccagcctagatgacagagtgagaccctgtcctcccaccactaacaaaaaccctgagatgataaatagcaaggcagcttgaaagtaaatagtaagtttaggatttgagaaaggggcaagatgttctaagttttcttcctttgttcagaaggaatctcagagttaaagctatgaaaagggatcaatctaattagtaaagagtttaaataggctgggtgtgttggctcacacctgtagtcccagctacttgggaggctgaagttgggggatccctcgagcctgggaggttgaggctgccgtgagccatgatcacaccactgcattctagcctgggtgagagagtgagaccctgtctcaaaaaaagagtttaaatggtttaaaaaggggggtgaggagagtagttatttgtaatgagctagtgcaggggtccccaacccccacccggaattagtccatggtctgttaggaaccaggccgcacagcaggaggtgagcagtgggcgagctcagcttcatctgtatttacagccgctccccatcgcctgtgttaccacctgagctctgcctcctgtcagatcaccagcaccgttagatccattagattcttttttttaaattgctgctgcacaaattaaggcattagattctcataggaacatgaaccctatcatgaactgcacactccttatgagaatctaatgcctgatgacctgtcactgtctcccgtcactcccagatgagaacatctagttgcaggaaaacaagctcagggctcccactgattcctacattatgttgagctgtataattatttcattatatattgcaatgtaataataatagaaataaagtgcacaataaatgtaatgcacttgaatcatcccaaaaccacccccacagctgggtctgtggaaaaattgtcttccacaatattggtccctgatgccaaaaagattggggaccactgagctagtgggttctggaacttcacctcttatgagcgatgtaaccttgggcaagttacttctctgagatactctataaattaaatcacttaatacgttgaaggcacttggcccagtgcctggcacataggagatgctgaataaacattcactatttttaatataatcttaatgcatagtaaaattatattaaaaagagtgagctagttcaatacagcaagtgtgaaaaactggactctgaaggttgacaggcccaggtccattcccaggtcaatttctggaagcaatttgctgaacaaacagttcgctgaaatagtgaggtttttttttaagttttgaaacatggtccctgccccacccctgccctgtccctgcctctgacaaagaaagaactatggcatttcatgacttgatttctggggattttcctttcagttttctactaatcaatgcattggaaaattgacctgctagtcctgggtttgaatttgttttacctttttttttttttgagatagggtctcgtgctgtcacccaggctggagtgtagtggtgcagtctctgctcactgcagtcctgggttcaagtgattcttgtgcctcggcctcctaagtagctaggactgcaggcacgagccaccacacctggctaatttttgtatttttagtagagattgggtttcgctgtgttggccaggctggtctcaaactcttggcctcaagtgatgtgcccaccttggcctcccaaagtggtgggattacaggtgtgagtcaccacacctggacttttttaactttttaaataaatttaaattttttttttgtagaaacgaggccttgctgtgtggaccaggctggtttcaaacttctggcatcaagcaatccttctatctaggcctcctaaagcactaggattgcagacatgagccatggcacctagacttgaccctgggtttgaattctggctctgacacttgctaactgtgtgtgaccttgggcaggccactgacccttcctgagccttatgggaatgtgggaataatattaggtaatggagcaagttaatataggtaaagaatttagaatagggcctggcacatggcctcagtctagtaccagagtccaagcccataaccactgtgccaacactcttgtaataaatgtatgtgggagacagggaggctgggaggctggatatgtgatgctactttatgtcaactacacatgaattttatatgtataatttatataaactaattgatgccatctactattattagactgaacaaatattgttacttggaactctcagatatgtaatagcttttttttattcaaatccaaaatgtaaaatgtgactatgagtaattgataatgaacttaactgataagaaacttcaggatagatttttctcaagttttccattcagtcttacagtgattaaagtgatgaaaaattccaactatgcatgccctgctcggagcgtccaagaagagcctaccaacgggggctacttaagctctcaaaggccaaacacacaaacggcattttgagtgcaagtggtctgtttgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctgggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgagcaaaggtgttatgaaaattttttattgggtttgcccagctagatctgttaataatgcttccctgcatggcagcagggaagtaagagctgggccagaagagaggtggggacattgtgaactgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgaggctcagttttatcatctgtaaaatggaagtgtgaatgccaaccttggaacatttctgagaaataaatgaggtaatatacatacattctaggtactcagtaagtaaaagctttaccacaactgtcattctattaagttctttgaaactgtatttgacatttataccttgttggccagccactcgaatctgaccccctgcaaaggctactaagagaactgcccagtgacctggtagcctcagtggcatccgaaattacaatcagggaccacagggacctaaagagccctgttttcagaggtcagaatctttattgatgttaactaagtgaggaccccagtgataggtcttccaggttcctgaaagtccttgtttccatagtgatgtaaacaacacttttgcaaatgtgaaaaggagtgggaagtgtttagtatgttaattgaaacgttttaaaaaagaaattccaagatgataaacaacatctctctctctctctctctgtctatatatatatatatatatatatatatataaaactgatgatgcacacaatcttggctcattgcaacctccgcctcctgggttcaagcacatctcccaccacagcctcttgagtagctgggtttacaggggcacaacaccacgctcagctaatttttgtatttttagtagagatggggttttgccatgttggccaggctggtctcaaactcttggcctcgagtgatctgccatctcgacctcccaaagtgctgggattacagacatgagccactacgcatggccaagatacctgatttctggatcaccagcagtaactgcccagttgggtttctgatggggctggtctcaggaaaagccaccacacacttgcctggaaaagcacactgcttctctaggctccaagtctctctctccctcccttcctccctctgatacacacacacagaccacatcacccccaccttccctggttgtcagcattcactgtcgtcctcctttgcctagaagcccattttgctaaaggcaccaaccctgcatccagcattgattccttcttctcatttttcaagagaatgtgtcagagacaaagaggaggatggggcacaacctatctttcccaccccaagactggaagtgggcatgggtgttttcactccgtgagctgtgcaagtggctgctcccagatatgctggagggctgcttggcttatgaaaatggtggagtgggccggacatggtggctcacacctgcaatcccagcactttgggaggccgaggtgggcggatcacaaggtcaggagttcgagaccagcctgaccaacatggtgaaaccctgtctctactaaaaatacaaaaattagctgggcatggtggcgggtgcctgtaatcccagctactcgggaggctgaggcaggagaatcgcttgaacccaggaagtggaggttgcagtgagctaagatcgtgccactgcactctagcctgggtgacagagtgagactctgtctcaaaaaaaaaaaaaaaagaaaatagtggagtgacaatcatgaaaccagaaagcaaacactatagctgtggcctggattctcaagtgcaatctgcttttttttttctcattttgatggggaacaaaaatggaaaagcatgctcattggtagtccttgccccgagggtatgaccttctcttcattcttagaataatgtagtgttttgtattttatgcatgtttgcttctcttggctcttggactatttgttcagaatatggcccaggccacatttcactttttaatggcaaatcattttggctgaagttatggcatccactggcatgatggattttactggttatttgcttgcaagtatgttcctgaaagtttaacagagtagaaacagcagaattgtttcttaggttaattttttttgaactttctgggttttaaaaatgtttatcttttatgtttaaattcaggtcagagtctcagtaacaacttgagtcagtttgaaaaaataacgcatgtatatatccaccatcctgtgaacatctgtgggctgttcactcggcagcctgtgatgtctgtccacatgggcttatctcttacctcattcatttatctggaatttctactctgtgccagatgccggttgggggtgtgggggtagtgtttaagatgaatagacaccatcaggaggtgcacagagtagtggaagagacaggcatgtgaaaagatcattaatttggtagaatcggtgtgcaaaagtagaggcatagctacattatagctcaactctgcctgctgagcaggcttagtgtaaggcagtggttctcaagctttggtctcaggatccttccttttacgctaaaaattatttttattttattattttattttattttattttgagatagggtctcactgtctcccaggctggagtgcagtggcatgatcatggctcgctgcagccttgacctcttgtgcttaagcaatcctccaacctcagcatctcaagtagctgagactacaggcacatgacactacgcctggctaatttttgtattttttgtagagacagggtttcgccatgttgtccaggctgatcttgaactcctgggctcaagcgatcctcccccctcagtctcccaaagtgctgggattctaggcgtgagccactgtgcccagccaaaaattattaaggatcccaaataacttttgtttgttttttaagaatcctgaggacaatcaagggagctttgtttatgtgggttagatctattggtatctacctgatcagaaatttaaaaataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtgaaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgagtgagccgtgatggtgccactgcactccagcctgggtgacagagtgagaccctgtctcaaaaaaaaaaaaaaaaaaaaaaagaagagtagcaccgttttacagttttgcaaatcttgtaacggtctggcttcgtagaagacagctagattgtcatttcttgaccattcaatctgtcatgaaatgttttcgttagattatatgaaaatgcatggatatgtagttggaaaagggaagagcatttaaatagccttttcatataattgtgaatgttctttgatactacaccaaaacttgacaaagagtagtttcttaaagtttagttgcaatgtgaaatctaaaatcagatcaataaactttttgttctctatatacccacaagagaatgagagtatgaaaggcaaacattcatgttattatggaaatagttctgacctcatggatcctctgaaaaggcctcagggacccctagaattccccaaactacacttgagaatggctggtttaagagaattgttcccagtgaaggtcctgcccacggagagccctgtgggacagcaggtggcagaggcatgaggatggagtgtggcagtggggctccgatgtggcgctgggtctgccagacaggtggtctgagctggagataaggcagcaataatttaggacctcgagggctccaaggaaggagttttgagcttcattttgcaggggtaggagctgtggagggctttaagcagtcaacagtgggtgtcgctttgtctttgcacccactgtactctccggacagacttgaccttcctgggttgtggcaaagagcagggatctaaatagcaggctgcaacaggagaaggaacgagcacctgctctagcccaaagacccctccaggccacaacgctggcaggtagagtcggagaatctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagcttgtggtctctggtggtggtctgtcttatgaggtcttgttgacatatgcattcttttctaaatttaccaaactggctcattttatttctgctaactaaacttgaaagccttttcttttcctattatagactctcctttggatcaatactacacactcagaagttatgtttgtgttttaagagagcattttgtggcaatatggcatcaattctagaagtgggagacaaagatttaaaaggaagttggccctgcagtctggtcaggggatggtagggcctgagctccctcccaccccacaccccaccacacacactgctggaagaattccagaggtgttccagggtagacaccacagcatttagtaaaatttactcataacagttaatttactacttaaaaactaatgaagaaaatctaagaattcacctttttttttttttttttttttttttagacaggatcttattctgttgcccaggctggagtgcagtggcactatcatagctcactgcagcctgagctcaagcgatcctcccaagtcagcttcccaactaactgggactacagtcatgtactaccacgcccaactaattgtttaatttttttgcagagacagggtcttactatgttgcacagactggtttcaaattcttggccttatgcaatcctcctgccttggcctcccaaagtgttgggattacaagtgtgaaccattcctcctggcagaattcaccttacacagccccaaattctgctcttggggaatcacagtgtattaagagacacttattttcatttttgcatgtatctctaaacctgacatcaaaatattcataaaattgcaatacgtttcatataatgagctgaaacctcctaagtgagcaatgtgaagttgttggctgcctggagaattaaatgtaagcatggcctgctctgtgttgctaatggaaatttttacctaggttgatatttattaacccccccttttttttttgagacagagtcttgctctgtcacccaggctggagtgcagtggcgtgatcttggctcactgcaacctccgcctcccgggttcaagcaattcttctgccttggcctcctgagtagctgagattgcaggcgcccgccaccatgcccggctaatttttgtatttttagtagagacggggtttcatcatgttggccaggttggtctcaaattcctgacctcatgtgatctgcccacctaggcctcacaaaatgctggaattacaggcgtgagccaccgtgtctggctccaacctacatttttaaggcttagctgccactcaatggatttctacatcccaaaacaatacctttaattgacttttattggcctcctctgtgaaggacggaaagcagatgccagaagccatgagaggctctggctctccgaccaacccgtggaagccactagtcttaaatttcctgaagccattttgccatgattaaaacttttgtctccttccctgagctttccagagctttgtccattctcttccttctacctggaatatccttccccagacaagacccattctcatccagggccaggtcaaatgccacctcctccctctccaggcaagacctccattgagggaccacacacattgcaggccctctgccaaagtgccaaccctctctgccttacattccaaggggtaatagtgatacttacctcagagggattcacattttagctatttttgcacttgtctcattttactactagactgtctcttcaagatagggactgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacgcgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaaaagaaggaagttgaagtcaatgatctctcaggtctcatctcagatgtggtgatgtcaccaattcccctgacatcccttctatgtgggaaccctgatgaaatccgcagctttccctcactgtgtccaggtaggaaagccaaggaggaaccatattctggaagccaaggaaggagaagttttgagacacagggtggtcagtaggatcaggcaggacaacagggatggggcagtgggatcaggtaacacagcagggctgggcagtgggttcaggcagaacagtgggctgggcaggggatcaggcaacacagcaaggttaggcagtgggatcagataatgcagggctaggcaatgggatcaggcaacacaacagggctaggcagtgggatcaggtaacacagcagggctgggcagtgggatcaggcaacataacagggctgggcagagggatcaggtaacacagcaaggctgggcagtgggatcaggcaacacagtagggctgggcagtgggatcaggcaacatagtagggctggacagtgggatcaggcaacacaacagggctgggcagtgggatcaggtaacacagcaaggctgggcagtgggatcaggcaacacagtagggctgggcagtgggatctggcaacacgacagggctgggcagtgggatcaggcaacacagtagggctgggcattgggatatggcaacatgacagggctgggcagtgggatcaggcaacacaacagggctaggcagtgggatcaggcaatatggccgggctgggcagtgggattaggcagtgaagcaggggttgttaaacttcattgtgcatcaaaagctcctggaaggcttgttagaacacagattactgggccctgtgctcaaagtgtctgattcagtaggtctgggttggagcctgataagtggtattcctggaaacctcagtttgagaactattactgtagagaaacctacaaggttgggtgggaatgggcaggaggaaaagatactagaagaagatgctgtggggcatgagccggaaagacaatacaagatgagtaacatctgcagagaattgcagctgcagagtataaactaactgtaatctaggtccagcccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgggcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtaccccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggaggccaaggtgggtgaatcacctgagatgaggagtttgagaccagcctggccaacatggtgaaaccttgtgtctactaaaaatacaaaaaattagccaggtgtggtggtgggcacctgtaatcccagctactcgggaggccgaggcaggaaaattacttgaacctcggaggcggaggttgcagtgagctgagatcacaccactacactccagcctgggcaacaagagtgaaactccttctcaaaaaaaaaaaaaaaaaatagtagtgatgacaagccaccatgtgccaggcactgtggtaggcagctcacacttcactctgcatgtactattatcccttaaatgtctcatacaaggtcattcaactactgagcagccagaggtagaattcaagaagcgaacttgctgttttctctacttaaactcttttatcacccaggctgcagtgcagtggtgcgatcatggctcactgcagcctcgacctccaggcccaggtgatcctcctatctcaacctcccaagtagctgggattacaagcacgcaccaccatatccagcaatttttttttttcatatttttttgtaaagacagggtttcaccatgttggccaggctgttctcgaactcctgagctcaagcgatcctcctgctgtggcctcccaaagtgttaggattacaggcataaaccaccacaccccgccttcttgaactcttttctataaccccacccaccctgttttatccagttgaattggactcatctttcaggtctcagtggaagcgcttctaatcttctaggttgggatttaataccccaactattgcattcccatggagtgctgtatgtccccaaaactgcacttagcctgtacagcaattgcctgcttaattgtctgtgtagttcgtcactgtaccagcatagctgagcaaggtgcctggtacacagcaggtattccataaatgcctataggaaaagtaaattaacggactcttcctcaataaatatatatatgttctagaaatttgagttgtatattagtttcctagggctgctataacaatataccacaaagtgggtggttaaacaacagaaatgtattgtctcacagttctggagctagaagtctgagctcaaggtgtcggctgtgttggtttcttctgagccctctctccttggctcataggtggctgtcttctccctgtgtctccacgtggtcttttccctctgtacctgtgagtgtccagacttcctcttcttataaggacaccagtcacattgaattaggctcgccctaataacctcattttaacttaatcacatctttgaagaccctaactccaaatccggttacctcctgaaggcctgggggtgaggacttcaacatatgaatcgcgggcagggagagggacagaagtcagcccatgacaagctgctttgcttttcactttcccagtttgtggaggacagtgtgtcatctttcaacatgtttctaaatagcctctttttcctttctgattcactttatgttcccacttcagggtgatatgagaaacgctggggaagcatgttcaaagacttgagcagtgggtcacttattactttaccatggcatatttcagagtcattaaagcagctccagcaagcgcagtgggctgtgcagccggaatcccagggctgaagatgggacaggagtgcaatctaaccaggatgtgaaaccaagtccaagtaaggtttttcaaaagccaagaattagaacgactaactcagtcctgtttcagtatatccaggggaggctgatttatagggaaagatgaaaggaggacaatgtgtatattttggctgctcagaagaccatggggctagacatgggggaggaggaagttattataagcctacagccagccaatgagtaagaacatcaaagaggaaggctggttggccagatggaccaagagctggggcacaggcaggatctttgggagaaacaagatgaatggatgcttcggacaacctaagttcagagcccggaggggcctttagaaaggcatgatggattatgtgtactgtgggtcattgcgccatgagaagtcccatgggggatgagccccagaggcccttaaagtcagggtggaccattaagtaaactgcggaggaatttcttccaggagggctcagacttggcaaaggctgggaagggctgctttccatctccggctcttaatcccccagccctgacactggggctcgcttgttccagcctacttgatccatttattgaataaagatatactgagaaccagccgggcgtggtgactcacgcctgtaatcccagcactttgggaggccgaggtgggcggatcacgaggtcaggagattgaggccgtcctggctaacacggtgaaactccgtctctgctaaaaatacaaaaaattagacgggtgtggtggcgggcacctgtagtcccacctactctggaggctgaggcaggagaatggcgtgaacccagaaggcggagcttgcagtgagccgagatagcgccactgcactccagcctgggcaacagagcgagactctgtccccgcccccccaaaaaaagatatactgagaacccttttattccaaggtctgcattaggcccagtgaaagatgaggaatccttaaatctttgggacttggtggggtcaccggggatacatcctcctctcctaggtaccgttcatctgtttgcacccagatgtggcctgtcccatgtgattgtcccaccactgaccgaagcaggcctctccattctcctcttccagttaaagctgaatttgtctccaaagtgaagaagaataggaaaaccatcaattttatggagctttttaactatgccaaaatggtttcattctgatacactttttttttttctttttgagatggagtcttgctctgttgcctgggctggagtgcagtggtgtgttctgggttcactgtaacctccgccttttgggttccagcgattctgctgcctcagcctgctgaatagctgggattacaggcacgcaccaccacaccaggctactttttgtatgtttagtagagatggggtttcgccatgttggccaggctggtcttgaactcctgacctcaggtgatccacccaccttgacctcccaaagtgctgtgattacaggcgtgagccactgcacccggccctgatatactattttgtttcataatttgcttgggtaatcattgattcatccattcaacaaatacgtatgaagaagctacagtgtacaaggctttgctttgggtgccaaggatactgcagggtcaggccagggtcacatctggctcaccaccagtcaggctttagggtttggtacaaattccacggcctcaggcaccatgggtgcataggatcagcaaaataagtccttaaagagatggaaaactcactcataaaaccatctgggcttgatgccttttgtagaggggatatatttgacaacaaattaaatatcttcaaaatccatttgtgcattcaggtttttcatttcttcttaagtctattttggtcattgatatctttctgaaaagttttctcatttgtctacattttcaaatctgttgttataaattatagctcataatactgagttacgttttaatagggaacatgtattttataaatacatgtttataaaaaatagggtcccactatgttgcccaggctggtctcgaactcctgggctcaagcaatcctcctgcctcagcctcccaaagtgctgggattagagatatgagccactgtgcctggccaggggacatgtatttgttttttttttttttaacaaaaagtacacagtgttaggccgggtgtggtggctcacacctgtaatcccagcactttgggaggccgtggtgggcagatcacttgaggtcaggagtctgagaccagtctggccaacatggtgaaaccccgtctctactaaaaatacaaaaaattagctgggtgtggtggcgggcacctgtaatcccagctacttgggaggctgaggcaggagaactgcttgaacccaggaggtggaggttgcagtgagccgagatcgcaccattgcactccagcccaggcaacaagaacgaaactccgtctcaaaaaaaaaaaaagaataaaaaaaaagacaaagaaaaaaagcaaaaagtgcccagtgttttattctcatagatcacaaagctcttagcaaaaattctgaagaaacactgagacctgggggatgggtgtgtgttgccgggagaggagtcgctattgcctcttgggtttctccgataacacctggcttttgtagaagatcttcacagtttttcaaagcacccatcccttgccttacctctcctgtctcccttgtctgcctgatgcctccaacttctcagaagtgccagggccagggcactgctgggcccatggtgtgggtctacattgcagtaaaaggctcgttacccactcccctcaacacaggagtctcctgtttttaggcagcttaagaaagcagtcttgtctgtggaggaatgcccagccttcttggtgcagatgctgggtttggggacccagctgtttgcaggagttgtctaggaacgtcagtacccagggactgtgagactcctgggatgttatagtccccatgctagcagagggaagacactgggcccatgagaagttgagtttaggtagccagtcctgctgggagaaaggaaagcctcagatgccagcaagcttgctgtccagccattttctgacaaccctgcttattgcaccatgtacagtaatcaacacagacttgcatctgctctgaggggtgcaggtggtgctccatggaacacacacatgcacgccttcacccaccctttcctgtacctttggaattcgtggcataggaacactatatctattgcacttgggtgtggttataatgccagggtaaagataagtttctctgtggagtacctgaatgacaagatcatattttgtgtcagttccacatggaagggctcttcctcacagacattggaagggtaacagtagaatctaagctctaggaaggcagggtttttttgttttttgttttgtttttgtctgcacatgatagacacttagcaaatatttgctggatgggtggacaaatggaaactggaatgaaatggagatgcctaggtgagtgtgggaaggactctgcctctcctggtctttgccctgtagatgccaaatatcctaggcgggaactgggaagttggcagatgctgctgtgtagagagtcagtggagcaaagactggaaaaacatccagcctgtgtcagctagcaaaagaggggttttgggtctattttggggtcagaatattagaggaggtaacctgtaccctcaggcttcagagtgtggttgactaggaggctccaaagagtaagtgaaacccaaggggacggagataggaccacttgatccatccttgtaggttcagagctatgtcttatcaaatgttttcccttcatgtagtagcatgataatgaactcttcctactttggtttgataatgcaatggattatatggatagattttctagtgttgaaccaatccttgcattattgaggtaaactttacttgatcataatgtactttttaataccttactagaattattttgctaatctgtttttgtatttagattcataaattaaactggcagatattccctctaattttcattttttgcactctctggttttggtatcaaagttaagttagcttcatgaaaataagttgtttttgtaaagtaggtattagctattccttaaagagctggcaaatttgttcataaaaccatctgggttgaatcccttctgtaggggaaatatgtttgaaactaatttaatttctttaaaagccattagtctatttgacttttctatttcttttgagtctattttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacgtattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgcagtttagcattcccttctattatgattgcaagcaacaaacaccagagtagtagcagtactgtgtctccagtagcaatcacagatattttcatggcacattgtagccatcagagataactcaaaatactgtttacactcatcactacttcaaaattacactagttagtagacccgcctcttgatcttgacatgttgtttttaaaagtacatgttactctataccaaatttttaaaaatattttgataactgcagttcaaataattggcctcctttctaatcctttgcattcatttacttgtttattgtgataaaatatacataagataaaattgactattttaaccgtttatagtacatgtttgatggtattgagaaaatttacaatgttgtgtaaccatcaccactatttccagagcttttcatcatcccaaatagaaactctgtaaataatgaagcaataactcctcattcttcccttccccaccccccagtaacttctattctacttttttctctatgaatttgcctaaatacctcatacaaatgaaattctatcatatttatcctttggttgttagcttttttcatttagcttagtgttttcaaggttcatccatgttgtagcatgtatcagaacttcattctttttgtggttcaaaaatacgctacattttactccattcacctgtcaacggccacaggttgttttcacctttggactactgtgggtttttttgttttgttttgttttttgtttttttgagacagggtcttattcctatcacccaggctgcagagcagtggcgtgatccgggctcactgcaaccttgacttccctggctcaggtgatctttccacctcagcctcccaagtagttgggactacaggcacacaccatgcctggctaattttttgtattttaagtagagacagggtttcatcatgttgcccaggctggtcttgaactcctgggctcaagcaatccacctgccatggcctctcaaaatgctgggattataggtgtgaaccactgtgcctggccacctttgagctattgtgaataaggctgctatgaacattagcacacaagtatcttcttgagttcctgctttcaattcttttggatatatactaaggagtagaattgctgggaaatatggtaattctatgtttaactttctaggaactgctaaactgtgttcaacagtggctgcagcatgttacattcccaccagcagtacacgagggttccaatttctccacatcctcaccaatacttgttattttcattaaaaaatattaattaccatcctagtgggtgttgcattttattttaggcatgtaaaaactttattctgagaaggagtcatgggcttctccagactgccatgggggtccctgatacaaataaaggttaggaagctaggatgagggaactcaagagctcagagatattgtcacatgtccaaggtgaggtgatggactagcagcagcccaggcattagaactaagtttcctgggtctcaaaggagcccttttccctcctaccagatggtctgttctcatgtacatgatccaccccagccagtggtcagaactgagtcagagctggagctaagccattgaccaaccagctactgaagctgaggccagcaccagacacagactagatagacataattaatccctgtttgcaaatcactgcaatgtagaactaccatgcaccaccacagctgctaaatccttatccagcctacaaacatccactgaatgcctgtgtgcagatcaaactccatattcagttggagtgtttgggggacacttacggggacatcaatggacaatttggtttataggtataaagttcaggagggagaaataaccctgtgtatgtttcatttaattacagaataggtgtcttgatctctcgtttctttgtggggaccctctatttccgcagaggcaggttcagatggcctcttgagtctcatcgcccattttcttactgagctctgtcagccttggctcctgaacctttccacacttgtcagctcagtttttaaaataaccatagctgactttttttttttttttttttttgagacagagtcttgctctgtcgcccaggctggagtgcagtggtgcaatctcggctcactgcaacctccatctcctgggttcaagtgattctcttgcctcagcctcccaagtagctgggataataggagcctgccaccacacccaactaatttttgtatttttggtagagacggggtttcaccatgttggccaggctgatctcgatctcctgaccttaggtgatctgcctgcctcggccccttaaactgctgggattacagaagtgagccaccatgcccagtcatcatagctcactttttttttttttttttgagatggagtctcgctctttcctccaggctggagtgcagtggcgcaatcttggctcactgcaagctccacttcccaggttcatgccattctcctgcctcagcctcccaagtagctgggactacaggcgcccgccaccacagctggctaatttttttttttttttttgtatttttagtagagatggggtttcactgtgttagccaggatggcctcgatctcctgacctcgtgatccacccgcctcggcctcccaaagtgctgggattacaggcgtgagccatggtgcccagcccatagctgacttttaatgagttttaattctagctctccactgtgcaaccatgaataagtaacttaaccaccctgaagttcagttgtcttgtttgtaaaatgaggataataatgatacctccctcatagagtggttatgaggatggaataagacaatacacatagagggcttggcacagagcctggcacagaggaagcatttcattagcgctgttattgttgattttaaaatttattattaaaagtcactttgacgcctataatcccagcactttgggaggctgaggcaggtggataacctgaggcgaggagtttgagaccagcctgaccaatctggtgaaaccttgtctctactaaaaatacaaaaaattagctgggcgtggtggcagacgcctgtaaccccagctactcgggaggtgccttgtggtaaaagatgggccaaggagtttttggttttaaagcgaaagcctgtaatcactgtgcctgctcacagggggattgctatggctaagttcatagataattgggtagttggctgaggcaggagaatcgcttgaacccgggaggtggaggttgcagtgagccaagattgtgccgttgcattccagcctgggcaacaagagtgaaactctatctcaaaaaaaaaaaagtcactttgtaagttgcaaagtatgactctactatgagatctttacaactaggaattaagccagttacgatggcccatgcctataatcccagaactttgggaggctgaagtgggaggattgcttgagcccaggagttccagaccagcctgggcaacatggtgagagcccatctcaaagaaaacctaggaatcagagcttctcatctctgggcctaaaacatctggtggagtagcttctcaggaactgtatactgaatgaatgagtgagatgacatttactaacagttttattaacttttatcttttatttacctatttgaccatctactgtactgacttaaatataaaatagcagtttttctctttcaacctttttttttgaggcagagtctcactttgccacccagactggagtgtggtgatgcaatctcggctcactgcaacctccgcctcctggtttcaagtgattttcctgcctcagtctcccaagtagctgggactataggtgcgccaccgtgcctggctaattttgtgtttttagtagagacagggttttgccatgttggccaggccagtcttgaactcctgacctcaggtgatccaccggccttggcctcccaaagtgttgggattataggtgtaagccaccatgcctgcaccagcccctccccgcccccttttttttttgagacagggtctcactctgttgcccaggctggagggcagtgccctgatcttggcttacttcagcctctgcctcccatgctcaagtgatcctcccatctcagcctcccaagtagctggggccacaggtgtgcaccaccatgcccagataattttttgtatttcttgtggtagagatggggttgcccaggctggtctcaaactcctcaactcaagcgatccacctaccttggcctcccaaattgctgggattataggtgtgagacaccatgcccagcctctttcaactttaaatcaagtatcagtcttagaatcaattctctgtagaatttgtcatatgagtcagtctgctctctatttctatgagtttggcttttttaaattccacatataagtgaggtcatgcagtatttgtcattctgtgcctggtttctttcatttagcataccatggggccaaggacattttttcttttgttttctttttcttttctttttccctgctccagctcaaaggatggggctggggaatctttagatgagtcgggggaaggcctcagtgagaaggtgactcttcttcacatacctgaaggcagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgtgatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctgggattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaatataaaggcatgcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaatataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcccgcctcagcctccaaagtgctgggattacatgtgtgaactaattaacttagtttatttagagccatagcatatggggctgaaaaagaactaagacacttcatttagtctaaccctctcattttacaggggagaataaaaactagagatagaaaattccatagccaaaataaaataaaataaagttatggtccgggtgccgtggctcacacctgtaatcccagcactttgggaggccaaggcaggcggatcacgaggtcaagatatcgagaccatcctggccaacatggtgacgccccgtctctactaaaaatgcaaaaaatagctgggcatggtggcgtgtgcctgtagtcccagctactcgggaggctgaggaaggagaatctcttgaacttgggaggcagaggttgtagtgagccgagatcacaccactgtactccagcctggtgacagagtgagactctgtctcaaaaaaaaaataaaataaaaaataaagttatgcggccagtgtcacctagctggtagcagagtggggactggaacacaggtctctggactcccagtctggtgctttctctgctatgccacattgcttccatagaaccctcagtgcagcaccaggtgggaataataataacaacaataaaggcttatttgactcttactttgcgccaggcactattctaagtacacatatttgctcattttatcctcatgacaaccctatgaggcaggtacaattattgtccccatcttgcggaagaggaaactgaaggagagagggataaagccacttgcccagggtggagaatgagtgtggtgtgggagacatgggcaggaggctgctgccccgttacactgcacgacctgcttctccctttatgtaacagggaaattgaatccagtcgttcaagtcctttttcagccttcaaatttgcagaccctaaatgcttttctattatcgggtcttgaataaataccattccacttcattaaaactgctgtctttttaacttgtcttcatcttaatgatcatctacaagaaagactatttgcagaagagcctagaaaccaagtcaccaagcctgtgagagattcctgaaatgttatttctggcttccatagcaaccctaacatagggcgttaagcttaacggagtcagcgagagcagctggagccgggcattgaagcgctgagagcgctgaggaaacaaatcgttggctcaatagttttccttttgtgtaatatactgtcccagtgtgtttagggagttacgacttctgccaagtaagaatggaggaaatgaagcattgtatcaaagtgtacagagtttccaagcaaattggaggatgagtacaagtctgtgtctaggggagtctctgcagaagatgagggtgggcctgcagagacgtaggggtggggaggaggggcagctctgctttccccaaccttgggtgactaggccttcaggtcagctttgtgaagaggactgagcatgcctggttgccttttctgttccaccccgtttgccgacctcagtagagagtgggggtgatacgtgagtgaggcatcaaagaggccaagatgctgaggatgacagaggcagatatgctgaggctgacggagccaccagggccagtgcaggaaacagagctctctaggtatttcaggaagaaaaagatttaacacggggaattcggttatatagttgttggaagggctggaggagtgggagcccagggaccaccacgcaagagcacctcactgggatcaggatggtgctgccaccagaactgacgtctgtgcagctgctgagcagacaccagaacacgaagtctggctgccgcaactaactggctttctaaaaccttgcttgctggcagagccaccatccaccccacttcatcctttgtgaatatattgaattggggttccccaattcttacccagaaccctagctgcctgaaagatagtctgggaaatatttgttttgtccttttagcttctgcaacgctggaagactcatggggagagttgggagttcatgccaagtgccaatggacatggacagcaatcgattttttttttttttttttgagatggagtcttgctttgttgcctaggttggagtgcagtggcacgatcttggctcactgcagcctctgcctcccgggttcaagtgattctcttgcctcagcctcccaagtagctgggattacaggtgcacaccaccacacccagctaaattttgtatttttagtagagacggggtttcgccatgttggccaggctggtcttgaactcctgacctcaggtgatctgccttcctcggcctctcagagtgctaggattacaggtatatgccactgcaccctgccatttttttttttttttttgagatggagtctcactgtgtcgcccaggctggattgcagtggtacaatctcggctcactgcaacctctgcctcccgggttcaagcaattctcctgccttagtctaccaagtagctgggactacaggcacgtgccaccacgcccagctaatgtttgtattcttagtacagatggggttttgccatgttggccaggctggcctcgaactcctgacctcagccgatccgcccgccttggccttctaaagtgctgggattacaggcatgggccaccttgctcagcctgatatttatttcatttgaaatttggattaaataggtagaggagttgaacaccaaatagagatgagttgaaagggcccatcgttgacctaaactatttgctccaccatctgaaagtcctttgggattaagtccagggttagataacagaggggcagaaactcaactcccagagacaaaggagtggccttaacattctctctggtgccttctctattagtatatacataaggaaacattaatttacacccaagagtaggctgggagcttggatgggaggggaagcagggttgggggtcaggcctggagagattggctttgggctgggccatagatggagaagactgaagtctgggctgtcaggaacccttagaataagcctaaaataggaagggcacatctaaaacccttcagtgctcctcgtttgtcctaataaaatccagaccttttttttttttttttttttttttttttttggaacagggtcttgctctgtggcccaagctggagagcagtggcacaataatggcttactgcatcctcaccctccagggctcaagccatcctcctgcttcagcctcccatgtagcgaggactacaggcctgcaccattacacccggctacttttttttttttaatctattgtagagagggggtctcaaactcctgagctcaagtgatcctcttgcctcagcctcccaaagtgctgagattacatgtgtgagccactgtgccctgcctgaagtccagacttcttatgcaggaggcacatgccgtccacccacatggccctgtcttccccaacttgtcctttaggacccagccttgccacatcacctgtggttacctgggtgcgtgtgcatcccactctgttctggcctccagcttttgcatacgctgcccttttacctaaatgcacaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggcgcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaaccaaaccaaaatgatgatagaattgtctccgaagacaaactttgcctttgctggcacagggctgtggaaccttgtgccctgttatctaactggccccttcctccttgtgtacctacacctcctcccctcctccttccagggaaaggccctgaggcgctgtgttttggggcctccacctccttcctctcctctcttgcagcccagccctgtgttgctatttattcacaggtctctgctctgctctggctttcacttgctgaattctcagaaagcagatgaagcaatttattcagttaaagtgcccctgtgggtcaaatgccagcttgctttttaaaaccttcctatgctgctttttactttgcagagagcagaaattacctgttttgtttcctggtgctttctgcactctcttgtattgagggatggttgtgtgtctgtgtgtgtgtgtgtgtctgtgtgtgtattacaattttaacgtacatgtcatttctcaatttgagaaaggaagaaagatagtgagggggtttgatagagaatatcaaaattattttgtatgtattcagtcagctcattttttaaaagaaaatgttttaatatcactggctatggtttttattttattttattttattttattttattttattttattttttgagacagagtctcactcagttacccaggctggagtgtagtggcgcaatctcggctcactgcaacctccacctcctgggtttaagcaattctcatgcctcagcgtcccaagtagctggaattgcaggcacgcgctacaacacctggctaatttttgtatttttagtagagacggggtttcgccatgttggccaggctggtctcgaactcctggcctcacgtgatctgcccaccttggtctcccaaagtgctgagattacaggcatgagccactgtgcctgacctgactattgtttttaattttaactttaattttaagttcaggggtacatgtgcaggtttgttatgtaggtaaactcaggtgtcacaggggctggttgtacagattatttcatcatccaggtattaaatctattacccattagttatttttcctgatcctctccctcctcccaccctctgatgggccccagtgtgtgttgttcccctctatgtgtccgtgtgttcccatcatttagctcccacttataaaaaccactgtttcacagcttatttgtacttctctttatcaattaagaaaaagactgtttgtatagcaaactccgagagaggacgtgaggggtattttttggtgagacttgagcaaactgctttacgttgcaaggaaattcaattcattggaaactttttcctccaggactaaactggggcagctttcattttggctctctcacaaagaaaattgtccagggtctggaaaccacagttgttgaacctcatatgacgtctcttttctttcagctcatgcaacatttactagaggagactggtgtgatgtggcgtgtttttcctttccttttttttcctttccattttgctggctcgttggtgcacacttcctgagggcctgagagggctgtcttcctggaggaatttatgacagtcagcagggacaactgaaatttgagctggtgtgaacccataatccctcagggccctactggctggagtctctttagggagcatccttgctacccaaagatgcacacccattccccagcaccttcataaaacaacaacaaaatcttaccatggcattgccaagcatattttgcatacaaacttcccaggatggattctatctccatgggcagatggaatccatcccgaaagcatctttctctgccagcacactcacctgtctctgctctgcaaatgcccttcttggtagtagcttgttcaagggtacgcagagcaaatttggcaattctgaaatttcagcttttgtttgtgaacttcggctctgctcaggaagaacttgtcagaatgaaggttgacattcagcctgtatgtcgagcattcttgagagaagcacacggtgcctggcatcttgaatggcatcagctgcttgctacccagttctttgggacaagtgggtccatgagagaaaatatacagagcagggataagactgcacccgctctggcaggacagggagcctggctaccccaacttccttttcccaagccatctgctacttttcttcttctgcaaccaggcattcaaagcagggtgtatgtgggggaagaccctggaaatcacctccatctgggtgtacattgttacttttatcctcagtagttggtcaagaagtagagtgtattctctatatatctttattgggttcatccccacttattcagaagtagaatctctaggccgggcatggtggctcacacctgtaatcccagcactttgggagactgaagctggtggattgtctgagctcaggagtttgagaccagcctgggcaacatggcgaaaccctgtctctttcaaaaatacaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctcttaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggcgacatcactgcacattaagttactcattgggcttactgtcatcacgacctggtgctgagaaggcacatttgaactccggtaggtgcagcagatgaatcactggggcctgagcgatgcctcccagggcactggcctgggcagagggtgaagtggggagatttgcacttaggcgactgtgtcttgagttgagctttatctcctgggtcacattccaggctcagctgccagtcaatgtgttatctggtgatggggagggtaacagggctcttcactcttggccacctactgggagcagtgggtaaaaatgcaggtatgagagtcagaccaacttggggtttaaatccctgttctgccaccactcattaatcccctgactgtgcacttgtcacttaacctccctgagcctcagcttcctcatctacaagtggagggtaacagtgcctatcttctttattttctgaacctaattgaatgccagatatatctgtcatgcatatgatctgacaatggaacagaatatttgcatcaggagacaaaagagactccaggctgtatgattgccatattttcaaggccactcctggtttgggggaagaagatggcaggacatcagaatggggtgccctgccactatcttcttttctagacccttggcagatggtctctcaggctcacataaccctagagacagagttctcaaatttgttgtgcttaagaatcacttgtagcaattacaaatgcagattcctgggccttaatcccagagattctgattccctgggtctagggtacagctggagtgcagtggtgcgaccacagctcgctgcagcctctgcctctcaagttcaagcaattctcctgcctcagcctcccgagtagctgggattacaggtgcccgccaccaagcctgctaatttttgtgtttttagtagaggcagggtttcactatgttggccaggctggtctcgaactcttgacctcaagtgatccacccacctcggcctcccaaagtgctgggattacaggcatgagccacgatgcccagccgtccccacctctttctgatgttatcgagctgtcgagtatcccagctgcaacctgttctttattgtgtctctgctgaccagcgttcccagcccattccagctcatggcagggtatctgcaatctttctcttccctgccctcccaaacccccacccacaagctttacctggaagctcatgtacacaccaaagggaataagcaaggacccagacaggcagccaggtgcctggcactaggccgggtactagggattcatagaagatactgcttgtggccaggtagctgcatgtgtgagatactggtggaagacactcagacagaggtaagcagggagtgttggggctcagaggaaggccactgaggccagtggagaatggcccattaaggaaaggttttcaaaataggtgaccacagggctgagtcttaagctgaacagggagcagagggcatgcctagcagagagggcgctgtgtagggactacagacaggcagtgtgacattgtataaggtatagggcagggagtggtggctggtggagaaggctgagttcatgagttcattctcccctgaacatcagcaaccttgccattagtgacccttgggatggtggcttttgaagaaattgctttgatggaatagctccccaagactcatggatactgggagtttatgtatgtatgtatgtatttatttatgagacagagttttgctctgttgcccaggctgtagtgtaggggcgtgatctcgactcactgcaacctctgctttccatgttcaagtgattctcctgcctcagcctcctgagtagctgggattagaggggcacgccaccatgcctggctaatttttgcatttttagtagagatggggttttgccatattggccaggctggtcttgaactcctgacctcagatgatctgcccacctcagcctcccaaagtgctgagattataggcgtgagccactgcacccagcccgatactaggagtttaaagctgtcatttctggttcttgggactcagatcaatgaaactcactaaaatattcattcatgggaaagttctggtagaaaggggaagattaaagtccatttttgtcaggagagtctctctctgggaaagccattgatgagatgactggggcataaggtggtgtggtggtgtgtgcctgtagtcccagctactctggaggctaacttgggaggatcacttgagcctgggaggcggagtgattgggagtaattggaaagtgacatctggaagacaaatcggtttattttcataagctccctccagtctatgggtgatgggaaattggggtgctgtgtcaagaggaatcctgtggttggactttgattctgagaccaggactgattaggggtgtcggtcacagatgccagggctggggacatgggggtgacatgcaaggcttggacttgccatcctggctccatattttatcatgggaccagctgtctcccttcctttggtttatgcagttgatttcgaaccctacgtgcagggcttgacatttttaccaattacacttcatcttactagtttctactcattattccatccctcagaaaccctttctgggcctgtctgtgttactcagcttattaacagttcctcccagcatcgtatgcagtggtgtagggagaaccataaatgcctccagaatttgcaaaaatgtttggaaaatgttaccaagtgggaaatgatttgctaatgagttcacaatatgtcttagacccattaagtaatccagggtgtctccctaatatagtagaagcaagttttcagaatattccccagcggttttttcagaaaatgtgaatagagcacgactgagtcaaagaaagccctagctcatcaactgcattctacagtgtcaggcctcatgtgatgccgcagctggcgactgactaataagggaattggagaggggagaattgattatttcctggacaaggaccatggtgccttaatcaagtgccctaaatgcaggggactgcaggggaagtcgcactgtggtaaaaaaaaaacaaatatagtctaaattacatctgaagtagcctttcaattacccttaagcactgagagctggtcacagtctggaggcacacagggacagaagcacctgaggaggctcaggggccgcatctcaggtgtctgtggacatgcccctgagggagcacagtggtgggtgggatcccactgctgtgtcgcacggtcgtctttgctctcagtccatctgtctctctgtctctctttgacaagcccatgtagttcaagtctcataaataaaatgcgtacagccggggttcccaaaccccatgctgtggaccgatctcagtccgtggcctgttaggaaccaggccgcacagcaggaaatgaatggcaggtgagcattaccacctgagctccacctcctgtgagatcagtggcgacattccgttctcacacaagcgcaaaccctattgtgaattgtgcatgcaagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccctcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgttgcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtatgttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagctagttttttctctgtccctttaggaaattttaatcatgtttttaatcatgcttcatagtgttttgggtcacccttcggtaatttttaaaatcctctggttattcctagttctaagaacaattttagctcttggcttactgctactctgtccagcattacccttgtcataattgttggtgatttcaagatccacatgaatcatgaatcatcctttaatagctttgagattcttttctccaatattcttgtcttccaccagatctcagccactcacttctctctctctctctctctctctgtctctcttttttttgagacggagccttgctttgttgcccagattggagtatagtggcacaatctcggctcactgctatgtctagcctcccaggttcaagcgattctcctgcctcagcctcccaagtagctgggataacaggcgcctgccaccacggccggctaatatttgtatttttagtagagacggggtttcaccatattggccaggctgatctcaaactcctaacctcaagtgatccaaccgccttggcctcccaaagtgcggggattacaggcatgagctactgttcccagctagatttcagccaccttcttctcttatcttgaccctataattacagtaactttattcctgccataatttcagtttaaacctcctatcttcccagcttacctgtactagtattccaactccaacaattctgtgaccttatctggacttccagttaattgatcctgctattttttcactgtctttcacctcaattcctctatttcctgcttccccagcttcaattctatagggaatcactatagtcactgtcaactacctttgcccctttcctgattcatcgttctcgtttggctacatgataacccttgttaaattcaacttttaccagcctgccccccatatctgtgtagctgaatgtggctgtagcaaaacatgcaaccacctggattggtctcatgtaaatttcataattgcagcctttaagtaggcctttaatgtggcctggaaatcatactctagttccctaatcccttcactcttccactgtcctagaaactgttacagttttttttcacttgtgttattacatttttcatggttctcttgttaagtgcccacaaaccatctgctcgtgggaactttgctgggaattgatatggaacatcacattttctgaaatcaattttcctgggtatttgactactgtccagactgtagtccttctattccccacagcccctcaaagatcggtgacctctctctttccgtcacacctgtcccgtccttcattctccccctggcccttgaccgtactgaactctccgtaagcgcttgtcgaggagtaagaatgggaaccatcagtggcttgacttactgggctgctgctatccaggcaggcaagcatctgttttcatcatattattaagtgtttttttttttttttcagcacttggcaggaggtaggcaagtttgggccatagctttcaggccctgagtccaggcaaggaaagaactgaccccagagagccaatccagccctggtgcatcttgagtattctggaaatggcagatctaaaaggacaaaatcatttcatattcatcatgagtatagcttggtggttaagagtgcagactacggagccatcacgatgggttcagatcccagctcctctacttcctagtgataaaagaaaaaactcaaccaaattaaatttaaaggagtttaactgagcaatgaacaatttgtgaatcgggcagcacccagaatcacagcagattcacagagactccagtacagccacgtggtggaagatttatagacaaaaaaagggaaatgatgtacagaaatcaaaagtgaggtacacagcgggtggattggctacaggctggcgtttgtcttatttgaacacagtttgaacactcagtagtgtatgaatggttgaagtacggccgctgggattggccaagactcagctattgttacaggtgcatactcctaagttaggttttcaatcttgtgtacttataagcttggttgcagtttttccacaaagactgaaatatagaagcatggagtcattctcaggccatatttacttcacttttatactagataggagaactcaagcaagttatctaacctctctagactcactgtcctcatctattaaagaacagtaacaacacctactttctaaggtgtgttctttcctactttctaaggtgtgtgtgaagaataaacaagccaacacctgtaaaccattcagaacaaggcctggcactaattaagtgctcagtaaatattagctataaattacgattattttctcttttgagtctcacaacagtattgtaaggtattattatccctattttgcagaggaagagactgagggtcacacaggttaaggagaggctcaagatcatttggacagaaagtggcagaggctgggcttgcatgggatcataggactctaatactgtttcacttaggatttcagagccccctttggtctccagatgaaatgattttacccttgtcatggagattcatattcattccttctccaaatgtgtcctaacttccccatgcagatggcaccaaatatttacagtatgattacactgccatgattgaatttagccagaacgggagagaggctgattagtgacaaggctgcaatcttgagaggaggaaatagttctgatgttgcacattgtcattctgctggagtaggaatgttgcttaaaattgtcctggctcagttccctttctctggaagagtaaaagacactcatttgcccaatacatggactttggagtcaagctgacagtactggaagagctgttaacagagtccagatcatcactttatggttagagggatgacgttttattatgggcccacaaactgtcctccaactgtggctgaaaaccctgtcatgagaggccagaaggaagatcattgtatgttcttctcccaggccaaggagacaggatgtccttcatcagaaccagttgtcagcataagaagaacacacaccaaggaaatccatttcctggaaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgagtcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtcaagactttatagaacttcttttctccagagagctctctatttctttgacctgtgtgtgtccctagaccagtaatattgacttcaccagggagcttgttagaaatggaaacctacagaatcagaagctctggggttgtggtgcactggtcttagttttgttctgttttgttttgtttttgtttttgtttttgtttttgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattatttttttttttttagtagagatggggtttctccatgttggtcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttggtgttttcaactcagaattacagctttcttggaacctccaacaacattttgaacctttgtggcgtttttgtacatgtgcaggtgttgtggaaactacccatttgttttgaagggagagaatccagtttagcacacaattctccatggaacttccaggcttccctttaaattgattgtgatgcttggatagatattgacaccatgactaagacccataataaaggcccaatccaaggaggctctgctacttccaaagatctccaaaggaagagagttctcagagtgcgagtcttgtgtgaatttccctcccttcaaaggtgccttaattaatatcctcctccatggcagggtctaagcctggcccctcttctcagcaggtaaagattattgggtcacactctccctgcagtaagttcagacatgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgccttttttttttttttttttttttttctgaggtggagtcttgcactgtcacctgggctggagtgcagtggcgccatctcagctcactgcaacctccgcctcctgggttcaagtgattctcccgcctcagcctcccaagtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggatttcagttcctctcacctccttgagcaggtgcctgtgtgcagcaccaaccacatagccatagctgtaaccctgcccctacccagcctggggctggacacgagtgagggctgatggaggggtggggagagcctgtacatgcagccagcacacgtcgggagttcccaagtgctggatccttcattacatcatttccttaaattcttacagctgcccaacgaggtggatattggttgcacctctgtatatttttttctttttctaaattatgaaagatttcaaactctcagtgctcccatgttctcatctatgcaatgggtatgatgcttcttgatcctttctcaaaaacttgttctgaaaatcaaatcacaccaagtgacaaagtgctctggaaatgttaggtttcatatagatcttatcgctgaaccctcaaaggctcactttctggggcctctgttttgagacactcaccctggactcacccagccctcagggttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcatgggcctttcccacttctcatttttatgactagctttactgtttcattttggctttctctctctttcttgcagctgtggtgattaggatttagggcaagcatttgggatcccttttctaatacctttcaaatcctgattcagctgcaaagtccgggaagggagtagagaatgggggaggagggactcaccctggtgaaaggcagtagctcagaatatccgagaaactcccaacaggaatgcccagcctccacccactaaagctggaggcctctcatctcatccaatatcaccctcgtactagaaacgcaaaagggatgagtttgtctatggactcaaacctttacagtcttcttgcttagcagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattgtgtataccatccatcttgcaaaccactgccagactctgttgacttttcattatgtaacttccctatgggagaggtgagttacataatatgatgctaagatgcccctcactggtggcatcatgtacatatttctcagtctgaaaggaaaggtctttttaaactggcttcaggccatctgtccaactaattcctgcctgcaactcctagtataccctctactacaaggtctcatcacttattctgttacccaccacattcattccgtcttgggctttggttcatgtgatccactcgatgtgctccttctctctaatccaaacaccacgcatctataaggtcagctcacgtcccatctccttgaccccagcccattcatatccctattctcttagcagctattgtcaggacgacacagttttcatgccagttattctttcatggttttattagttaattctccccaggtagattagaagctccttaactttggaccctgtcctaagcttctgttatattctctgcagtgcccagccaagcttatgtgtcatgcagtaaagaataaaataattttgaccctgatcaggtgtttggttacataaaaactgcattggcaactttctagaaactaatatattcatttatcttgcaaaaaggattgctatctgattatagccagtagtcatgatcttccagccatgcacaaatatacccttataactttcatgagtggggaggaaaattgatgaaggaggtttcaaaggtgatcatcagtcccaggatttccaacaatagccagtctgccctgggtccttaactctcttttaatgtttttattcttatttttatttttttaatgcagtctcactcttgttgcccaggctggagttcaatggcactctcttggctcactgcaacctgtgcttgctggattcaagtgattctcctacctcagcctctcgagtagctgggaatacaggtgccgccaccacacccggctaatttttgtatttttagtagagacagggttttacagtgttgaccaggctggtcttgaattcctgacctcaggtgatccacccgccttccaaagtgctgggattacaggtgtgagccaccacacctggcctctcttctaatgtatttgacctctcctctttccccagagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcagtaagtcctgctcctttgtcactcttctagaggaaccactagaattcattcattcatcttcaagtgttcattctgtgttactatgtcccaggtactgtgctggcaataggttttcaacaaaggccaagataaacacaacgtgctccaggggcttacactttggccaagagacacatgtttttatttatttatcttttagagacagggtcatgctctgtcacccaggctgtagtgcagtggcatgatcacagctcactgtaacctcaaactcctgggcttaggtgatcctcttgccttagcctcatgagtagctgggactacaggtgtgcaccaccatgcctggcttattttttaactatttgtagagacaacgtttcgccatgttgcccaggctgatctgaaactcctggcttcaagcgatcctcctgcctcaacctcccaaagtgctgggattataggcatgagcacccagctaagacagacattaaatatataattatacaaataagtaactatagttgtcacagtgtaatggaggaagaattcaggacatgaaggagtgtgcaaccccaggaccttatctaggcctggatgctcagggagattgccctggggaagggacacgtaagcccaaaccacagaatgaggaagagtagatagacagagtttttcttcagcacatggagctgccctggaattccctaagttggaattcatgagttggagtacggataggaatggaagggcagaaaaagtaacataatctctccttggatggtgtggaataccaaggcatttttgccccatggtggtgctggcaggggatgttttctcagctgacaaagaggtccagcgtatacagaggaccaaggtgtggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcagggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattctagacctctaagatatagcccccagcgaagaacaatgtgcttttgatgtgtattaaacaaaatcccctgctgagaactaacttcaaaaagcacagagatctcatttgttcttgactccggaatcaaaagatttacttaagaaatcaatgccatgaagaaaaaaagaacctttttccttgccatgccacttggaaagtgttcagaagtgccatttccctggcactgcagaggctgtgttgttgtggtgtgttgtggcctaagtcagctggaacacttcaatcagcagaacacactgcaaacattttcaaggtttatgactttaaatgacttctgcagaatttatgtttcccctttcctgaaaatattaaaagggaaattggttctgtaaccattttgacagcttattcatttgtgttggaaaattttaatggaggggttctttttataagccttctgtatttatcagaaaatggaaagataacatgataaggctgaggagctacacaatgggactgaccgcccccctccccccacccccgcaatcctggtgtcgaataggatataccaatgtggacttgtctgtggaaaaaccatctctgtgtgctttctggcaaggcagcaaaatgaaaaggcagtttggacttttcctcccttcatcttctttgttataatctggaagctctaagaaaacattagcgttatcccgcttgttcctgtgcctgagaaatgaatcccctgtgagtccccccatccactctgcaggagacagggctgctgtctctcactgcactgcactgcccggctttgctcagcagactcagcagccgtcttgaaaggctgaagaggccccagggcctctttatcaacttcatggtaaagactgtagtaactaacatttataaagcactttcccttatgttatcgcagaaagccccaggaggcaggcagcacactcttgccactctctttttacaggttaaggaacttgctaagtgaatcacctgaaaaacaaatagccaagagatagttggatgctaattccaaacctcttgctcatttcactcctctgcatgttgggaattacaaattcctcttttaaggtaaaccattttctggtggccacctccacagtccagcctggccaggtaaacctactttgcaattggcattcacctaaaataggtgaaactctgaaggcagccttcgtaggaggaagaggagctgactctagttgtacaatcttgagcaaatcctttgtgctctctgagcctcagttgcctcatctgtaaaatggggattttatatgcagaaagtagatgagtgaacaggtgttgtaaatggtagagccctattcagtgtgcactgtgttatgtattattacaatcaaatacactgaggaccgatgggctaggcagatggcctcagttttgatctgcactcaaatgatcagacaaaaatggtgagcattttccaagttgcagatgacatctctgaggtttgggaagtctcatttgttccttaaacattcattgaacctgtaaaccaaaaagtatctgagacaagtcccaatcaatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaatcatgtattcctctagtgctcagtaaatcaacactttacataagataaggtgaacatagagtagctacttatgcagatatttaaccttttatctgtagctatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctctcacatcagcctcccaagtagctgggactacatgtcactatacctggctctattatccctattttacacaactggaaattgtcagggtctgcctgggggctccaggagagctttaaagatgaggtgatactaataatcactaacatttcttgatattaatgtatgcatgtgttgtttcaggctattagtgtatgttaactcactttattcacacaacaaacctgtcaagtagatgctcttatagttcccattttatggaagaggaaattgagaaccaaagaggttaaataacttgtccaaggtcacaaacctgtaagtgctggagcttgtttttttgtttttatttgtttgttttattttgttttttgagatagggtctcactctgtcacccaggctagagtgcagtggcatgatcatagctcactaccgcctcaaagttccatctcagcttggactacaggtgtgcgccgccatgactgaataatttttactttttaaaaaagaaacaatgtcttactatgttgcctaggctggtcttgaactcctgggctcaagcagctctcctgcctctgcctcccaaagtgctgggactacagacatgagccactgtgcctggcctgtaagtggtagagttgagacgtgagcctaggcattctgcaggcagaactgaaaatcaatgctacatctgcagattgggacaggttctgtctgggtgtgatcaaggcaggacctttatcatacagtgaggaattgattagactctgcagccagacctcgctgggtgagagtcctggcttttttctctttggctgtctggctgtacaatcttgagcacagtggaggctttatacttgcaggcagggacttcccataccagccacagcaaggggaatcctgaggttgcattctcaggccacccttgagaccaccagggagaggccaggtgccctgtgaattgaggtcctgtctacaagatgaccaaaccccacacatcctggagtctgccatttttgccacccagtaagagaaaacatggaatctatgggctgaaaacgctgtccccagtgttctggtgattcttgccacctgggcgagattgcttttaattaacctctaggtgctgactttatcagcctcatctggtattttggagcagggagccaggctgttcctaccctaatagccccaccccacccaggccaggcacaatttaaggccctaatagtattcctaggacacacccttcatgaactggcctgggcagtctacactgatggcacccctttgaggtcctgatgtgaagtggggaggctggactgacttcacaaacgttgagtctactgtgcccagtaatacaagacctccagcccacctccctacactgaccactcctttagtcattcatacaatcattaaaaaaaggactgttcttatttcctagtcaacaaatccaatcccaccaatgacttaggctgctgattagttattcctccccgctgaacacaaggccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatccatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttgttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaactttttttttttttttttttttttgagatggagtcactctctgtcacccaggctggagtgcagtggcacgacctcagctcactgcaacctctgcctcccggtttcaagcaattctcctgcctcagcctcccaagtagctgagcccaccaccatgcctagcttatctttatgtttttagtagagatgggattttgccatgttggccaggctggtttcaaactcctggactcaagtgatctgctcacctcagcctcccaaagtgctggtattacaggcatgagccaccatgcctggcctaatttccgcaattgataggtgaagaaagtggagttcagagaaaccaagtcatttgcacaaggtcatagggagtggcgaagctgagccttcaggtggtctatttccggtagccatcctctccccacgatgctgcctgctgcccgccagatattttctctgcctcacatctcctgtcttcttattttgtctgttagggtctcaccaagaagacaggcaccaggtacatcacttgggcctcccactcatgacagtgggtgactgccgtgtagttggttgcctacacactacacttccttaattatggagagagacagtgacatgctgtgagtgccttagaaatgtcctctgcccgtgggtaatttgactccagcagtccaggaaaagaagagagtctttcaggatgcaaagcaaatgcaaattaaaagtgggataatgattacccctcaccatacgattgtcaaaacttgaagtttgataacaccaagtactgaagttttgaggggatgggaatcgttaggaccatcgttgctgacatgagctgtcttggaaggcaatcaggccatatctgtttaaagtgagacccagtcctagagaaaacatcgtacatgaattcaaggggacgtgttcaggaatgttcatcacaacactgtgaaagtgaaaacttggaaaccacccaaatgcttaccaatggggaaatggccaaataaaatgaggaaagtcatatgaccaatggataaaacaattgggagggataaactagatctaaggttttgattaaatctttaaatctaaaatacagctagttttcattattcacaataattatgttttataaagtcactgcaaacactgagttagagaatactaaaccattgctccatatattcctgatggaatatagggttaggttcctgcaatcctctggtgacaatattttttgtcaactaatcaatacgtagccttgttttatgtgtgtttctgtttaaaaacatcttattttttgtttgtttgtttattttttgagacagagtctcgctgtgtctgcagtggcacaatctcagctcactgcaacctctgcctcccggtttcaagcaattctcccgcctcagcctcccgagtagctgggattacaggcacctgccaccattcctgactactttttgtattttttttttttagtagagacagggtttcaccatgttggccaggctggtcttaaactcctgacctcaactgatccacccaccttggcctcccaaagtgctgagattacaggtgtgagccaccatgcctggccgaaaacatcgtatttgatatataccattgattcattaacatcagacccacagccaacggtaactcctgactgaatgaaacttacctaacacatgttttccctgtaaggcacatcgcagcctttctgcactgaggaacactagacggcgcatcaccattttaaaccgcaaaatcacttacagaaagcacagaaatgaaaaaacaaacaaacaaacaaaaaaaccacggtgctaagtagactgtgaaaaggatgcttgttcacagaatgaaagctgaaaaagaaggcagagtggctccttgttcaacctcagctgagaacatctgcaccaggcaacacatttttttgtagtctcagctacttgggaggctgaggctgaggcaggaggatcactggagccccggagattgaggctgcagcaagctgtgactgtgccactgtactccagcctaggtgacagagcaagagcctgtctcacaaaataaactaaatttagagatattttaaattgagtgctcatgcactctgagcatgtccactagtgaccgtgaaaacgctgtgagtattggtttgggcttacaaatacattttagtgagtaggcaaattcacaaatatggaatctgtgaagaatgaggatcaactgaacatgtcttcacagtttgatatctctgaaactggggtgcattttagattccatgaaatacagtacatgtatcaacattgatagaatctgtgattaacgttgagtgaaaactgaggtgaaggtcaatgtatataggatgaacctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatagtaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtagagacataaacttcagatggatttaatcacagctgagttttcacaagcgctggattaatggaattgttctaagcttttgagagctccttttattttagcttcataaaaatatatttctacatatagacatcttttttgtttatgagaacacttgcataacttgttatgtttgtactgttgcttgttaattttaaatacaatcaagttacattgagtaaagtcataaattaggacattaaaaaaagagaatttttatgagctacagacagacttatgcaggaaccaatgtaccagaaagctgaggtacttcaagaactaaatgcagagggcaggcgtggtggcttatgcctgtaatcccagcactttgggaggccaaactgggaggattgcttgagcccaggagtttgagaccagcctgggcaacatagtgaaaccctgtctctacaaaaaaaattttaaaaattagccgggcatggtggcacacgcccatagtcccagctactcaggaagctgaggtgggaggatggctttagcccaggagtttgaggctgcagtgagccatgattgtgccactgctctccagcctggaagacagagcaagaccttgtctcaaaaaaaaaaaaaaaaaaaaaaaagaaagaaagaaagaaaagatgctaaataggtatcttaaattgagacataaagattacagaaacatgaaacgtgtgagtgcattttttactccaaaattgtgtgtatacttttgcatattaaaaatttacgttactcttgaaacatgattttgagaaactgttggttctttaacacattcttgcttatttaatagcttttcctccagccccattgctgcttcctaaaaatccacacttaagtcaaagtcccctctgatgctggcaaacttttctgattccccagcccaccacatgggtattattaagttgaattggaaatttcttgcttttttttgtagatcaaaaccaatcaagtatcagcaatttcatatagttcagcctaacactgtttctctttgattttccatggccctttatctggccctgtcttgtccaccttggactgtgagcccccttgagggtagggactgcagcttatttctctgagtcctgcccagaggagagagtaggcactgaataaatgcttgctggctggaatggagtgagaaagggcatcactgttgacttaccttcctgtgtcttccctttcagcggcccatatgtgcagcaccctggagcataactgtgcccacttctgcatcaacatccctggctcatacgtctgcaggtgcaaacaaggctacattctcaactcggatcagacgacttgcagaagtaagattgctttgctgatgtatttgtggtttcttcctattccctcatcctctcccttcttttatctgggctcattttattcatctgtgatgcctcacccaccccagttatcatcccttggggacagaaataaagtttggtattttctgttgaccccatcacagtgcctagtccagagctgggcacatagtaggccatcaggaagagttggagagataggtagaagcaccatctcagaaatagcctctttggatgtgtgaactggtctcctttacttccaagcttgttctttagcagggactactgaagagccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctaccccttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtgtcacatttatagaggccaaccacctttttcatgtttcttctcactgtttttcagttttggggttgagtggttggctggagttctccctgcccctcaagattaggtaacatctacttgaccctccgcttctgtgtggcctgtggaaacccaaagccctctggactctgaatcgcaggggtggggtgggcggtatgtgttcttagcctcctctaagaccccaggatcccaagttgagtgcagcctgaatcatcctcatcttccagttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacctccccacaaccatcctctggaggcacccttcctcctcttcaggcatcctcccctctgccccggatgcttctctgtcccatctcagcttcccaccatcttgcccactcccttcctgccctttctccttctccttctctgtctccttctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttcaagcagtcctcccacctcagcctcctgagtatcagggaccacagctgcatgccaccatgcctggctaatttttgtagagatgaggttgctcaggctgctctcgaactcctgagctcaagtgctccatctgcctcaacccccaaagtgctgagatttacaggattgagccgctgtgcctggtgcccttctcttcttaggagcacaaggaattcctctccttgtctcatgtcccactgagtgactgggatctgggaatctgctgatatttattttccgtgggctggcctagccaagccagaggaattctgacaccagcaaataaaaaataaagtgttctttccctaattttatgagcaaggccttcccccacacagcagagtttgccagacccctgcctggtcctgccacaggccctgatgtcccccagatctcaagtactgctctggccttggattcctcctgcctagggatgtgccacaggagaatatgaagcagaccctgcctggacttcagacagactgaccagggggaggggcagggaggtccaggcggaggagggctaggagctcagggcaggctttctcaaacttcagtgactaagaatgagccaggaaactgacttctgggctcacccgcagagatgcagagtcaacaggtctggattttcaatgaaccgacgaatgactgccacactttgagattcactggcctcaggcagtgaggggtcccagggaagggcttagcagagctctgctgtcccgtctgacccagctctccagtcaccctgaagcagttaaaccatcttaaccttcagccagacttagcttaataaatgtgcagtgataaagaacagctctctctctttcagaaggggataatactaataactcttttgctttcccaaaattggtgtaccaggggccttggtggaagaacaaggccttcactgtctgcagatctgggcttgaacccgaccttatcacttaccaactatggctgtctcactctgagctggttatttaaacttcttgactctcagtttcctcgcccataagatgggacgggtggtaacaaatcaatacctgtctcactgattatgtccttgttaggccctgtttttggtctaggggacagttaaaagctgtgccaagtgaaggctgtgccatctactgacccctgctgatgagcagggacctgtgcctgccaacactgagagaaactcacagtgggcctggagaggaggcatgtactccacttctggaagctgtttccacttaatttccatgtcctgggcgtagctggataatctcccagatgaaaagccatgtgggtgacacctcctccccaaagcacctcttactctctaagaagtgcttgccattcattcttccatacaatcattgattggttcatttattttttcatttaacaattgtttttgagcataaaaatgtgccaggcagcatgcaaagtactggaaataaaatagtgaataacacagcaatattctttcttttttggagctcacatttttgcatgggagtgaatcaaataaacaaccagggtaattgcaaccaaaagtgactgcaatccacgtccacctcagtgtgcaacacatgaggtcaagcctaactatagccacttgttaggtgtttaccatgtgccaggagctttcctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcactcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatagaaaaaaaaaaaaatatatatatatatatataatctccccaccattgtatatttgtaatttgtgtggagagggaaagcagacacagttgatccacacattctttgaatggtgatggaccttggctattagacttctggcttcctctcttatggaacttcagaattctgtcccctcccagtgtcccagaggggtgatggttcttacagaatcaggttattacaaaacacctgaatcccatattcagacagcttggatcagcggttgagctgaaatcctacttgtctataatttccacttttatcctatttctgctatctgaagccatataccaaaaagttatttccttatccaaataaatagagaaagcccttcaattattatacagtgttattcccacacactgaccccattcctatcaattttctcttcttcaggggagaaacacatcttttgatgacctagttttgggtctcttcactgtccaggtaaccctcttctgggtggatattagttgtctaaaaagggcctttccattcgaagactagatcaaatgcattaaagaattttagcttccatcacttcttggccttttggctaagatcaaggtgtagaattttatcttccaagttgtgtctatatgggcaattttgaacatactggacctcaacattgtggattccttctgcctttcaaaaagtcttccctgtcaaataccattatatgagatatatgcaagagcatcagcataatactagaacaatggaattttatgttccttccttttcccatttaaaaaaaatggggggaaagaaaacctcatgaagtgtgcccgtcttcacatgctatttccccttatccttccccttcccagaattcctgtcctactaagaaagaactttatcttgtttctttttcttgatatattttcaaaataaggaattttccctttcttctggaacatttaatctatctggaagctgatgataatgcagcatttagaaaactccatttggcagaaaatgtagactttcttatccagcttaaattttttttcttctctcaagaacgataccaaatgcattttactgctttcattctttggaaatgttcccaacattatttttcccaagctacataagtgatttaatagatttatgttagagtttaaacaaggagcatgacccagaaaaaccactgaattattagagagagataactataaccaacattctttgtgaatttagatgtgaaaattcttaaaaatttagcaaatagaattcaacaatatatagaaagaacaatacatcaagaccaaatggagtttattccaagaatgcaagtttggtttaacattcaaaaatcaatcaatataattaatcatagtggcgaggtgtggtggctcatgcctgcaatcctagcactttgggagactgagttgggcgtatcacctgaggtcaggagtttgagaccaacctagctaacatggcaaaaccctgtctctactaaaaatacaaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataatggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttctcattattcccagtagttatcatccataaaatatccataaacactaaattgcaaattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttgttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaagacagtgtggcattggtataaagatgaacatatagagcaatggaacagaacagaatcgagaaataacccatatgtatgtggtgaaatgattttttgacggagtgggaaggcaatccaatgaggaaacaataatgtcttcaacaaatggtgttgcagcaattgaactgccatgtgcaaaaaagcaagcaaacaaacaaaaggaacatagatcttgtctttacctcataacatgtataaaaattaattgaaaatgtattctaagcctaaatgcaagagcagacactattaaataccatgatgaaatggtagaagaaaaatcttgatgacctcaggttggcaaagatttcttaaatagtacacaaaaagctacaaaacataaaagaaaaaaatcaatatatttaatcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggattttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctgaccagagtggataaattttaaaagattgactataccatgtgttcgcaaaattgggaactggaatgctcatacatcaccagtggtcatgtaaaatggttcagccactctggaaaacagcttagcggtttcttacaaagttagatatttacctatcatgtgacccagccattccacttttaagtatttactcaaaagaaataaaagtttatgtctaaaaaaagatttgaacacaaatgttcacatcagctttacttgtaatagccccaaactgaaaacaactcacatgttgattaacagatgaatgggtgatacactgcaatacacgcatcctgtataatactcctctgcagtgaaaagaatgcactattgaaacatgcagtagcctggatgcatctccaaatcactatgctgaatgaaagaaaccagacccaaaaaaaccagaacataccatgtggttccatttgtataaaatttttggaaatggtgcctactcagtaatgacagagagcagattagtgggtgcttggggccaaggagtggggagcagcagggagagggattacaaagcagcatcaggaaacttgggggggtgatgactatgctcattatcttgattgtggtgatgatatattgataagcccgatttatcaaactgtacacttgaagtatgtacagtttattgtatgccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagagggtgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtacgctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttatttattatttttgtcaacctcattcactcagatttcactgtattttagaacttgtttcagagattccccccttcctccttttcccttccccgaggaaaaccaaaatcttgttagtgaacaggagaattgattgaaaaaaaattcaactgctgcgggaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcgccagggtttctaaaggaaggcacttacatctagggtgcatgggagtctctggggaaactggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttagcatagaactcaaaaaccaaacttggccagagataaattttagaacgttaggatctaatattcatgtttgtagggattttttttttttttttttttttttgagacaggatctcgctctgtctcccaggctggagtgcagtggcgcaatcatagcttactgcgacctggaactccctggctgaaatgatcttcctacctcagcctccctagtagctgggactacaggtgtgtgccactgtgcctggctaattttttaattttctgtagagacaagatgtcgttctgttgcccaggctggtcttgatcctcctgcgttggcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacacggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggcgggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtgacagagccagaccttgtctcaaaaaaattaaaaataaaaaaataaaataaaaatatcttctgtgagacagatgctttgcccatctagattatctcactcaaccctacaaataagatatttaacctttttatgaaaactgaatctctcaaaagtcccttacttgaagtcgttacccagctggggccaagtctggctccaaagtcgatattcttttcacctgcctgcctcacccctaccctttctgaggagacgtaactgacatcctgccctcccccagtggtggctctcttcatcatttttcatgtcacctctttcaggtccaaataaaaatttggagaaggtcaaaatcatcttttcagttcacactgttaaaaatggaagcctgctctctcaccacgctcaactcccctttcctgcttataacgtatcacagatttttacctatttgctttgtttactatcaatcttctatcaggtatgtgctgctaaatgtttaacaatcaggtctccaggagacaaaagctctgatttgtagatttgccaatttccatggtgtaaatactcccaccgtggacatttcaagctaccaacgtggcctctttgaatgcagctgtgggaagagatgcacatcattgtgtgagtcagtacgagctgcctctagcacatgactggcccctcactggaccatcagctctataagggtaggaatttttctgttgttgtccactgattcactgttgttttcccagcactccgaaccgttccatcgttgaatagatttattaattcagtcatccacaaatcagccacatggcagatgctagatatttgaactagcatgctgagcaagacaagcactgtggctgccctatgtggcaggtgaaatagacatgaaataattagttgcaaattaagcattaaattataattgtgttgaggattacaaatggaaactctgagggaggacttcacccctagtggcaggtcagagcttcctgagaaagcagactttcaggtgagtactaaaggaggtatgagagttaggtaggggaaaaggaggtcaggaagaggcttgagcattctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccacggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcgcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagtagctcttggtttgtcaggtcattgacacggaggaggtggttactcccaggtgttgccatggcaatggtaaactgacatgtcacactggtgggtgtgtcttatggaaagctgcttctgccccagccctcaatttgatcctgtgtccaagccctgcctctggagttaagctctgcctctggagttgagtcctgcctcctacctcactctgagccctcttctggtgtgtgaatacctcttgctgaggatgaggagaggcagagagacttggagagaattttgttcccatctcagtcatcttctgaggaccccacatctaatggaggagggtattcttaggactttagggccattcctcctgggaggcagggcatctgggcctttttcattgttcattcagcaaatgaactcttatggagaccaaatacatgtgctaggacactgtgctagactctggagagtcaaaactgaccctcttataatggggcagatagccgtgatcaagtccttccaataccatgggatcagtgccgaaatgctagagcggagccatgtctatagtgctgtgggggcccaggggaagaagccttaactccagccaacttgaaggaggcttcccacaggaggtgacatttgactggggttgtgagccattcatgggggtcaccaggtggagaaggtggaaggctgtgccggggcagggggagctctggacacagtgcttcttatccttcagtgaaatcctcctggcctcagagagaaagaagggctgtttttcaaaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtcgctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagggttcctgccagacccctgatggggcaaggcagcatctgcagtagagattgggaggacccatgtggagaagctgctgccacccttccagagctggttccagcatgctggagcgtcacctcccagccatcaggacttcatgcagggacactgcccacccacttagggagcttagagtctagtaagagagacacagtacatccatcgctctataaacacatacgtagttaacattatgattcatgccaggagggaaaagtgcaggggtgggctgacagccgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccacctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaattccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtgttttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatccgcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagcattctcaggtgtgcctgacgttgtgttctaacatcgtgactttgcctcagtccaggatctgtgtgccatggaggaccacaactgtgagcagctctgtgtgaatgtgccgggctccttcgtctgccagtgctacagtggctacgccctggctgaggatgggaagaggtgtgtgggtgagtatccctccagctgggcttggtagggaaggacaagttaagcatggtgaggaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgaaatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagtgcctggtggatagtaggtgtttcataaactgaactgaatacttatgaggcagaaaatctagaaggaaaagaacttgactgacatcaaaactggaatgtaaattttctgctaaatcctgcattttgtcttccgtgttctattgttttcaggaccctattttattttgcttcgcacaaacagggtatgcttatatttttgcacatagaatttgcattttccagcacaccttaattcttagctagggatgtggaaggcaaaacaaaacaacaacaaaacaaaagttaggtggtagcctgcaattggcaggtgagtgatgagagtatcgtgggtttgtttttacacactgataggaatgaaagcaacctctgcctctgactctcatcaaagggccacaaatgcagctggtctcctgggccttagggttgtttttcttcttaatctgctggtggtggccatgatagagtggcagggttccacacccactaccactagcaaaaaagaagccaacatatatacccatggttatttttgcttcattaatttttattatgcaagtaatacccgttcatagagaaacttaaacagatgagaaaaatcactattaataggttattgtattttctaccagactttctccatataaatatctactttaaaacattttgttggacaggtgcgatggctcacgtctgtaatcccagcactatgggaggctgaggcgggcagatcacttgaggtcaggagtttgagaccaacctggccaatatggcgaaacccggtctctactaaaaatacaaaaattagctgggtctggtagtgtgcccctgtattttcagctagttgggagggtgaggaagaagaatcacttgaccctgggaggcggattttgcagtgagctgagattgtgccactgcactccagcctgggtgacagagcgagactcatctcaaacaaacaaacaaataaacaaaaaacattttgtaaagatttaacaaaatgaggtcacactgtctattttgttttacaacctgctttttcccctctactatttgttaaatgggtagaaactctgagtgctgtttggtcaggaggaaatcaagccattgtgagttaggctggtggaggagcttcaggaaacaggatgagggtaatgggttgattaggacaaggggagggacagtagaacacagggcttgcattggtcacagggagtagatggggcaggaagcccaccttggcccatgggaaactggaggccactgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatgggcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaatagggctatggtgagtacaacgcaaatgatagagaaaatattggccacggaaggtcagagagagacatcctaatggctaggctggaagatctgagtgtggaaggaagggtggcaattggacaaatgtccaaggcagggggagagatgaagggcagtgactgtggaggtggcaatgctcttcaagcattagggctaagtctggcctaggagtggcagggccagctcctgggagctggtaggtcagagagagactgttacagtgaaaaggccaaactgaaagttaaccaggtggcctaacctgagggccagaaggcgcttatcaaagatggagactccaggtaccagacttagagcaggaaatttagaggagaggctggtgagaactctggacatactccattagtagctgatctggggtgccctgtgtgtagatggccagggaacattaagaacagagtgattatgcctcccagttaatacaggacaatcccagtttatgccctgttggcccaattcttttttttttttttcttttttttgagattgagtcttgctctgttgcccaggccatgatcacagctttgcagcctcgacctcctgggctcaagcgatactcccacctcagcctcctgagtagctgggaccacgtgtgtgcaccactgtgcccagctaatttattttttgtagagacagggtctccatacattgtctaggctggtctcaatctcctgggctcaagtgatcctcctgccttggcctcccaaagtgttgggattacaggtgtgagccacctcgcctgatgccatttctttttatttttagacagggtctcactctgtcacccagactggagtacagtggcgcgacctcggctcactgcaacctctgtcccccaggctcacatgatcctcccacctcagactcccaagttgctgggaccacaggtgcataccacacgtctggctaattttttgtatttttggtagagatggggtcttgctatgttgcccaggcaggtattgaactcctgagctcaagtagtctacctgcctcggcctcctaaagtgcagggattatagacatgagccactgcgcccgactgaccccatttcttacccagctggcctcatttcttgatggcacatcttttcactttgaaaggggttccagtttggatgataaattacataatcaccctagttaaggctgtccaatttgacttaaactgttaagttcagcagagaattcctgtatacatgaagtaggagatgaagttgaagacagcagaaggaactggattgttcagggctttgaaaatcagacgtaaagcctagattttatctctgaaaaagagccaccgaagggtttatatttgggtgacaaatgcaaagcttcatttttaggaaactcaacctcatggggaactgcagggtgtattccaggagaaggatggcaagaagtgggaagaccagataggagattgtagcagttatcgggtgagagaggataggaaccagccaggatttgaggtgcaactgtaggaaaggagagggagacagtaaggaatgaaagaaggtgctgtacataaagggaacaaggagaagtcaaaagtgactctaggccaggtaccgtggcacatgtctataatcctagtactttgggaggccaaagtaggaggattgcttgagcccaggtgttcaagactaacctgggcaacatagtgagacccccatctctaccaaaaaataaaaaaattagttggacatggctggatgtggtggctcatgcctgtaatcccagcactttgggaggctgaggcaggcagatcacctgaggtcaggagtttgtgaccagcctggccaacatgatgaaactccatctctactaaaaaaaaatacaaaattagtcaggcgtggtggcagtcacctgtagtcccagctactccagaggctgaggcaggagaatcgcttgaacctgggaggcagaggttgcagtgagccgagatcgcaccattgcactccagcctgggcaacaagagcaaaactctgtctcaaaaacaaaacaaaaatattagccaagcatgttggtgcacatgctggtggtcacagctacttgggaggctgaggtaggaggattgcttgagcccaggagatcattcaaggctgcagaaagtcatgttcacaccactgtactccagcctgggcgacacagcaagaccttgtctcaaaaaaaaaataaatgaataaaattgaaaaagactccatgatcttgagcttccatggctgtgagagtgatggcaacagtgatggaagagtgatggaatcgattttcaaaaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttcagaccaaccaaatctcacatgaactaactgagcgagaaatcacttatcaccaagatgataacactaagccattaatgagagatccacagctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagaagggcagccattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcacccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaactcgtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggggttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggaggtgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagtagcttaaggctgggggagagaaagaagaatcatggaacatgataggaagataatttcttggccaggtcaatattaatgtcatgcttcagcatggccaaaggtaacaggacttagagaaaaagccatcaacttgagtcacagattcaccgctgcaaacatttcagaactctgccagggactttgctaggcttgaggagcacaaaggtgaccaggaggccattgagaatggcaaagggggcatgggtaaagggcagatttcaagaggcagggagtgggtgacaagaaagtgtgggcagcaggttcaaactatttatttaaagaaatttggtagaagttaagcatgtccagctgatgcagggcaggcaagtcccaaagtggagcttagcctacctgggttcttggctttgcccagggaagaattcaagggcaagccagaggtagaagaaaacagctttattgaagaggcagtgttatagctccatgactgctcttgcagagcagggctaccctgtaggcagagaatagcagcttaggcagttttgcagtcatatttatacccactttcaattgcaggcacgttaaggggaggtttatgcagaaatttctagggaaggggtagtaatcgttgggtcattgcccaatgatagtaagggatggtaactcccaggtgttgccatagcaacagtaaattgacatggtatactgattgaagtctgattgaaggctgctttcaccccagccctgttttagctagttctcaatcaggtccgatgtctcagccccacctctggagtcaagtcctgcctcctacctcacagctactagtgaatttatgcagtagattttcagtttcaacactttcatagctactgctatgaaaagcacttcttttgttaccaaaacattaggggttcagtctaggtcctgttgcttgttgcacagaaagccaatcactgagacaacaagtattaccaggaaagaaggcttcagtcaggtgccatagccaagaagatgggagatcagtctcaaatccatctccctgactgactaaaattagggatttaggctggatgtggtggcttatgcatgtaatcccagcactttgagaggccaaggtgggaggatcacttgagaccaggagtttgagaccagcctagacaacatagtaagactcctgtctctacaaagaataaaaaaaaatcagctgggtgtggtggccaacacctgtagtcccagctactcaggagggaagattgcttgagtctgggaggttgaggctgcagtgagccatgattgcactactgcattccagcctgggtgacagagtgagaccctgcctcagaataaaataaaataaataaaataaaaattaggggtttatatagcagggaataaatgtaaacatatgggggaaaacaggaattagggaggagtatggaagaggagttggtcaacacgcagcaggtggttggttaggcagtcataaatggggaggggtctggcatgtcattgtgcagatgcagtgatctggtaagtttcagccccttgatactgtcagagagtcctgacggtttggttcttgagaagggttctcagataaaacaaatgtaactttctcaagtttcaagactggaaaggtaaatttctatgtttattcaaaataaaccataaacatcagttctgtgggacaattgggccggtttcactttgattcatccctgaattattactgtgacctgcatgaaagttcagttcttagtcatggactcagcatttttttatagatttccacacatttgagtaagtggaacgttcaattccagcaccagagttccaactccctgacagctcatttcaccattgagagtcctgaatttattccgtattcaatggtggattgctgactaagaacctcctctgctttagtggagtccctgaatttataattcatcagctgccactaaagtcatgttcattgccatccaaaactatttttcaaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaaagtcaggccaggcatggtggctcaagcctgtaatcccagcacttcgggaggccaaggcgggcagatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggaccaggttataaaacagaaatcattgattttagggttttattacctgcagcaaggtatcatttattcttagagacagtggagtgatttctcacatgttgggcagagaatgaatgtggcaagactgacttctgactctgggatcttagcacttgtgatctggagggctaaagagctacagctggagaattactctttccatttgtaaacaagaatgtagacattttaggcataaatgactgagaacagattttgttgaagtagatgagaacttggaacaatagagccatcattgagttatacaagaggtcacctccatacatctgcctccctaatcttgacctctctttttatgagtacaattttgcaaccaagaaagttatgcaaacaacccaaaccacttggcaaataacattagagctgaatgccctagaactctcttggccttaaaaaactgttagattcacatgcctggcagtgggttcttccatgtttaaccactgcactgatggcctcatctgccgtctccagaagcctagcagtgtgtcagtgggtggatttcaaattgagatgggatttgacaccttggagttttacagactggagacttgggacccaggaatgcgtgaatcctgccttgccaatcacatcctcccccttagttccccagagagctgtgtacacaaagaacaaaaacattatgagagtcaagatccagagaagctctcttatctcatgaattgggcctgtggttagctgataaatggaaaacatcattcagagaggggaatcctaaaaaactatatatgcaaacccaccttagtcattttatttttatttaaaacacataaatgtatacttagtaaaaatcacttttatgcttttaaaaaatgctaattttaagttgaagaaaaaagtatgatatttacaaatcttttttttttttttttttgagatggtataattctgttgcccagattggagtgcagtggcatgatcttggttccccgcagcctcaatctcccaaactcaagcaatcctcccacctcagcctcctgagtagcttggaccacaggtgcatgccaccatgcccagctaatttttgtattttttgtagagatggggtctcgctatgtatcccaggctggtctcgaacccctgggctcaagcagtctgcctgcctcggcctcccaaagtgctgggattatataaaaatcttttttgcataaaccatacccataatgtgttgtctatgattttttagttttggtttctttaaattggaacaaggatttcaagacatctgtaaagcagtctaacagcagaactcttgtaaattttaatgggaaatttcccaatgttttacatttgtttcatccatgcctggttctatagcaattttggttagcaaattgctttaattttttccaaagctttcaacaaaatttttatttttaaaaactcagtttcttttagtgcttatattttattggtttttattttatttatttatttattttgagacagaatttcgcttgttgcccaggctggagtgcagtggcacaatctcagctcactgcaacctccacctcctgggctcaagcaatcctcccacctcagcctccagagtaaatgcgacaacaggtgcccaccatcatacctggctaatttttgtatttttagtagagatggggtttcaccatgttggccaggctggtcttgagctcttagactcaagtgatccacccaccttggcctcccaaagcgctgggattacagatgtgagcctttttgttttgttttgtttttttgttttgttttgtttttgagatgtagtctcacactgtcgcccaggctggaatgcagtggcacgatcttggctcactgcaacctccacctcccagattcaaatgattctgctgcttcagtctcctgagtaactgggattacaggcgcctgccaccacgcccagctactttttatatttttagtacagatggggtttcaccatgttggccaggctggtcttgaactcctgaccttgtgatccacctgccttggcctcccaaagtgctgggattacaggcttgagccaccgcgtccagccccagcccagtttttataatatttaaattacttacaataacatgtacaaatgacacatacaggtttggaaacaaaagcaaccttgactctaacaatggctcttaagttttagcgtgcctcagaatcacctggagggcttgctcaaacacatattcctgggtcccactcccagaacttctgatcagtaggtctgggatggagcctgagaatgggcattactgacaagttctcaagcgatggttgatgcagttggttcacagaccacactttgagaaccaatgtttataagaatacatctcagtcaatggaaaaagtacacaggtgtcctagagcccatgtgttccaccaaggctgctttatcagcatacaacccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaactttgaagcaaaagaataaacgtaacacaggttattaccctttacaaatcttcagtgtccctttgcatctttttattgctatgctaaatatgtcattatcttctccatgcatggttttgctttttaaaattttacatatgtattacttttgtagattctatttccttgttattatttacacacttttgatattaatataatcctaaaacattgtagggagtacttttttttgaaaagggactggtcttaagctcctgagctcaaatgattgccctgcctcagtctcccaagtagctgggatttccaaaaacttttttttttttgagacagggtcttgctctgtcaaccccagagttgaccctaggtgcactctctttttctcatttcacctctaatccaacaggaatcctgttagccccaccttcagtatttaccaggtgtattagtttgctagagctatgctgtggtttggatatggtttgtttggcttcaccaagtctcgtgttgaaatttgacctctgtggccaggcacggtggctcatgcctgtaatcccagcactttgggaggaggctgaggccagtggatctcttgagctcagaaggttgaggccagcctggcccacatggtgaaaccccgttcctactaaaaatataaaaattagccagatgtggtggcgcacacctgtagtcccagctacttggatggctgaggcaggaggatcacttgaacccaggaggttgaggctgcagtgagcagaggtggtgccactgcactccagcctgggagacaaagtgagaccctgtctcaaaaaaaaaaaaaaaaaaaaaaaaaaaaaagacaagaaatttgattcccaatgttggaggtgggacctgctggaaagtgtttgggtcgtagggacagatctcttcttataagaacaccagtcatattgaattagagcacgccaccctaataagcacattttaacttggttacttctgcaaagaccctatttccaaataaggccacattcgtaggtaccagggtttaggactccaacatgtctttttaggggacataattcaacccataacttccagaacaccactccccctcatcccctgcaacatcctggtttaagcctccacccttcctccctgggattactggagtcactttcttactggttttctactctcagatttgccctgtcagtctattcttgactcatgggtccagaaccctgcagtgactcccaactcattcagactaaaagctgaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccgtagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagggtgaacattgtcaaattgccttccaaaaggatctttctcaatttataatgcccctaccattaataacgctgctgcctttctaccactgggttttatctcatcttatttttgccagtttactaggtgtaagtgcaccttgtgatgattttgatttgcaattctttaacttttaaatacaattgttcacatgttctttagtttacttcctatatcttcctatatgaattgcctgatatagactcctgattttttttgaggggggcagagaccttgggttcataactgtttatcctactcttttggggggcaataatattaatcctaattaatatctgttatcattttgccctcatcctaccattcccttttcctctgtttgcatttctaattctgaatgtgttttattctctccagctgtggactactgtgcctcagaaaaccacggatgtgaacatgagtgtgtaaatgctgatggctcctacctttgccagtgccatgaaggatttgctcttaacccagataaaaaaacgtgcacaagtaagttacacacacatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagcactaacagggcttgagatgttttcattgaagctttgtggcttgtgggctttagctctgactccacgcaagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcagagacatgcatcagtgagaaaacaggattttaattcataaaaagttcatgtacctacaacctttctaaaatgtattcactatgtaaaacaggatacatctgcacaaaacctttttcaacataaacttacttcctactcttcaatacctaaatatcagcagcttacaaacaccagagctggaggtttgggtgatgtatggaactataagggacacattaggtcaaaagcatacatttctggagccccaaccatgtgccaatagaaatgagtacggcaaggtccttaagggagaagataactgtggctgagtcttggaggtggagctgtcattcactaggcagaaaagggtgaggtgggggttccaggagaaggaaagaagttgaagatgtgaaccaagcagagaactgtagtctccatgccccgtgcatgactggcatatacagtggtttatttgttttgtttattgaaagagtaagtaaatgaatgagtgggctgctgtgtttgtggtctcccttcccttctgaatattctgaactgtaaaatagcagcctgtgctgtcgtcgtggttggggagttgtggttgttgggctgatgagtcagtgttcctcatcaaagaggaggccgtgggctgccagcagcgggccttggttctaatcccagcttctctgctttttctcttggtgatcttgggcaagttacttatgcctcagtttcctcagttacagtacaggatgataatgctgcctactgcatagcattattctttccttttttttttttttttttttttttgacactgggtcttactctgtcacccaggctggagagcagtgatgtgatctcggctcactgcaacctccacctcctgggttcaagcgattcccccacctcagcctcccaagtggctgagactacaggctcgcaccaacacacccagctaatttttttggtattttttgatagcagtggtgtttcaccatattagccaggctggtgtcgaatccctgacctcaagtgatccacccacctcagcctcccaaagtgctgggaatacaggcatgagccacagcacccggccatagcataatcttgaatactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctggggtcacctgatttccaccccagcaccagccctagttcccagagtggcaccatcttccccaccctgtggctcagcatgcctcctgtcccagatccccagcccagggtggtgcaggcaaggagggtgttggagccctggaatcagaccctggaagtagataccgcagcatagtgggactgggagaggaggtttggctaggagccacgggaggggctgatccagctgtgaggtctcaccagctaggcagcgagcccagcagtgcagttgtcagaatcaagatccagaagtgggccgccccaatgcgtgtgcagggaagagtgctgggagactggagggttcgtgcaggcagcctcagggcagtacatcccttagaagagccctcttcccaccatgcttggggtgggcaggagccagacccaggaggagggagacaagaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatgaaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacaggtaccatcagtttgcaaaaagttagcaagacttttctttttctggtattgttataaaacatacataatagaaaatttaccactgtactcattcagtggcattaaatacactcacattgtgaaaaacgcatatcctagcctgtctccttcctgcctctccagaccacaccccctggctggggtcacctgatttccacccagctgtaactatcctcaccatccatctccagaacttttcatcaccccaaactgaaacgctgtacccattgaacaataactccccattgcctgccctgtcaaccaccattctactttctgtctgtgaatttcaccactctcggcacttcatgtaagtgggattatatggtatttgtcctttgccgtctaacatatttcacttagcataatgtcctcaaggtttatctgtgttgtagtatatatcagaatttccttcctttttaagactgcataatattcaattatatgtatatatcccattttgtttatccatctgttgatggacgtttgggctccttccaccttttgcctattgtgaataaagctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgcggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaacactttcagctggaagaggctttaaagttcaacctagttcttgcccaactatccatcctacaatattctcactgtgccatcatccaacctgcatttgaatacccccactgacaggatattcactataccccatggtagttcattccactttgtatagctctgactcttagaaagtgattccctagactgagctgatatctatttccttgctcttagaaatgaacaaaacaaatttggctacttgcgttctttgtggccactaagagtgagtcatatcagagtaactttatttcacttagtagactagccaggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacatggtgagagaggaagcaagagagaaaggatgaggcggtgctctttttaacaaccagctctcatgagaactaacagagcaaacgtactcattactgtgaggacagcaccaagctattcattagggattccccaccatgacccaaaaacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatcattttcttaggaacacaacaaaaaaggaaatttattgagtcaaaggcaattaacattttaagtcttttgatacatattcaaaattattttctaaaaacgttttaccgatttatactctaccatcagtgtttaagggggcaatttttatttttaaattaaattaaattatttatgatttcaataggtttttggggagcaggtggtgtttggttatatggacaagttctttagtggtgattctgagatttttggtgcaaccatcacctgagcaggatacatagtacccaatgtgtagtcttttatccctcaccatcctcccaccccaagtccattgtatcattcttatgcctttgcatcctcatagcttagctcccatttaaaagtgagaagtgggatatttggttttccattcctgagttacttcacttagaataatggtctccatctccatctaggttgctgcaaatgccattcttttgttcctttttatggctgagtagtattccatggtgtatatagacactgtattttctttatccacttgttgattgataggcattgggactggttccatatttttgcaattgcaaattgtattgctataaacatgcgtgtgcaagtatctttttcatataatgacttaatttcctctgggtagatactcagtagtgggattgctggatcaaatagtagatctacttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccacacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaagggactgtgcctctttgttcaacactgatcctagtgcctgtcccatggtaaatgctcagagaatatttactgaatgaatgaatgaacagggaagttaacatgtcttcatatattagacattcaagagagagggaataataaagatctgagctaaaataaaaggaatagaagacataaatcaatagagataattggtaaaaaccaaaatgtgttttttttagaagattaataaaattgataaatgtctaaccagactagtcaaggaagaaaaaagagagaagacacaaattactaatatcaggaatgagaaagtggacatcaatacatatcctacaaactttgaagcataatacaggccaagcatggtggatcatgcctgtaatctgaacactgtgggaggccaaagcaggaggatcacttgaggcaaggagttaaagaccagcctgggcaacatagagcccatctccaccaaaaaaaaaaaaaaaaaaaatatatatatatatatatacacacacacacatatgtatacacacatacatatatatatatatatacagaaaaatcataaacaagtttatgccaataactatgacaacttagatgaaatggacaaattccttgaaagacacaaactactaaagtttacccaagaataaatagaggctgggcatggtggctcatacctgtaatcccagaactttgggaggcttaggtgggaggattgcttgagtccaggagttctagatcagcctgagtaacatagcaagaccccatctctacaaaaaataaataaattaactgggcatggtggcaagtgcctgtagtcccagctactcgaaaggctgaggcaggagggttgcttgagcccaggaggttgaggcttcagtaagccacgatcacaccactgcactccagcctgggcaacagagtgagactctctccccagaccgaccaaaaacaaaagaatatagtctgaatagatctctatctattaaaagaaatggaatttgcactttaaaaccttcccacagagaagacttcaaacctagttggcttaactggtgaattctaccaaaaatttgaagaaaaactcatactaattctacacaaattattccaaaaaattgaagaagaaagaacaattttcaactcatcctatgaggctatcagtaccctgatacccaaaccagaaaagaaagacataaaaaaagaaaactatacacaaatatttctcatgaaatacctgcaaaagttatttaaacagtttctagcaatcaaatttaacaatatattaaaaagtacaatacatcacaaccaagtgggatttattccaggaattcaaagttggcttaacattcaaaactcaatcaatgtaattcataatattaacatattaaaaagtcaaaaccatatgagccatctcaatagatgcagaaaaggcattggataagatctgacattcattttttctttaaataaactttcagcaaattaggaatgaaggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacctgatcacctgtgtagaaaatccaatggaatctattaaaaagctactagaactattaatagcaagtgaatttatcaaggttgcaggacacaagatcaatatacaaaaataagttagttttatgtacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatgaacattagccaggcatggtggcaggtgcctgtaatcctagctacttgggaagctgaggcaggggaattgcttgaacccaggaggcagaggtttcagtgagctgagattgcaccactgcattccagcctgggtgacagagcaagactctgtcaaaaaaaaaaaaaaaaaaaaaaagacaagccactcaataaaaatgggaaaaatatttgaatagaaacttcaccaaagaatatatagagatggcgaagaagcatatgaaaatatattcaacaacattagtcattaggtaaatacaaagtgaagtcatattgagataatcatacccactagaatgactaaaattaccaagtgatgatggggatacggagcaactggaactctcataaattgctggtgggaatgtttaagcagttaagcatacatgtcccatatgactcattcattatgcaaaaggaatgaaagcatatgtccacacaaaaacttgtgcattagtgttcatagctgctttatttgtgatagccccaaactgggaacaggtaaccagcccttcagcaagtgaatggataaacaaattgtggtataatcacatagtgaaatactactctgcaataaaaaggaacaaactattgacacacatatgaatctggatgaatctcaaaataattatgctgaatgaaagaaaccagacaaaaaagaatacatactatatgattacatttatttaaagttccttggggagataaaaaaagaagataaaaaataaaattctagaaaatgcaaactgatttatctggatagaaggtaaatggttatttgggactggagagagtggggaagaatgaattagcaagagacaggaggaaagttttgagagtaatgcatatgcttattattttgattgtggcgatggtttcatggcaggatacatatgcaaaatgcatcagattgtttttcttgagtatgtgcagtttggtttttgtcaattatacctcaaaaaaactaaaaacaagtagaagagactgtattattccaaaatttctatgtcataaaacacaaagagaggctgtggaaatgttctggcccatcactatcctatgggacactctggttgatggaaattctctgtttgcatcatacaatacagtagtcaggagccacacgtggccactgagcacttgagatacagccagtgcaacccagtaactgaatttttgtttcgttttgttttgtttgttagagacaggctcttgctttgttgcccaggctggactgcagtggtacagtcatagctcatagctcactgcaatcaccaactcctgggctcatgagatctcctggcctcagcctccctagtagctgggactacaggcaggtgccaccatgctcagctaacttaaaaaaattatttttctgctgggcacagtggctcacgcctgtaatcctagcactttgagaggccgaggcgagtggattgcctgagttcaggagttcgagaacagcctgggcaacacggtgaaaccccgtctctactaaattacaaaaaattagctgggtgtggtggtgtgtgcctatagttccagctactcgggaggctgaggcaggagaattgcttgaacccgggaggcggagattgcagtgagctgagatcgtgccactgcactccaccctgggcagcagagcgagactctatctcaaaaaaaaaaaaaaattcttttttcagaaatggggtcttgctatgttgctcaggctggtctcaaatttctgggttcaagcaatcctccagcctcagcttcacaaagcattgggattacaagcatgagccaccacccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacggactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataatacaatgtctgggccaggtgtggtggctcactcctgtaatcccagcactttggaaggctgaggcaggtggatcacgagatcaggagttcaagaccagcctggccaagatggtgaaaccccatctccactaaaaatacaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttcagcctgggcgatggagcgagactctgtctcaaaacaaacaataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaacattttttcctttcaagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcattttagtggctcttacatgaatcaagacaaggaaagcatgttcacaaatttgtttgttgcataaacgttttgtaatatgtcaggaagtttgtctttgcctagcagaagagtccaggtataataataataataatagaagaagaagaaggaaaggaagagagaaagaaagaaagaaagaaaaagaaagaaagaaagaagaaaggaagaaaggaaaggaaggaaggaaggaagggagagagaggaaggaaggaaagaaagaaagaaaagaaaagagggaaagaagaggaggagggaggggggaagagggaagagggggaagggaaagaggaaggagaagggggaggaagggaaagagggaggaggagggaagaaggagaagaaggaaagaaggagaagaagtttctcttaggagaggccatatctctaaacatggaagtagctttattgggagaccccttcatggtgtgactctttgaggtgtgggattttacctgtttgggaaaatgaagactggaaatccctggttttcctatgctagctttattgattggtttgccattcttgtgatttttccttcttgccagagatagactactgtgcctcatctaatcacggatgtcagcacgagtgtgttaacacagatgattcctattcctgccactgcctgaaaggctttaccctgaatccagataagaaaacctgcagaagtaagttacagtgggagttggagaagggcttgttctgctaaatgctcctctagttagttttcctttccgtgcaaatcttaagcaagatgtgcttgtattcagcattgtgtctattaacattattctcccctttattttactttttggctcactagatcctattatgtggatgatttttaaatattgaataggtctggccattagattcaattagccaagtggacccaagctgaagctcccacctatgtgaaatgcaggtgcagtctccctcccccttattcccatagcattggggtcttggaaaaagaaaagaatgggcccagagatgagaggtagaaggagttggtttcttctactcctacaagataagacacttgacggatgctaagagggaggacattgcagctttattccctttgataggaaagaagaagaaaaatgagactctaggacatcccagcaatattcaaggggtacagggtgtcagcgggttgatattgtggatgtactgagtgcctcaaatgcctgtcatctagcacatcaaagggcatgattggggatctgagcacaggccccagagggcacctgcttaagacaaaccattcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcctggattttgaaacggagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcggtgattagatctggttcagctcagatgctcattgcaagcttcctcatgtgttactaatggaggggaaaaaggaaacaagttaggcttggggccatgggcggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggaatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatataggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggtttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccagccgaaaagggtggtatttgaatagctgcctgccagattgctgggtgataacctctttaagaatctaaatggttttcagttgaattatctcatgtgtaaatcattctttaaaaaaaaaatcttgctgggcgcggtggctcacgcctgtaatcccagcactttgggaggccgaggcgggcggatcacaaggtcaggagatcgagaccatcctggctaacacggtgaaaccccgtctctactaaaaaatattaaaaaattagccgggcttggtggcgggcgcctgtagtcccaactgctcaggaggctgaggcaggagaatggcgtgaacctgggaggcggagcttgcagtgagccgagatcgtgccactgcactccagcctgggcgacagtgagactctgtctcaaaaaaaaaaaaaaaaaaaaaatcttgcttgaaacattatttactaatttattttaattttttaaaaatgtttttctttttatatttttattgtatgtgctgctgaagcgagagcttcagcatatttttttatatttttaaaattttaaaaatttttttttatatttttaaaattgttacaacatagttgtacctctttttggtatttatttattttttaaaattgacataaaaattgtatacttgtatacaatatgttgttttgcaatacgtaaatataaatttttcttaaagacaacattggcttttttagtgtggcaaaatatatataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcgttcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctacaggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctctccatgcactctgtctgcagccattctgctcatactctgggcatgaagcaagctccagccaccagtcacctgggagggcacgtcacggattctttttttttttttttttttaattttttaatttttttaaagacggaatctcactctgtcacccaggctggaatacagtggcgcgatcttggctcactgcaacctccatctcctgggttctagcgatcctctcacctcagcttcccaagtagctgggactacagatatgtaccaccatgcctggctgatttttgtattgttagtagaggtgggctttcaccatgttggccaggctggtcttgaactcctgacctcaagtgatccatccgcctcagccttccaaagtgctgggatacaggcatgagccactgtgtccagccagatcctttaagagaccctttgaggggtccttcaggtctgggtcccattcacatttccatttttactagcagtggatcttgatcaagttattaacctcgctaaacctcaattcctcagctttgaaatatggataacaggccaggtgcggtggctcacgcctataatcccagcactttgggaggctgaggcgggtggatcacaaggtcaggagatcgagaccagcctggccaatatggtgaaaccccgtctctactaaatatataaaaattagccgggtgtggtagcgggcacctgtagtcccagctactcaggaggctgaggcaggagaattgcttgaacccaggaggcagaagttgcagtgagccgagatcacgccactgcactccagcctggatgacagagcgagactccgtctcaaaaaaaaaaaaaagaaatatggttaacaatcacacatatcttgcagggtcaaatgaagttatgtttgtaaagtggttggcacagcatctggcattcagcaggtatttaagaaatggcagcagctatgatgctatgattatcatcactaatgtaactatcagactgccactaatagtgagaaaaataaagatggcatggtccctgctcgtggaactcagtctagtgaaagaaacagactttgaagcatcacagatacaaaacatactacataaccattgtgatgaatgctacgaaagagaggtcctgtagaaagaactgacttcatctacgaggtcacaaaagatgacaaaatgatgttgagctgatcgtgaaggaagatagaggttagccagtgcagcaaggagccactgagacaagagggtgatgtgtcatatctttaagtgatttgtggatgtgagcttcgtcaaataacttttgggcagatacatggtaaaaataaaatctagtcattactttatgatttcagatcatttcccctgtatcagttatggtgctttttgttcacacaaaaccggaaatccaattaatggtgttttaagtcagaaggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtcttttttttttttttttttttgagacagagtctcactctgttgcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatctttcttgagggcccccagtaagcttcttatgtttcattggtcagaactagggcatattcccaccccttgaccaatgactgacaaagaagaacatggttgccacgctggcttagaccagccatgactcatgcttgggggtcatggggtaatggttattggcaagacaaccaacagtgtctgccacatccccagaaaaagaacaatgctgtgcagttaaactgatccagcccagccaatgaggtcggtggtgaccttttcccgcaacaccagtctcataaagcctctccacaagctcattttgtgtccttttccagttctctatcttccctggagcctgctatgtgtggggtcttatggctttagcattttctaccaggaaaggaattgcttattggctcctggttatgacacagtttccatctgctggcagaaacacagcatggatagagtgaccttaccataggacagaattgcagtagcctggggcagcatcagagatacgcctcctccagtcccacgatactatgccagcgtggtctcaacagagcaaggcgaagcatttagatccttcttcatgaaactgccaacccctgcgtccctaaatagctggatattttgcaagatcaccttttgtttattttgccttgtgccgtccaatgtcactgtcagatgtcactgtagacagaagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcacctggtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcaccgtcccctcatccccgggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagacaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttatttctggagcccaccgggtttcctgatggtctgtcaggtgtatccttccttatcctcagtttcatcacccatagaatgtgactattaatgctatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaaccctatctctactaaaaatacaaaaaattagctgggtgtggtggtgggtgcctataatcccagctactcgggaggctgaagcaggagaattactcgaacctaggaggcagaggtgcagtgagctgagattgcgccattgcactccaacctgggcgacaaagcaaaacttcatctcaaaaaaaaaaaaaaaagaataggagtaaaatacttagaacagcactgctaggcataagcactcaataaatgttaactaatattagtatttgctgttaagtgtatttactaggtcagacaggtctaatttcaaatccaacctctcccacctactagatgtgtgtgaacttgggcaagttatttaacttctccatgctttgatttcccatttatgacaaaaagcaaaactaatagtcgtattattcccacagggtttttatagggagaaataggagccattttgatatgttagcctggtgcctggcacagggtaaacttccaatcaaggggaactgttcctatcatggagcctgtgagaggggccagtgcctggcgccagactgggacaagaggccggaggggacagaccttggaaagcaatgggctgcagaggctgatctgagagcagaatcaagaaacatgggattttctgagaaggcttgtcttaattttcttgtgtcagagccacaacaaagctccactgggtgatgtaaatgtatgggaacttgcaagctctgccagctgggcggctccatggttttttatgaggcaccatctccacgggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctccagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcggggagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccacttggcagacctgcaccaggcctccagtgtctgtccagtctctggaggtgcattttctccataagggaaacctgggaagcagcctgcagggctgttagtgggagctgttcaccacagctgtgtgttcattagccttcggcacttgctgcccggaggaccagctgtgcagcattcggatgccaggataggccacacatgcagtcccaggctttggtttgttttttaatctggatgtcctgataatgggggtaaaaaaaatagaaattgatttcatggagaatgacaactctttttcattttcaattagaaatgaaactatatgactaattcttactcagcactacttgataataatagtgtgttcattaagtggttgctgtatgctagctactgttctgagcgctttacataatcaacccctcttattctcaccctattcctataagaaagcaaccatcaacatccacattcacaaatcaggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttacccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggctcctctatgctttcgcgtgtgtgaaaatgcaggagtggaccactgtgcacagcaggaccatggctgtgagcagctgtgtctgaacacggaggattccttcgtctgccagtgctcagaaggcttcctcatcaacgaggacctcaagacctgctcccgtgagtccctccgcgctcctctcataggggaaggtttgcaccaggagtgaaacctatgtgactgcagagggcacaggttgtacttgggcacccctcccctgccccttgctctgctccaggagatagtgaggatgtccactgggactgcatgccttcgagggagggcggggtgagcatgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccaggctttgctgggcctgcatgaatgtgtgtgacagcatctcttagccattaagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgaggaaaaactgtagctcagattaagtaaagagcctaaggtcaccagctagtgagtggtgggttcaaactctgctggctgtgattccaaagtcagtcctgggagaagaggatgctcctgagaaacgctttgccctgctttctgaccccggtgatctcacagcacatggtgaggctggcagtgatgtgtcctgggtacatatttccttgcagctggtcccaaatcttgtctcaattaaaaaaaaaaaaattgctcccagacctccttctctcctttactgaagaatgctggtgtgtttgttgccctgaaatcctgtttcgaagtggaccaagataaagaatcgaaatatggtcattttgagagaaggaatcagaaatgaaagaaaaggaccaccatttatcttccccagcctgctggtctttctggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaactgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaagtgggtttctaaccaatggcacagtggaaccatctacatgagtaaatgtccaacaatgcaatgaatagtgaattttgttatttatatgtggttgtatctagatgagaacttgtgagatagtcagataagtgagaattgtcctcaggaaccgtataggagagatgcatttcacccaccagctgatacatatgcattgagctattcccctaattgaagactttctgcctgtcccagaatgattcattctgactgtcctgtcctgtaataatgggctaggttttcagcgtggccacagctaactgggggttgggatgtgtgttccccagctctactctcaatgacaaagggccagacgacatgactgcacctatttggtaaagccttttggggggcagtcaggcctggctcagcagataagagtgtccttggctctttatagaggcagcctccacttagagctttgatagcaagtggtcttaagaatgtgtcactcaccttctggaaagttctctgaagtgtggaggggttccaggggccctgggatgagatgggcactgctgtgcccctacctcttcaggcaccttgggttctctggcctctggagcgatgtcccctcccttcctccagccccctgaccgcaagctctgctttcccagattttccccagaggcctttttgcctcgggcagttagatgcacagactcagggtgtggggggtcggggaggggatggggcgatctcttttaccagctgcagctgcgcagactccttccctctctagacgtttccctgagattgaccttgtgcaagggcatcccagcaccaagaaagactctataggcctgatgtgcatggaccacactgcccactggcctgcaagctcctggaggttggaggtcagaggccaacatgaaatgactgggagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctgataggctctcctctcctcctcccaccccaggctctgctggggcctctctgcagagctctcctgcccagcctcaccctggggctctctgtgcacatgtctgagaaacagtgtggcagagcagaaagagtactgaactggaagcccaaagactgggtttaaatcgtgtcgcttctaccctaggcaagggaattggccctcttggggtctgactgctcatctctaaactgagaatggtcgttgctgcctttcaaggccactgtgtggttcagggagactgctgttgcagtgctatgtgaacttgtggactgccgtgacccctaaggaattcctcttcctctctcccctcccagcatcagaaccccctgcactgaggagactcagaaggtattgctgcctggaaacccatctgccagggccaggcctgctctccttggaggggccccagagacacacaactctggaagtgggctggactcaggagtccaagggctgtcctatgagggaccctcccttctgcaagcggaggacaccaacggggatcagagccgtcagcctagggcactgggggatctctgctggtgatactcccagtccaactaccacaggcagatctgcgagggcctgttaggctgcctgaggccctgagcttggccttccagggctgaggcaggcctaggcgaggctaggggagtgtcttagtctactcgggctcccatcacaaaataccatagactgaatgttgtttcttaaccacagaaatttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtaaattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatattaagttagcaaaggattggctgctgctagttttattacgagaaaagccaggaagcagtgtaattctatctgtcggcttctggttactgtcttggcagatggccactgtggctttctctctctggggttggggttggttttaacaacgtcttatgtggagccccagacgcaggattgctgtctgtcatcacggcagaggtgcaagtccacagaacacgttgccccactgttgctgcgccacagacttacgtgactcacctgtgtcagcgtgcagggctgctagacagggaccctaaagacccgtgctacatcctaaaacttctaatcatcctgagcacacgctgcagaatccattcacgatgagggtttaattaaacacataggcctgggtccttatgtgtaaaaggaggagaatccttctttgagaggaaaaatgttttctttctccctcttgagatttcttacatcctcccacctatttcacttaagtgatggctcctaatggagtctgtctttactctcctctctgggtttgaatctaggtacttccttaagcgcttggttcctttaccctcgttctctacaaatatttactgtgtacctgcattgtgcggggtgctggggatctctggggttgatgcagattcggtttgtgccctgacagtgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcgagagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctgaccatcagttttctcatctttaatgaaggggttggactagttcatatccaatgagttgaacttccagcacccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccacggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgccaacatctcacctctgatgattcgttgaaatcatctatggggctaggaaaaagtctaaaggcccaggcagcatcccagaaaccctgaatcagaaacagaaacagagactgtcttacattgttggtgagagtagagattgaaataatctctttggaggatgacttggaaatatttatctgcctttaagtattcataccctttacctaggcaattctgcttctggatgtgtaactttcaggtatgccttcacattgtacataaaactacatgcacaagaatatccattgcagataaggtgtggtggctcatgcctgtaatcccagcactttgggaggctgaagcgggaggatcacttgaggccagaaatttaagaccagcctgggcaacatagtgggaccccatctcaacaaaaaatatgaaaattagctaagcatggtggcatgcacctgtagtcccagctactcaggaggctaaggtgggaggatcacatgagcccaagagccaaggctgcagtgaactgcgatgacaccactgcactccagcctgggcgacagagcaagcctgtgtctcaaaaaaaagaaaaaaaagagccttagctgaagctaggaggacaggactgggcacaagggaagctccaggaaggaagggcttaggggtctgtctggattatggcttgacaaggttgacgtgaaagagctatagctattttattaccatggaaaatggagtagtagtagtattataaattcacggtagggggaaaaaaaaacacctcacctccatggccatccagttgtctatatcatggatcactcaactctactttccactcttacaccatgtgaggaactatcccaaaccatcaggaaatgttctgcattaatagtgagtctagaatttgctgagaaaagcaagtcatgctcagggcaaacaggagggtccaactcggctttgagcctcctctgcagctgtaattgcagttatcaaacttttcccattcttcaaagattttggcagtgcttctccccaaagaaattcccttcacatttgaaagcttgctgtagaatatagcaatgtagtatagtcagaaaatacggggatttatttataagattacaatttttgtctggttctttctcttgttaacaattggtcttgacaagccatcagccttcccaacccttagtttccctagctggtgagtgagaataacaacagctgccttaactaacccaaaggtggttctgaggagtcctctccagagagatactgcaaagatgctttaccaaaaaaagtgtgtggtttgtgcctgattataaaggtcattatgtgctttggggcctttatttaataattccgattcatgtccattttagaaattctactcaatctgaaaggattgagttaactttcagaaatatgtagggttcttataaaaagtcaccactcacctatcctcagtattaagcttttaaagtaacagcctggttttcacaggttcacaaaccttctagtcccccagaagccacccagccctgtaagatggcaatgccatccttcagttgctcagtccagcaacctgggagtcttccttgactcttctgtcctatccatatgggctctttgtattaatccatgaacaaattttatagattctaccttaaaatacagccagtctgaccacttctcaccagcctggtctgggccaccaagatctttgcacagggctgctcccaggtgtccaagctccattctgtgcagagcgatcctttaaaaacaaacccatatcatgccactccactgctcaaaacactgcagtgactgcccttctctttcagatctgacccccactgtgaaccccacatggtctgccccagccaaccttgctggcctcatcccctgccaggctcccggatgctccagtcacagtggtctccttgcctttcctgaaacacaccaaccaagcagctcccgttgctgcagtttgcaaatgctgttctttcttgctgataatgctctttcccagacaccaccactcacttcctgtctttctgcagggctctgctcagtgtcaccatatctgacacaccatataatataacaagccctccctactctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaaataagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagtcccagctatctgggaggctgagatgggaggatcacttgagcccgggaggcagaggctgcagtgagttgagatcacgccaccacactccagcctggatgacagagtgagaccctttctcaaaaaagaatttttgctcatagacatgctttatattctgaaatgtgtactgtaggataaggcactgttttaattcaaagtgtctgaaatgtcttttatgattgaataagccactaatatatgagtcattttcttcttctgtttctctaattcccatttgattctcagaattggactcttgtgctctgggggaccacggttgtgaacattcgtgtgtaagcagtgaagattcgtttgtgtgccagtgctttgaaggttatatactccgtgaagatggaaaaacctgcagaagtaagtttgtactggagctggctcctactactatgccagaccactgtgtgaaatcgctatccttatctctgtatatatcagttcctctcagaagtcaatgccacacagcaaaatgtaatgtagtgtcctggataggaccctgaaagagaaaatggacattagggaaaaaataagtaaatgtcaataaaatatagactttagttaataatcatgtatcagtatgggtttatcaataataacaaatggaccatactcatgtgagttgttaataatagggaaaactaggtgtggggtatattgcaattctttgcgctatcttctcaatttttgcgtaaatctaaaactgtcctaaataataaagtctattaaaaaaatggacaaacaaaaaaagtcaatgccagagctactactgaagttcttcacttatatgctctgtggcaagaaacagtggtttggcagtatactctagtggaaagatggacagtcagaaatccaagattcagtcaacctctgtctctgccatttattagctgggaaagttgcctaacttctctaagcctctctgcttatttatctttaataatgttgttgttgttatttctggtagcacaaatccctcccaaagggcaccttgtgatgaagccagttttgcctttcagaaggcaaagcctcttagatggggctgcagccagccagcccaggacaagcagccttagagtgaattgctggtgtaaatctcaagacacatctctgaataatcaaaggggagtgtgtgaccctggtttccatccatatcagttatctttttctcaacgtctcaaagcactttataaagagcaactcatgttgacacttttggaagaaaagatgggtaactggaataattactctctcattttttggacagcacagctaagactccaagaagttaagtgattctcctaagtcatacactatgttaggcacaaagccaaagttagatttcagtgctgctaatctaaattgaggtttaacctcctaaggaatcatatcaagtgtttccattctgatatcagaaactatgtctacagaaagttgatgatggactgcattttaacactaaagtagtgctggtgaacgatgatggtgaagacagtgaaacagtttgaagggttagcccgaattagagccgctaaactttgttctcaattgtaacttcctgccccatggaccactgagctcaggtggcagatagaatccagtagctgactccagtggatgggtcctccaaggtgaagtccatgtgaaatgtatgttgttgaaattgttgtaacttgctctcctgtcttcagggaaagatgtctgccaagctatagaccatggctgtgaacacatttgtgtgaacagtgatgactcatacacgtgcgagtgcttggagggattccggctcgctgaggatgggaaacgctgccgaagtaagtagcctcgaggtggagaagaacttttccctctgtggactcagacagttagagaagttcatttaatccttaaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccgtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccaccaggtgcctcccacaacacgtgggaattgtgggaactacaattcaagatgacatttgggtgggacacagccaaaccatatcagagggatttcctgtgggttttttctattatttttatcatttgcttctataggtcacccagaacaggctctgagagtttcgttagaaggtgtattccccagagttctccagagaaacagaccttctctatgtatatcttcatcttctattatatataaatataatagaagacatatatataatatatatatgtcttctatggtctgttctatcttctatttatatatatcatagaagatatatatatatacacacacatatatatgtgtgtgatgtatatatgtatactatggtctgtttctatcttctattaatatatcatctccacaggaaaaatggacatacacacacacacacacaaacacacatatattgtgagggaggaaaagattggttgattttaagggattggctcacacaattgtcaggggctggcaagttctaaatctgtagggcagcctggagacccaggcaagagctgatgctgcagcccaagtctgaaggcagtctggatgcagaattcccttttcctctgaggacctcagtctttttctctttaggccttcaagtgattggatgaggcccatctacattatagagggtgatctgatctgcttcactcaaagtctactgattaaatgttaattgcatctaaaaattagctcacagcatcatttagactggtgtttgaccaaacaactgggcactatagcctagccaaagtgacacatcaaattaaccttcacagtacccaaaggaacagagggatgtcatacgagctcagtgaggtgggcattaggagagtacagagcagggatttttccccaccatgagattctgagctggtaattccctattttggggggaggggtggttgacaaagtctacttgcttttgtgacactttgccccagtgggcaaaataaccctttttcaattaagtcaaaataagttcagttgctttgaggttgatttttgggaatttcctcacagactcctttgagataactggggatattccacaagccaacaaggctgggttggagggatctcaatacctcgcttcttcctccaggaagagggactcctacctttagcaagaagttctgtgtgaatgactgacacctaggatgcctgtggtaccctggcctaactctgcagggattcccctcacaactgcaggtccagcttcacactgcagtggccctcttgtggagattttgtctataattctgcccattgtgcctgtctgcactgcttgttcatgcttttctttttgtttgtttttgttttgagacagggtctcactctgtcacccaggctggagtgcagtggcactatcttagctcactgtaatctccacctcctgggctcaagcgatcttcccacctcagcctcctgagtagctgggactacaagcgtgcaccaccacacccggttaatttttgtattttttgtagagacatggtttcaccatgttgcccaggctggtcttgaacacctgagctcaagaaatctgcctgcctcggcctcccaaagtgttgggattacaggtgtgaaccaccatgcccagccctcatgcttttctttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgaggatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtattttctttaaaagagattacttccacaatctctactcacatgactattcaattcacctcatttctacactgatgggattgttcaactccctacattttcctcagggaaggatgtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctgaatgttttttatagtatgttaccatcgatatattttgtaaaacactctaacatacagtctctctttctctatatatgtgtgtgtgtgtgtaccattatatacatatctaatgtgtatacccttatgcacacacacacacacacacacatacacacaccctttttctaatatttaagttttgttccaaatgcatgtattattttttagaaaaaaataagataaacacgatttagaaagaattaagcagcatgatcttgtgaggaagttcagtattatgttaagcagaaaaaaattaggaaactggggatctttgtagaaaaaaattttgaggtaccaaataccaatgtgactgtcatctcactcatgatttgtatgatacccccaccccaccccaccctaccctggaaagaaaggacacttggagaagctacagcttagcacgaggacaaagaagctttctaccagggaagctgcatgcctaattagttcagagcataagcttcagctcagacagatctggatttgaaccctgattcatactacccgtgtgaccttggtcaaattatttaatctcggccgggcgctatggctaacgcctgtaatcccagcactttgggaggccaagacgggcagatcacctgagatcaggagttcgagaccagcctggccaacatgacaaaactctgtctctactaaaaatataaaaattagccaggcgtggtggcacgcatctataatcccagctactcaagaggctgaggcaggagaattgcttgaacctgggaggcggaggttgcagtgagctgagattgctccactgctctctagcctgggcaacagaggaagactccgtctcaaaataaataaataaataaaataaataaaatacaaaaattagccgggtgtggtggcatgcacctataatcccagctacttgagaggctgaggccaggagatggaagttgcagtgggccgagatcgtgccactgcactccagccagggtgacagagcaaggctctgtctcaaaaaaacaaataaacaaacaaaaattatataaactctttgagtcccagtttccccatctataaaataaggataataactcacaaagccatcacaaggaatacattagatcgtgtatccaaaggtgctgaacagccgggtgttgtggctcacacctgtaatcccagcaccttgggaagctgtggtgggaggattgcttgagctcaggagttcaagaccagcctgggcaacatggtgaaaccctgtctctacaaaaattagaaaaattagctggttgtggtggtacgtggctgtggtcccagctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcggccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactgctggaaaattatttcagtatttttgaaatctgctgaagagccacatgcatgctgcctgagtctttttttggttcactcaggaacagactatgaatgtaaatgaagctttgagttggccttttcctctttcactaataaaagatcgataggttgagtgatgaggaaaagcacttaatggagaaacagaagaacccaatcccccaacatgtgcgcactcacgcacacacacacacacacaccacacacactatgacgttaagcattttatactggccaggcatagaaatggttttgcatgtgtgtgtctctacatgcttatattgttgtgcctcacttttaaagattagacagctgcttgatatataaaacagaatgtttatcacagattgtggattgtttgaaatgagatcatctggcccagcacggtggctcacgcctgtaatcccaacattttggaggccgaggtgggtggatcacaaggtcaggagttcgaaatcagcttggccaagatggtgaaaccccgtctctactaaaaatacaaaaattagccaggcatggtggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggttgaggcaggagaatcacttgaacccaggaagtggaggttgcagtgagccaagatcacaccattgcacttcagcctgggtaacagagcaagactcaatctcaaaaaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctcccaagtagctagggctacaggcatgcactaccatgcccagctaatttttctttttttaagaaagacagtcactctgttacccagggtgttcttgaactcctgtgctcaagccatcctcctgcctcagcctcccaatgcactggggattataggcgtgagccactgcactaaggctaattattttgtaagctttaataggtcagtagggtacttacaggtgtgctacccaatgaacatcacctcattcacttagtctgtcaccacacatttactgaacactttttttgtgccaagtattggggggtggggcacaaaaatgaatgaaacacagtccctgctgaggaggaactcacagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactagggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctccaattgaagcatcattttattctactcttgtgcataaatgattttttattcaactatgtcaactttccttctgttcatatagaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgagtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgtatatttattcttgtattttttaaccaatacttcaagcgagcattctgaaaatgcaatagcccctagggtggataatactcttgtgtttccaggaggcaaagttagcttttccgaaaatcaaatgatggaacagattatgactctaagctcttgttgctcagtaaagcccagcctcttctctgaggttttcctgacctgagggttacttcagttgtacagatgtgaagcgtgctcgaggagtatgacccttggctaaaggaaacccaaaaggtaggataattggtagagacagtttatggtgaagtttctagattccttgagggagataagaaaacttgaggttgtgaactagtttgcttgaaaactgctttttttttttgagatggaggcttgctctgtcaccgaggctggagtgcagtggcgcgatgtcagctcactgcaagctccgcctcccaggttcacgctattctcctgcctcggcctcctgagtattgggtactacaggcgcccgccaccacgcccagctaatttttttgtatttttagtggagatggggtttcaccgtgttagccaggatggtctcgatctcctgacctcatgatccacccacctcagcctcccaaagtgctaggattataggcgtgagccactgtgcccagccgaaaactgccttcttaaagtacttgttgaggacacactgctttagcaagtcctgtaagaggaaataaggtatgcacagatcaaggcctcatctaagactttatggacccagtgcctagatcaggcctggcacacagtagatgtgtgacaactacttgctgagtgaatgaagaaagaagtgagagtactggcagtcccattggtgaactccattcctcctcacagaaaggctggttcacatcgacattcactcgctgtctttgtgaaggaggtcattttattgatactgcgtaccttcctctttttctagcccaagagtggtagccacaaagtgtcctgccctgaatcatctggatagattgtaaaactggctgttcacactagcctagattgctagagctcatgtcaaactcataggccccctagtctgcattcttaaaaagaattaattaggggaagcatcttagtctccagagacagtggttagccctttcatctcactgagactaatctaccttaccctttgctccactcaaatgtctctacacatcacacaaagacaggtggtagcagaaactgatgtttacttgattcttgaatcaacaagatttatatgaggtgacatcctcttatgaatttaactagtcttatgtatagcaaacagaatcttaaaatagtagttatcctttttaggaagtcgtgcataaaatcactgggctcccggacaaatatgctgaacttggttagtgaccttacacagactcagaacaaggcatcacaactcttgccccttgtcttgaagagccatttttaagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaagtgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcataggaccaaaataaaaatggtagaaaaataaaaaggaaggttggcatggactcttcaaatcataccacttaacatctaactggctttgggtgcagtacacacaacttccagcccctgggaacacaactctaactaacttgctcttaatttttcctgcaccctaggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaaggtactatagcttacgccgaagaccttagcaaacaaggcagcatgaactcctttttttttgttttttgagatggagtctcactctgtcatccaggctggagtgcagtggcacaatctcagctcactacaacctccgcctcctgggttcaagtgattctcatgcttcagcctcccgagaagctgggattacaggcacccaccaccacacccagctaatttttgtatttttagtagagatgaggtttcaccatgttggccaggctggtctcgaactcctgacctcaagtgatccagccaccacagcctcccaaagtgctgggattacaggcgtgagccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcaagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagttctgcctatttttccttgtactcatgtccccggctcaccagttagatcccagtctaagtgctgtgtcttacccctctagggaaagaactcttgagatgaggggtaacagggagggaaggcctttcagatttctgagtagagaatgttttgcctcttgattgtttcatgcaagttaaaatgcctcaagtggagctgctgccactgcaactaaaatccctcaacaacttcaccttttttttctgccctactttctagacatgacatttttgggagcattcttaagatgtacttagggggtccaagcttctcttacgagagagaattgccctagagtggtcataagtatcatggtaaccaactgcttttttgaatctttggtgttaccaaacaaaactaaaaaaccttaggttatggcaggtaggtaaggaggtggtctgggaccagcttcctgaagaacacacacatgcctgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgttttgttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcggcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaagaggtttcaaactcagtactccaaacttttcctttagccccaaggaacaccacagccacatatagattcagtgtgtttagtttctggaggacaggagtggttttttcttttttttcccttggcagcagagatcttctctatcggcactctaaaaaatgaaacactccaccaagggaacagcaggatccaatgattcatttaaacaatattaaataaaaggaatgcttggggataataaagaaaagaggattcggtgcttttacatattgaacaccctgccaagtgctctaaacttaaaattacagtaagcgtactaaagctggctgatatctcaagtgcatcaactagtctatagggaaatggcttaattctgaactatctctgtgccaatgggcttatgtaataaggaacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccgtatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaataaaattaaaattaaaaagacaaattcacactgagccatctggctttgctgatgttaaaaaaaaaaaaacccaaaatatttgtcttgacagaatatgttaaatgagttctacaaatttacaagtcagggttttaacatacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaa

SEQ ID NO: 2320 - DNA, 167637 bp, Homo sapiens; identical to SEQ ID NO: 2319

SEQ ID NO: 2321 - DNA, 148814 bp, Homo sapiens
atatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgtggaggggagggggcggaaataaaagtcgtctctgcactaaaggaagaagtacaatctgcatttcacttttttttttctgaagtaatctctgagaacattttgtccgttccgcatgtaatttttttccttgcatttttaatctctgccatgccaagaacacgtgaggaggtaacaagcgaagggaggggtagctttgcccgggggcagacctggcgtgaaccgggcatcctcgattcctctgtggggcctgctcctctcccgctgtcccacctgaaaaccctgcaggtcatgatacatggtcttaaaatcgtccctaccctccctgggtttaactcaaggctgccccagggcttcttagttttgccacctcgctcgctctttatgtgagtcccacataaactgtgactttatcctgaaagattagccgggtgactccgctgcagaaggcagggaagagagggaagctcgaggcggcggcccgggctctgcagaacagcgatgccggtgccttccagtaaccccgcggctgggggatgtctgggagccgcagcctgaccgccggcgcggggacgtgagccagtgctggccgggaagccgcgagcacggcgactgggcccggagcgggcagttacaagttaccactattcgcagggccaggtacctggcgctcgctgttgctgtctgcggtggctgccctgccatgacctcttgctaccaaaggctctgccattttaaagttgcctactggatctggcacagtcccgaaataccagctgtcaaaccaggaatagcatgtgaaacgccttttccttggtcttgggcaggggtttgttttgcaggcaaaaccacccccacttgccctaaagtgagctctagtctcaactccttggtttgctttgttgcaacagccccaaaccgagagaagggaaacacattctctctcctggagtctggctgggaaagtttgctcagtgcccacacttataaaaagcatttactggggccgggcgcagtggctcacgcctgtaatcccagcactttgggaggccaaggcgggcggatcacgaggtcaagagatcgagaccatcctggctaacatggtgaaaccccgtctctactgaaaatagaaaaattagccaggcgtggtggcgtgcgcctgtagtcccagttactcgggaggctgaggcaggagaatcgcttgaacccgggaggcggaggttgcagtgagccgagatcacgccactgcactccagcctggcaacagagcgagactccgtctcaaaacaaacaaacaaacaaaaacaaaacaaaaacaaaaacaaaaaaaacactagtacctgaaattgacatgccaacctaaagcaatgtttaggcaatttcaaatcacagtaactggcccatgtctgcttcctcttgcagggaatcttcatagaatgtgactttgttattgccagtgccacccgtatgtcatgtcccaccattcaactagcctagcccagcctagctctgctcccacctggttcctttccctcttgagagagcaaattttgctcaggctgcccagaaacatcaacctgcacacagacttttgcatgtttgttttcaaacattaaattaagaaacctacaaccagagaccctctcctacaccccaccttatgtgccttccccatgccaagtaaccccaaatcctttgaggcatctgcaaaatatagtacggtaagtacgaacctttcaaagggggttttatagcttcttctttcattcttcgggttgcccaaggatatgcaggttggggattacttctggaggctggaggtagagcccagttatggctggaataagcctccctgctacatgcctctgataagctggaactctgagatgacatgagagcacgagccagagacggctatccctgttctgttatgaaccccactttatatcaaggcaatttaagtacaggaagggagcaagctgcaaagttcaacactgggccatttattctccccattgcgacatcactcagaaaattacagtcatcagtgtcctagctttattacacccccagcacgcacacaagaaatgtaacttaactgattatcctcacaaatcagtccggaaaaaattcaaaacacatgcacaggatttattttctcagaggctctgtggcatgcattccgggaggaacgtggcattcaggtcggagggttctacgcggaatagagaatagatgcaaccgtatgatttgtggttggaaaagaaagggaacgtctgatgtgctccttcctcccctaccctaatgttcagcacttggagacggatggtcggctaaacttatcatttaaccgagagaatcaagttgttgagactggcttttcttccaaccggatacgtgatgggtggagcaggcgccccctgttctgtcccagcaacctactaagacttccgaacaggaaggtgacacacggcggaggggtgcttgaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccacttgtctcctgaggttctattggtccagggaatttctctacaacaccttgtgcagtcatagaaaatatagacggcttgataggagataggctaattacctccccactcctccaagcgaattgtctcacatttatgtctcggtgctgggaaaactgcagtcaaaaccctcaagtaggaatgactgaccaggatgaaaagtttgcactgaaactaaacgtttcccagtgcatgtgcattttaatgcttcagaaaaaattttttcactcttctattttatttttttatttctttatttgtcactctatagtctgatggactataaatgctaaaacctgagagcttcacaaagatatgactttttccatttaattttaaaaggcttataaattattgatatttctcaacatattagagaaaatattttgaaaaatattttttataaggacttaaccatattcactcttaagacacttcttaaatgtatcagctgtaattgtcatgattccccgggtatgttatcttccattgataacaaggcaatataattgtttcatattgttcaaagtaccatcaattttagaacaatcctatgaagagtttaagttcccatactttttgattcattgtttgatgctcacagaaacctttccctggaacaccctcaaaaaagctcatagaaataccagaaaacataattattataattatagaaaacataattattactctagagagaaactgaatggatcagtttttgttgaaggttgtcagcaaaggcatgtctttttttttttttttttttacagaaaatgatgatgacaaatgagtttattcattatagctattatagacaagtcactggcaatggtggttatttaaatgtctatttatagacacaggttgtatagtaattattaccttccatattcataattgtcaaatttgacatgcaaaaagatgtgatacagtagataactaagagaacactatctctaatcatagtgttaaaagttattaaaacccacaaaactaattatttcatttatcgcagggtttatattttttccaagacagaggtgataatattctacacccattccttctaaaaagtgagcccataggaaaattgacgggagggtaggaacaagatttggtagtaaattttttatgtcattcaggggataaattaaagagaagccagtgggaatacttgacatgggaggaatgagaagctttttttgtttgtttgtttttgtttttgacatagagtttcactctgttgtccaggctagagtacagtggtacagtcacagctcactgcagcctcaacctcctgggttcaagtaatcctcccacctcggactcctgagtagctgggaccacaggcacatgccaccatgcctggttaatgtttttatcttttgtagacacatggtctcactgtgttgcccaggctggtctcaaactcctgggctcaaatgatcctcctgcctcagcttcccaaagtgctgggattataagtataagccactgcgcctcacctgaggaatgagaatctacatagcaagaaacaaacagatctttctcaggctgaaaacttacccatctccatcttggcaatgttgtcaatgtctgatttagtataatccaatcaatgattaaaaaaacaaaacatcagctagaatgcaatatgataggtaaggaattgtatgtatgtgacaactttatttttggttctcaggattgacctggaaaatggtgtccacagaactttacataagattatgaaaaatgatacattggtctggacagaagagtaaattggaaaaatttgtaagtcaatatttaatactattggtaaactcaagaggactgtggtggccaggtgcaggggctcacacctctaatcccagcactttgggaggttgaagcaggaggatcacttgagctcaggagtttgagaccagcctgggcaacatagtgagaccctgtctctacaaaaaatacaaaaattatccatacatggtggcacgcctgtagtcccagctacatgggaggctaaggtgggagaatcgcttgagcccagggtgttggaggtttcagtgagccaagatcttgccactgcactctcgccggggcaacaaagtgagatcctatctcaaaaaaaaaaaaaaaaggactctggccttatatttttggcatgcctttactgttaggcatttgcattttaaaaggccacttgtcaactcaaaaaatttaatttgcaatgataaaatgtcaagcattcaaacaagaaacaggtctgagagctttggggtgagaggcctcccgcaatatctggcctggtcggcctcctctccattctctccaaggtaaaactacgtgggcatctacttcccccacaagtccagcagccagaatccttcctaagacacacatattaaaggtgtaactgacacgaaggcaatataaagggctctctttcacccccactttatttacaaagggccaatagtaaataaggagtctggatttctggtggacatcttttgtcaaactaaagtgaaacctgaaagctttgatttgctcagtataaatctctctccaagtctctcccgtttgttttctttctttctttttctttttttgagacggaggagtcttactctgtcgcccagactggagtgcagtggcgtgatctcagctcactgcaccctctgcttccctggttcaagcaattctcccgcctcagcctcctgagtagctgggattacaggcacgtgccactactcccagttaatttgagtacttttagtagagatggggattcaccatgttgatcagactggtctcggattcctgacctcaagtgatccacctgcctcagcctcccaaagtgctgggattacaggcataagccaccatgcccggcccaagtctctcccatttctgagcctataatcaatctagaaggaggcaacagaagctcgggccacccctaaggacttaaggactgtttcctgtaaactctgtgtgccagttgtaacaacaaaagatacatgtaatagtaaccagcaatggaaaaaccagttatggggatgtcagtctagttggcgacaactgaggcttgctacctgtgagttttttttgttttgttttgttttgatatggagtctcacttcatcacccaggctgaagtgcagtggcgcaatcttggcttactgcaacctccgcctcccaggttcaagtgattctcatgcctcagactctcaagtagctgggattacaggcacctgccaccacgcccgactaatttttgtatttttagtagagacagggttttaccatgttggtcaggctgatctcaaactcctgagctcaagtgatctgtcctcctcagcctcccaaagtgctgggattacaagtgtgagccactgtgcctagccatacctgtgagattttagacaaggtattctctaacccttaatcttgtcagctgtatagcggggagagttatacctgcctcatataagttgtgaaaaataatggaaataggccaggtgtgatggtttatgcctgtaatcctagcactttgggaggccaaggtgggtgggtcacttgaggtcaggagttcgaaaccagcaggccaacatggtgaaaccccgtctctactaaaaatacaaaaattagccagaaatcacttgaacctggaaggcagaggttgcagtgagctgggattatgccactgcactccagcccgggcaacacagcgagactccgtctaaaaaaaaaaaaaaggaaataaagaatttagtaagcgcctctctcatgttggagttttaagtagaaaatatgatctgtgtatatttgccagccccaccctacgcacatcacaagtacaaacaacactgtcgcacagtgcaaagggttccaacaaatcaaaacaatacatcaagtaattatgggctgtgagtaaggcacttgcacagcatgggccacttaatctgctgggccaaggcgaggcctatgtgacaggaattccgtgaaaggcctgaatgataatccaacctccccctcctccattcagtctccctcacagacagtgctcctgaatgtgctgtatcaagaaacgaaatgccatgattactgaataaagacttgtttaccaagtgtttgcagcaaagactgaagtttagtgtgaaaaaagtggagagcaaaccaaaactaactcaagaaagtttttacttgctcgaggaaacaacagaaggcaaatatagacctattgagagggtggagtcattgaaagaagatcagaggccagtcatacttatcgtgctttttctaggtcaataagcttatcctgcaggaatgagaagaggaacaagatccagctgaacctagcctctgttagttttaatcattcagatctctgtggtgcacctctttcatttactgatttattgtattgatataagttgatgaacatattttggggtaacatggtattttgaaacatgtatacaatgtgtaatgatgaaattaggataattgggatatccgtcatctcaaacatttattttttctttgtgttgagaacatgctaattcttcccttttaactgtttggcaatatacaataacttattgttaactctgatttccctactgccatatcgaatgctagaacttattccatctatctagctgtactttgtacccattaatgtgaatgggttcttgacaggcactgtcttaagccctgaatctaacaaggatgtcatgatgggcagcgttgctgtactcagggagggtgtggtctatattttgtaaaatggaactgcacgttcccaaaagcaaaggtgagcttatagacatttctgattttcctcaggccccgctatgccttaatgtcattaaagtacagccttgggcacgtttgatcatttagattatctagtttttcaagtgaggaatgtgctggaaagtcttctgcagctctgattttgtacagttctatgatgtctgggaaaaaaaataaacccagaaggaacttctggaggcccagaactactctcctggcatggtttcctataataatgtcccacacccagctgatcctttagaagaacctgtccccaccccacccccaccccccacccccggcattggatccttcggtcaggaatttgtgtgcttagttatttaaatctcaggtgtttctctggaccttgagttccctgaaggccaggcagcacaatttgtgtctctcacctgcctaacattctctaatcaggtcgctgcctgcccctctgacctctcctcctaccttctccctccctccaggtttgtaccactgtggtgctctctgttccctttgcaggccaagctagtgtctgcccgagggactttgtctttgctgtgcccttcacctggaatgctttcctcctcaggctcacatggctggctccttcttgtcattcggatctcccagtaaatatcacttacaggccgggagcagtagctcacgcctgtaatatcagaactttgggaggctgaggcgggcagatcacgaggtcaggagatcaagaccattctggccaacatggtgaaaccccgtccctacttaaaaaaaatatatacaaaaattagctgggcgtggtggtgcgcgcctgtagtcccagctacttgggaggctgaggcaggagagttgcttgaacgcaggaggcagaggccgcagtgagccgagatcacatcactgcactccagcctgggtgacagagtgagactccatctcaaaaaaaaaaaaaaaaaaaaaaaaatcacagtgacgcagtggaccaaaagtagccagcagctgacctttctttgtcattcactctatttcaattatctgcatattagttttattatgtgactttttctgggtttattgttgatttacccaactagaaagtagtctctatgagatagggatatcatgtttgtttgtttaagacagggtcttgttctgtcccgcagtctggagtgcagggctgtaatcacggctcaccacaacctctgcctcccgggctcaagcaatcttcccacctcagcctctctagtagttgggaccacaggtgtgtgccaccatgcctggcttatattttatattatttgtagagatgaggtcttgcggtgttagccaggctggtctcgaactcctgggctccagtgatccgcacacctaagcctcccaaagtgctgggattataggcataagccaccgaccctggccggaataattatctatattatttgccacatcatccctggtgcccaggagagggcctagcccacaggaagtgcttgagaaataaaatgctttcataatggtttgcattaaaccccctctatggacgatatcatatgaatttggcttatagaaaagtatgccattgtaacctgttttactcttgtcatccaaccaactttcctcaagaactttagaacttttcttcctgccaggggatgacacagtcacctcatagactgttttctttctgtcttgcagccatgaagttctccataatttttgtattgccagaaagcctgaatgaacatttagcacaacccccttctactttatatccctttatatcctcccaaaatagccttctctacacaatgataaggacttgataaaagggcccctattgtgcagtcccagcctggacaaagtagttttaaagccatagcagaatggccatcaggttgtcagaaatgacaaaagccacagcacatatgcaagtggtacaaatgcttagtgccaagttaagatatgaaactacactttcatatctctatgagtgtgtgtgtgtgtgtgtgtgtgtgtgtgtgtgtattagttttctggagagacaaaaccaataggatatatctagagggagacagagaaagagatggagaaagagaaagagaagagaggagatttattaggggaattggctcatacaattatgaaagctgagaaatcccatggcaggctgtctgcaagctggagaccctgggatgccactagcatggctcagtccaaatctgaagaactgagaatccgggggctgctggtgtaagtcctagcgtccaaaggccaaaggctggagaacctgatgtccgaaggccggagaagaagcatgtatcccagttccaggagagtgagtgacctacccacggttctatctaggctcccaagcgattggacactaccccccacacccccctgtccccgcattagtgggggcgggtcttttctacttagtccacccagactcacacatcagtctcctttggaggcacccttaaggccacaccccaaaataatgctttgccagttctctacgtattccttaatccagtcaagttgacacttaaaattaaccatcacacgttctcacctttcaacttggcagccattacacatctctttgtatcacacttaatctccaaataaagacaatagcaaagtgataattctacctaatataatgcacctgttctgtgtacaacagaaaacataccagtcccttccccagaagagaaggtaaagtccttgggtgatgtttactcttctgctgatatcccataacttaaatactatgatataaaattaacaatacttaaatactgacataaagtcaataaatcttgtaaatactgatataaagtcaataaatgtgttacatgataaagacataagagaagaatgaaaacaaagatattaatatatgtacatagacgcacaacatattcttaacaaaacagggaggaaatactcatcacagttgcagtgcttggttctgtaactggtcacgtgatcatagctggtatttataactaccttcctttaccacccattctatatttcctttaccttcaacaagaacctcagttgattgtggttctttatgtggcaggtgacccaaacctacatttctgaagagtctgggccattcacagacttactcagattgagttgttgtaatttctcattgaccttaatcacaggacatggtaatactaagagacatcctaagggatctcctgtatttcagacatacacttctgggttttttttttggttttttttttgagacgcagtctcactgtgtcgcccaggctggagtgcatgggtgtgatctcggcttgctgcaacctctgcctcctgggttcaagcaattctcctgcctcagcctcccgagtagctgggattacaggcacccaccactatgcccggctaatttttgtattttagtacagacggggtttcagtatgtaggtcaagctggtctcgaactcctaacctcaaatgatctgctcgcctcggcctcccaaagttctgggatttcaggtgtgagccaccgttcctggcagacatacacttctttatctccattgtggaatagtagtccaatttctccctagtattttgaatcagttactccagccaacatcataactcccttcttagctttttgattcagaggcatgaggatcccaaagtggctgggtggtagtcttaacttccagttcaatggaatcattgttgtgtctccggaagcactcctccctctggaactaagacctccaggcctgcagatcataaagtcgtgggaacagaaagcaaaaatgtttccaatgggtcactagggggaatagtgagtggtgccactcccatttccaccccttccaccccttccatttctggacctgtggatcctggctatgggagaagcagcaccatatactggatgttgattcagagcatatacaactttctggagaaccttgcaccagccatgcaaaaaaatcatcaccgtaacttcaaaaggccattacaccattcattctattaacccagctgctccaggatgatgggaaacatggttaagaccagtgaattccaggagcatgggcccattgctgcctctctttggctataaaatgtattccttgatcagaagcagtgctgtgtctgtgtggaataccatgacaggggatagggcattctgggagtccatggatggtagttgtggcagaagcattgtgttcaaggaaggcaaatccatattcagaataagtgtctactgcagtaaggacaaaacactgcttcttccatgatggaagctgtccaatataatcagcctgcgaccaggtggctggcagatcaccccgaggaaaggtgccatatcagaggctcagtgttcatttctgttgctggcagattgggcactcagcagtggctgtagccaggttggccttagtgagtggacgtccatgttgctgagtccatgcataacctccatccttgccaccatggctactttgtttatgagctcactggatgcaagagtagttggggaaaggggctgtttggtatccacagaatgggtcatcttatccacttgattgttaaaatacccctctactgaggtcaccctttgctgagaattcatgtggacacaaatatctttacctttttttttttgctcattcagagaggtctattcacagatcacttccccaaatttctttgtcaccaattttccaatcatgttccttccaagtctctgaccatccagccaaactattggccacagcccataaattggtatataatcgcatatctggccatttctccttacaagcaaaatgaacaaccaggtgctcgaggttctgctcactgtgcgggtatcttttcagcactgtccttcagggacctgccagaaagagaccacagtgctgcagctgtccacttgtgtgattttgtgattttatatatagagatatatacatgtatgatagcatcagtaattcagcggtgttacccatagcatgagggtatgacacacaggcttcacctcacacagagacatgaaaacaataatccaccaacttcatactaagcaataaacactaagatttttatttcctgaggattccacaccttcattttcttagcacacagtagatttcagagccaccacgcctggccaacttttttttttgagtcagggtcttgctttgtcacccaggctggagtgcagtggtgtgatcatggctcactgcagcctcaacctcccgggctcaagtcatcctcccacttcagcctcctgagtatctggggctacaggcacatgccaccatgcctagctatttctttttctttttttttttttttttttttgagacagggatctcctatgttgcccaggctggtctcaagctcctgggctcaagtgatcctcccaccttggtctcccaaaatgctgggatacaggtgtgagccactcacgcaacccagacaatttttttttacagacactttttataaaactatttgtttctcagttgtgattatagaatccctttaacaaataagattagttatccccagaggattgtttgatggtttggggccaagcatttcagatactgcatattaactacctcttttatacaggtgtgtgtgtgtgtgtgtgtgtgcgtgtgcgtgtgcatgtgtgtatatataaatatacacatatatttttgtgtgtctgataacaccaactttgttccctaatcatcatttcacagaagatacaaatggaatctaaaagaatgaaaataagcttttgtataagaccacaagaaaattacagagaataaatgaaacagatgtgagcaaaagatggggatcatacataatgtctgaccttataaactacataaacatggttacttcaagaagctactactataatattacttattatttgtttatacaattttgcttaaaattacatcgtactctctacttatttagagcaaatgattgtgccaaatagataagactatttccatcaattagtatctacaattattctatttcacaactcataaagtgttgcttaaaaatctaattccttagagcacaagcacagatcatcacaatagacctagttaaagttcattcttcaaatcgtgttgtttatataccttattatatactgacataaatccagtttagcaaggtatttaataagccctgactttcctttttaaaagcagaagtattcccttttctctctttaccacattgtaagtactgttttttttggttgttttttgtttgtttgttttgagacggagtctcactctgtcacccaggctggagtgcaatggcaccatctcagctcactgcaacctccgccttccggattcaagtgattctcttgcctcagcctcctgagtagctgggattacaagcacgcgccaccatgcccggctaatttttgtatttttagtagagacatggtttcaccatgttggccaggctggtcttaaactcctgacctcaagtgatcggcccgccttggcctcccaaagtgctggaattacaggcgtgagccactgcacctggccctaagtactgtttttatatctacaatctgctcctatattcataactgatggccctttgacttttccttctatagtgggaaaacaacaatcaaagagcagaaatggggccctgtcatacatagttccttccttccttccttttttttttttttttgagatagagtctggctgtatcacccaggctagagttcagtggcatgatctcggctcactgcaaactccgcctcctgggttcaagtgattctcctgcctcagcctcccaagtagctgggattacaggtgcacaccaccaggcatggctaatttttgtatttttagtagagacagggtttcgccatattggctacactggtcttgaactcctggcctcaagtaatccacccacctcagcctcccaaagtactgggattataggcatgagccaccacgccaagcttcctggcatacacagtttttaacaccccttgtcactgttctcttcccacctcccattatcttttcttagggctttgattttcttgaggattataggtttttaaaaggttgaaagggaccttgcaaaatccctcaggactgctattccttttctatctcttcttaaaaataatgttaaagaattaatattacatacattacaaatattagaaagtacatttacataagatgtgaaagaggcatacgatggtaacagacacactagacttagctggattacttctaggaataatagtaagtgtctaaaacaggttgccttgttagaacatgatactactgaatctgagtgcttatcttcctcatatgtgccaattatgtttttgtcgaagagcaatcctttctgattttcgcagactgctttctgattatttgtctcacaaagagactgggtaaaagcatgtggctttatttttgccatttctaaaaataacccaacagctatgctgtgcactgctcaccttagcactattgtattcatgtgtttatgtgtataaaggacagttcatagtcagcatattcaatgcttttctccctctttgttttaaagttcaaagttactgtctacacgaaagttggggtatttcaccactagcctcattttatgctattcataaaatcatgagcagactttttaccaagggcaaaaaaatcttaagaaacaggaacatcccccttcccccatacaatattcctgacaaccatttattaaggtctttctctaatctttcgctggaatcacctctacttcccaaaccatctctaccactgtcaactagcatcaatcgttaaagttcttcgttaggctgtgatcaaatatcctcatgaaggttttttaaggagtagctcttctacacattctcaaggcgggtactacagtggtgctaaggacatacctatcagcgaaatgaacatgttctctttaagttccacagttaagtccacctattataatagctgacatttcttgaacgattatactaagtggcagacactatgcatagtgtttggtgttttgtttttttgtttttgtttttttttttttgagacgaagtctcactctgtcgcccaggctggagtgcagtggcgtgatctcggctcactgcaacctctgcctcctgggttcaatggattctcctgcctcagcctcctgagtagctgggactacaggcatgcgccaccacgcccggctgattttttttttttttttttgagacagagtctcgctctgtcaccaggctgcagtgcagtggtgtgacctcggctcactgaaacctccacctccgggtttcaagggatgctcctgcctcagcctcccaagtagctgggacggggcccgccaccatgcccagctaatttttgtatttttagtagagacggggtttcaccatgttggccagaatggtctcaatctcctgacctcgtgatccgcccgccttggcgtcctaaagtgctgggattacaggcgtgagccaccgcgcccggccctgatttttgtatttttatagagatggggttttgccatgttggccgggctggtctccaactcctgacctcaagtgatccacccgcctcagcctcccaaagtgctgggattacaggcgtgggtcaccatgcccggcctaagagccaaaattttaatcagtgggaaatgctgactgccacgctcatttaagaggaaaggtcaggatttcgtgagctgcattgttcactgacatctactttaacgactccagcccagcctgagctaatcttttcctaaatcctttgcattttctttctactgtcaatttacaccttaacaaaataaaggagttttagagtaagatagaatcaacttcaatcaactctcttgaattcgctggggaccctctgctctaaaatatagtactattcttgcctctggcatccctggttttaccttcgtcttcctacctccctcccacctccatccatcccccctccccccattcttttgagtgcagtggcacgatcttggctcactgcaaactctgcctcccgggttcaagcgattcccccacctcagcctcccgagtagctgggattacaggcatgcaccaccatgcctggctaatttttgtactgttgtattttcaccatgttggccaggctggtctgaaactcgacctcaaatgacccgcctgccttggcctcccaaagtgctgggattacaggcgggagccactgcgccctcctggtccacccactattaaccccttatttcctacccttcacctgcacctctttgagggccatttcattcctggaatagcctgttttcattattagttatgggcctattttccttactatgtacaattttaaagtcataaaataatttttcttcagatgttaaaaattgtgtttacatttaaccagataaaacacttgttattaagggcatatgttcaaaaatcttcttttccatttattttctctaagtcaggcatataagctgatatcatgtcttacatattttaaactaaatttgacctgaagtcacctctgttccttgaatctctacctgattgcagctcagcttagtatgttcacaaactgaaaacctaatttaggagtacgttataagtcctcactaaaaatggtagctaggttcttagatattgtaactttaagtgaaataaagtataaggaaaccaatttcaccataagctaattgatataatgaggaattaacttcctattgcatacttatggacataaaaacatcacataacttctaaataaagaccaaaacacttcaaatactgaacattgaaataaattcccggtcttgcccaggtgatctcatctcagcctcccaagtagctgggactacagggatcttctccctttgttttttttctagccccacttccagtttgtttccacagtacttagagtgagttgctgttgtttttcttctttgttctgttctctctttattttcttatgttccttcctgcacactgaagttgctgttgttttagattttctttttttgagtgagatcttctcactcagtcacctggctggagcgattaatagctgactctgggtacagtgcctaagctagccttgctctgcaaggaacagttaaaaaagaaaagaaaggagaggagaggggaggggagaagggaggagaggggaggggagaagggaggagaggggagggaaggggaggggaggggaggggaaaaattaataaaaactaagataactatttacccaatgattccacttgaggtggtagacaacccaagcttatcctggcagctcagggaacaaggtgacaccaaccttggacaggagtccgtcccatcctcaaggcacactcacactcacacccacactcatgctcactcagactgggacaacgtgaacacgccaatgaacctcaacatgcatatctttgggatgtgggaggaaagtggagttacatggagaaaacctacaaagacatgaagagaaagtgtgaactttacacagactgtggccccagctggaaatctttttttttttttctcatcaatgttataacgacatgctatatatatttttgttacaactagctgagtctcagccaatcacagcaaccaaacttcagctaatcacagcaactgagcttcagccaatcacaggatgccaactgatcagacgatgcccaaataaggcaaatttggagctttaaccagtcaagctgtttgtgtacctcacttccagttctgtctataaatgctccctgtccacctatttgcccagtggaactctctgagcctcctttggttctgagggctgcttgattggagaatcattctttgctcaaataagctgttaaattcaatttgtcaaaagtttttcttttttttttttttttgagacggagtctcgctccgttacccaggctggagtgcagtggcacgatctcggctcgctgcaacctccgccgcctcccgggttcaagtgattctcctgcctcagtctcctgagtagctgggattacaggcgcacaccaccatacctggctaatttttatactttttggtagagacgaggtttcaccatgtcggccaggctggtcttgaagtccttacctcaagtgatgcgcccgcctcggcctcccaaagtgctgggattacaggcgtgaaccactgcacccggcctacaagtttttctttccacagtattatgtatcctgtattatgagataaacttcttgggcaaaaagcaagccattaaaggctgaatatttcagcatgcctaacttaataaaatttaggacattttaacttttgctacagttaaaatccactagactttttgatctgctgccatattagtttgattcaaaataatgagagcagatttattaaaatatgaagttgcatttcatattttccttgtattttttaagtgagaaaatttcctggtatcattttagctatcataaaatgccttttaggactatggaaatgaaagatcttggacataaatgatttggataaaataagcacatgaaaatactgcctgaaaatagttttaaaagaatcctgaggaattagaaaaacgagctattgtgaaacactgttagtttagcctttagtaaaacagcagaaataacaagcaattttggtcagaacaaagagaaagagaaaattgtaagttccacaaacgcagaaacagattttgctccaattggaaagcttcagaaagctaaacccttcatttacacaatccaaggcagagtgaggggcctctctgtgttgagctaaactgagcctatagtcacacattcacacatttggcactaggacagttgtgaggataggatctgacaaacttttcactgccaaacataactcagatgctagatgagcatgactctaagtatctttacacagagagtttagaaataacatttccctactcactggaataaataacccatccttgaacttggaaccatctaaaccattgtagatggtttaagtcatgcaaaacaaagtgctttttgctttctagatcttagcttaagaatgcaatattttatctaaatgactaggcaactaaggttcgctccaatttgaggattttaagtctagccatatgtctatttccaggaagcttatcagttttgtgtctggggctccagataatggaatacagcaaattataagcttcatggttcagcagaaaaaacaagtttggggtccagtaatgtataaaatagtaacagtaatgataaaacaaaatgcattcttctttcaaaccatagttagtaaatcccatgaaagtgtaatcctagataaatgtaatcccatgtaaatgacataattctttctccaggtaaaaagagctaacataaattgaccactaattatatgttaacacagttataaatacctttactgcattatcttttttaatccccacaaaattctataatctattattactatttcatttttgcatgtataagaaatgaaaggacagagggttaaataatttgcccagccaggcacgtgactgtaatcccagctactctggagggtgaggcgggaggatcacttattttttttaaatttaaaaagagatggggtctcactatgttatccaggctggtcttgaactcctgagctcaagtgagctacctgccttggcctcccaaagtgctgggattacaggtatgagccaccgtgcctggccaagaggatcacttgagcccaggagttcaagtccagcctgggcaacagagtgagactctgtctcaaacaaagaaaacaaagaaaaaataataatttaccctaaaaaaaattaaaataataataataaaataataataatttgcccaaagtcacacaggtagtaagcattgaaatctgtggcaaactcagaaggcctgactcaagaattcacgacacaaccacaacagattgtacactaccgggcagtttcctgctgctctgtgcatggcctgctggccaactctgatgtgaggtcagttgactaaaagagatgtggttcaggaagctgagaatgattgtggttacctgttctaagatagagaaattgatttttaaaacttcgagttgaagtacgggatgccaaaaaccacgtatgagtgacagagtgagtgggtctctttctgatggattaagtcttcaaaaagactttcagaatgaatctctatctaccttaattttgggcagtgttaattgtattcattttttcaacacatttgattgtgcatataccatggacaagaaagtttgttaaaaactgaatgtataaggctgggtgcagtgactcacgcctataatcccagcacttcaggaggctgaggcggacagatcacttgagcttaggagtttgggaccagcctggacaacatggtgaaaccccatctctacaaaaaacaaaaaaattagctgggcgtggtagcttatgcctgtagtcccagctacttggggggctgagataagaggatcgcttgaacctgggaggtcaaggccacagtaagccgtgatcgcactaccgcactccagcctgggtgacaaaataagaccctgtctcaaacaaccaacaacagcaacagcaacaaaaaccctaatgtacaggaaattattttggggagtagtggaagatagctggcaagttggagactctaacttgagatgtggtactacttgtctgtacattttttttctcatttctgtctacccaaaggtgttatgtttttattgtcttaagggggcccttcatttgatggcataaaaagttatgaccagccatctgtagttcagttaataggtcaagaatatcagcagctattgttatgttgaggtcattatttatcaagcttcaacacataaaaagcaaaagtaggccgggcgtggtggttcacacctgtaatcccagcactttgggaggctgaagccagtggatcacttgaggtcaggagtttgagaccagcctggccaacatggtgaaacttaatctctactaaaaatacaaaaattagccaggcatggtggcggatgcccgtaatatcagctacttgggaggcagaggcaggagaatcacttgaacccgggaggtggaggttgcagtgaactgagatcgcgccactgagagcactgcctgggcgacaaagcaagactccatctcaaagaataaaataaaataaaataaaataaaattaaattaaaataaaataaaatataaaataaaataaaataaaatataaaataaaataaaataaaataaaatagcaaaaatagtccaaatgtcagttaacagggggaccaaatttatgggtgaacatccacaagaaacataagtggcctctagggaagccaatctttgcacagaatttttgtttaatgaggtggagggtatacaagatataggccaaaggataatttaggttcttatgactgtgtccttgttcttttcaaatcctagcttcatctctgctcccactgatgacactatgagactttggaattcttcactgtgtgtaagacgattttattactgagatagctaccgctttgtagttatgacctgagtaaacaaggttagtcaacccacaggattttcatgtgtccacagatttttactagataatttatctgtaatatcaggaggcaaagtctaccatgaatatactggccaacatgtatcagatggaaaattcttgtgtaagcagatgatgtttaacttttatcacatttttctcttttgttagataatgccatacttcggcagacaagcaattgttttctagctataaatatgagtattttgcttttcaagagaaaaaatctagaaattgttttctttactttaaaaaattcatgtactgaagtccttcctctgcttgtattaatccaatgatatcattttatatattctctgaaatactaaaatatttctgtagtccatatgttttcaaattatgaatcattttatttctacatttggtacataaactattactgctcctgagtaaatatggatataccactttatagtgattttttttcttctttttctctttttctattttttttttttttttttttgaaaacagggtcttactcctggcctcaagtgatcctcctgcctcagcctcctgagtagctggaattataggcatgagctaccagtagtgattcctaagtccccagaaatttgagctaatttttatttatttatttattcttgtatttacttattttgaagacaaggtgtcgctccgtcacccaggctggagtgcaatggcatgatcatggctcaccgcagcctccaactcttgggctcaagccatccttctgcctcatcttccttagtagctgggaccatacgtgcaagccaccacacccagcttgagctgatttttttaatgtgatgaactatgagaaaacatataggagctaaatgatgagaacttagaaacacaaagacggaaacaacagacactatggtttacttgatgatagaggatgggagggtgaagaggagcagaaaagataactattggataatggacttaatacctgggtgatgaaacagtctgcacaacaaacccctgtgacaagagcttacctatgctggcccggcatggtggctcacgcctgtaatctcagcactttgggaggccaaggcaggcagatcacttgagctcaggagttctaggccagtctggccaacatggtgaaaccggatctctactaaaaatacaaaaattagccaggcgtggtggcgggtgcctgtaatcccagctactcaggaggctgagacagaagaatggcttgaacctgaaaggcggaggttgcagtgagctgagattgcgtcactgcactccagactgggcgacagggcaagactctctctcaaaaaaaaaaaaaaaaaaagaaagagagtttacttatgtacaaaccttcaaatgtaccaccaaacctaaaacaaaagttaaaaaaagaaagaaaaataaatgtagaaaaaaatatatatatatatgaacaacgcataatcctggaaatataaggaaaaattaaattttctcctctgggaaaaatttatacagtaatgattcttgctctttaatttttgtttgaaagaaatctagacatttaaaaaaccccagtggtagaattgtcttgttaaaaagggacatcaagtaaaaggccaggggaacatcaaacaattatgtttcttacctggcaaaaccagtgtctagctaaaataatggcttgcaaatcaatcttgttgtttaaccacttcattatctggttttctctaagcaaagaacattatctgtgttgccaataatagtactggggaaaaacacacattttgaaagtatgaagaaactcattctaccttgaaattctcattcaagaggaaattataggccactgcaggaccagcgattgaaaaacaaaggtgtacaaaaacaaacaactcaggtttcaaaggctaaaaacaaagataacaggaaagaacctaaacttgtgcagcctgtttgcttactgtctgaacaaatgctgggaatgcatgagaaattctaagccctgtgaacaaaagtgtgagcagtaagatgacgggtgatcaattttcttcctttctctatttttcattttttccctatgatgagcatatgccacttttatgttataatgataaaaaagaaagacttaaaaaatgacttttgtttttccaactgtataccagtatctatctacacatagcaactgagcacgctagtcctgtcgtctggcactcacacaaaaagagtgaatgtcaaaatctaggcaattctaccagatttcacgtaatgaaactaccttgaataattccttaattcttcacaaaatcatgtttttatttaacttctatttctatcaagcaatgtggactaactacccctaatatttaactctatttaaactgtgtatcaggccagatgctggctcacacctgtaatccaagcactttgggaggccaaggcaggtggatcacttgggctcaggagttcaagaccagcctgggcaacatggagaaaccccgtctctacaagaatacaagaaattagctgggtgtggtggcatgtgcttatagtcccagcttcttgtggggctgaggcaggaggatcgcttgagcccagtaggctgaggctacagtgagctgagatcatgccactgcactccagcctgggtgacagagtgagaccttgtctcaaaaacaaaacaaaaaacagattacacactacattaaataaataaaatactctctgatgatgactgattttgaatgaaaatactccattcactggaatatattttccataaaaaatgacaaaaacattgtcattttttgtattatttctttttcttttcttctttttttttttttgagatggagtctcactctgtcccccaggctggagtgcagtggcgcgatctcagctcactgcaacctctgcctcctgggttcacgccattctcctgcctcagcctcctgcataactgggactacaggtgcccgtcaccatgcccagctaattttttgtatttttagtagagacagggtttcaccgtgttagccaggatggtctccatctcctgacctcatgatccgcccgtctcggcctcccaaggtgctgggattacaggcgtgagccaccacacccagccttatttctttttcttttttggagatagagtctcgctctgttgcccaggctggagtacagtggcccaatctcggctcattgcaacctctgcctcctgggttcaagcaattcttctgcctcagcctcctgagtagctgggattacaggcagacaccaccaggcctagctaatttttgtatttttagtagagacggggtttcaccatgttggccaggctggtcttgaactcctgatctcaggtgatccacctgcctcagcctcccaaagtgctgggattacaggtgtgagccaccacacccgacctattatttcttgtattattaaaatcatttcaggaatttgtaaaagttacagtaataaaactcgtactgcaaccatgactagaacatggcctttgtaaagaatccatttacaggctcataagatttggtgttgtggatggatggctatggagctgctcaagcttgtgtttgcacttatcagaattcaaggcagttagaaagagtttccaagtgctgatgtgctggagaagaaagggcatgctgcagtgtagaaaccacgggagaaacaattgcgtcacctagtttcaaactgtgagaaaactactagcgaactagaagaatatttaacttcctaaacctgagagatctacatcttaaagaatatagattctactctaggcacatcatagtcaaactgataaaaaataaaaataaaaataaaaataaaattacagcagccagtaaaagactacacgttacattcagcatagcaataatgtaaacattgttgacttctcatcagaaactctacaggccagaagacaagaaccaatatctttaaagttatgaaagaaagaaaaacaaagtagccacgcagaattccatatctagcaaaaatatccttcaagaatgaaataaaggtatttccatttataaagacatatcatgtagataaaagaaaactaagatatttcactgccagaagacttataagaaatcctggccaggcgcggtggctcactcctgtaatcccagcactttgggaggctgaggtgagtggatcacttgaggtcaggagttcaagaccagcctggccaacatggtgaaaccctgtctctattaaaaatacaattagccaggcatggtggcatgcacctgtaatcccagctacttgggaggctgagacaggagacaggagaattgcttatacccgggaggtggaagttgcagtgagctgaggtctcgccactgcactgcagcctgggtggcagagcaagattctatctcaaaaaaataataaaaacatgaaaaaaaagaaatcctaaaggaaaatttccaggctaaagggaaatgataccagagagaaacagattttcaggaagaaatgaagaacatcagaaatggcaaatatctggataaaaacaaaagataattttccccttattttttaaaaaatgcactgtactgtagggtttagtacatatatagataatacatatgacagctataatataaaagatgagggtagagtggggtagatgcacctacattgtttgcaaattttgacgatggtctatgaaaatttaaagtcatttattctcagctgggtacagtggctcatgcctgtaatgccagctctttgggaggccgaggtgggcagatcacttgaggtcaagagatcgaggccagcctggccaacatactgaaaccccgtctctactaaaaatacaaaaattagccaggcgtggtggcacgtgcctgtaatcccactacctgggaggctgagacaggagaattacttgaacccagaaggtggaggtcacagagagccaagattgtgccactgcaccccagcctgggcaacagagtgagactctgtctcaaaaaaataaaaataaaaataaagtcatttattgtaatcttcagagcaccactgaaaatgtgatgcaaagaggataactagaaagtcaacaggtaaattaatattaaattctaaaacctattcaaataatcctagagaagtcaggaaaggaagaataagcaaacaaagaagagaagggacatatagaaaacaaatagcaaaacagtaaagttaaatctaactgtgtcattacattaagtataaaggggctaaacatcacaagtaaaaaaaacagagatcattagataggattttaagaggaaaatctaaccacatgatgtctataagataagcaccttaactataagacacaggttgaaagaaaatggaaagaaaaatatgccatgtgaaaagtaggctttagaagattggactggctgtatctatcagaagaaatagacttaaaacaaagacttttaccagagataaagaaggaaatttcctaatgataaaatgatcagttcattaggaaataataataatcataaagatgtgtgtgtggttgggcacggtggctcatgcctgtaatcccagcactttgggaggctgaggtgggtggatcacctgaggtcaggagttagagaccagcctgaacaacgtggcaaaaccccgtctctactaaaaatacaagaattagctgggagtgatggcatgtgcctgtaatcccagttactcaggaggctgaggcaggagaattgcttgaacccaggaggcagaggttgcagtgagccgagccgagatcatgccattgcactccagcctgggcaacaagagcaaaactccacctcagaaaaaaaaaaaaaagtatatgtgcctaataacagaggttcaaaatacataaagcaaaaattgactgaattaaaagaaccaaaagacaattctaccactagaggtggagattttaaaacactcttagtaatggactgaccaactaggcaaaaaataaataaataaataaataaataaataaataaataaataaataattactctagacatagatcctactttatgagttggttaagttggtgactgggaaggatcttcatgagatgagctcttgtaggagggacactccattctttgtaacactactgatgaaggaaaagtaataaaaacgttttaaaaatgagtatgtctattgcaccactgcactccagcctgggcgacagagcaagactccatctcaggaaaaaaaaaaaaaaaaaagagtaagtctgaaatatttctattcctatttctctatgtgttctgcattagtttttcttgtaacttttttttttttttttgagatggaatttcactctttttgcccaggctggaatgcaatggcacaatcttggcttactgcaacctctgcttcctgggttcaagtgattctcccgcctcagtctcccaagtagctgggattacaggcacgtgccacacctcccggctaatttgtgtatttttagtagagaaggggtttcaccatgttggccaggctggtctctaactcctgacctcaggtgatccacccaccttggccccccaaagtgctgggattgcaggcatgagccaccacacccagcccgtaacataatttatttaggcttcaaaaattgtccaagcaacattttctttttctttctttcttttctttcttccttccttccttccctccctccctccttttctttctttctttctttttctttctttctttctttctctgtttctctctttctctctttcagtgaaagcaagtttattaagaaagtaaaggaataaagaatagctgcttcacagatagagcagtcctgagggctgctggtcaagcaccattttctagacctgtcctgtacagatttccctccctttccattttctttacataacatcaagaatcatttatgttcctttggtaatgtttcattctacattgcttcttcataacacatgtgctgtagatcttactagcagtattagccagcagatggcttgtttattgtggtggtatactgctgatggactgaaatgatggcataaataggctaattcacttttatgttttttcttctttcttcaaaagatataataaaacaagacagaaaacaattttttgacagatgaaattgataatgtttagaccgtaagtctggtctttgaaaaaaaaaaaagccatcagaaagtttctcactttccttctcaagtcctcctgtttctgctaataggcacagcctctgactcccttttatgaagaacagattatagcacagatttagcccaagctgtttctgctaggagagctgcttcttcctaagaagcgtgctatagaactgggcagtccactctccattctcctagccttggtattttctggctgcgagctttggatatgtcagctaacctattcagcttattatttcatttctaatagaggcataacaaggaaagggctgtctctcctatttcaagggattgcggcaaacactacattagatttctgtgaatactccttgtaaaagcgtgaggcataatacaaatatcagatatcagcgtgagttttctatttcattagacctatttcattagaaaaggtgaaagctctattatcactctcttaattgttttagctcctttttgcttcaccttcccttttatttctagtgtctactttgtgcaattaggcctcacggctcatgtgtgtttgtgaaaaagaatttttaaatgtcttctatttgctatgagaacataccctactctttgtctaagcgtaatttctaatcatataacctgaagcatattctccgatctcataaagtggcattcttctgattctgattagatgtacagccctaatatcatagtgcaagtatacatgccctcccataagtattctgaagtatgattcaccctaggttttcaaatctcttccttgccctagaaaacaaacttggactcatgtgtttgcccactttattcaactcctctgtcttctactccagcaaatagactcattcctcattcctcccaacacttaaatatgcttcacaatccacaaagctgtacctgatgatatatatatatatatatatatatatatatatatatatatatatattttttttttttttttttttttttaaatgacaggcaggtaatgtgcagacatcataacaaggcttgaaggaggcatatctcacacaggaacatgaaaacccaatcatcacacttataaacgacaaagggatctagtatatacgttttagatactgaaaagaagacataacaaaaggacttttagggtaaaattgattgcaaggctaggtatggtggctcacacctgtaatcctagcactttgggaagccgagctcagcagattgcctgaggtcaggagttcgagaccagcctggctaacatggtgaaaccctgtctccattaaaaatacaaaaattatccaggcatggtggctcatgcctgtagtcccagctacttggggggctgaagcaggagaatcgcttgaaccctggaggtggaggttgcagtgagccgagatcgtaccaccgcactccagcctgggcgacagagcaagactccgtctccagaaaaaaaaaaaaaacaaaaaaaaaattaattgcagtgtattcgagtgttgggttaggtaagaataaataaacaaggccgggcgcggtggctcacgcctgtaatcccagcactttgggaggccgaggcgggcgaatcacaaggtcaggagatcgagaccatcctggctgacacggtgaaacaccatctctactaaaaatacaaaaaaattagctgggcatggtggcgggcgcctacagtcccagctactcgggaggctgaggcaggagaatggcgtgaacctgggaggcggagcttgcagtgagctgagattgcgccactgccctccaacctgggcaacagagcaagactctgtctcaagaaaaacaaaaaacaaaaaacaaacaaacaaaaaaatatttccccccaaaccttgcctttgtgtagagctttactacagaatgtatcctgtacataacaggaaacaggttgtatttttccaataatacctggatcatcattagtccagaaggttcttggatcgggcttggtcaggatgttggcatgattacatggctctctcacctttaaaacataaagagaaaagaagtgatataaaaatggcttcatcatttcagctattttaggcttatagttctagagaaaggattccaaggctgaaactagtacatatggcatgtctgtgctctaattagggtggttttctcaggaccgtgctgggtatagcactgaaagtcccatatcctgggaagccttttagtcctgggcaaaccgggacagttggtccccttacacatgaagcagtttcactgggctgatggctgggttagcacatgggcgctggagctcacccagtgctatgtgcagtgcacaaactgcacagccgtatgaagaggccctggattattagcaaatttatcagtgtagacactcaatacataaaaagtgtttgaatctccacataacagaaatgatacttttagtacatattgcttgggaaaatacatattaattaaaagctacttttaattcagtagcactttaaatgctttttttgtttgtttgagacagtcttattctgttgctcaggttggagtgcagtggtgcaatctcagctcactgcaacttctgcctcctgggttcaagcgattctcctgcctcagcctcctgagtagctgggattataggcgtgtgccaccacgcctggctaatttttgcatttttagcagagacggggtttcaccatgttgcccaggctggtctcgaactcctgacctcaaatgatccgcccacctcggcctctcaaagtgctgggattataagcgtgaaccaccgcacctggcctgcattcttattttataatcataacaggatctttatattctcaaatagcagcacatgtacatatgcaatatgtattatttagtccacttagaggctcttcttagtgcagatacatgtttttaatgataaataatatttattgagcattttctgtcaggtattttttcatttttaaaaaaatttcaatagatttttggggaacagatggtgtatggttacatggataagttctttagtggtaatctccgagattttggtgcacccaacacccaagcagtgtacactgtacccagtgtgtagtcttttatctcttgccccactgtcacccttccccttgagtccccagagtccattgtatcctctttatgcctttgcgtcctcatggcttagctcccacttatgagtgagaacatatgatatttggttttccattcctgagttacttcacttagaataatggtctccaattccatccaggttgctgcaaatgctattattttgttcttttttggctgggtagtattccatgtatgcgtatatatatatatacacatatatatgtgtatatatagatatacacacacacatacatatacacacatacacgcatgtatatatatgtatgtgtgtatgcatacgcatacatgtatgtgtatatatgcatatacatacatgtatgtgtgtgtatatatatatacacacacacgtgtttttttcgtatatgatttcttttcctctcgatagatacacagtagtggaattgctgggtcaaatggtaaatctacttttagttctttaaggaatctgcatactgttttccatagtggttgtactcagatacaattaatagatttcatataacaagttccacagagcagcagtgatccatgtttttgacagctttatactactgtgatattagctttcaaatatattctcaggccaggcgtggtggctcacccctgtaatcccagcactttgggaggccgaggcgggcggatcagctgaggtcaggagttcgagaccaacctggccaacatgctgaaatcccgtctctactaaaaatacaaaaattagtcaggcatggcagcgcatgcctgtaatcccagctactcaggaacctgaggcaggagaatcgcttgaacccgggaggcagaggccgcagtgagctgagatcgtgccactgcactctagcctggacgacaaagcgagcctctgtctcaaaaaaacaaacaaacaaacaatcaaatatattctcatgaagttaaatatagatcttagtgttaaaactgcttttccatttatatatattttgtaatgtgatcatttgattactgcaaatattctatagtttcatcaactacttagtggataaattccttccattgcaacaataatcaaaatactcaagaatgacactaaggtcattgtttagtttcaccgacattttctctttataacaaggcttttgtttttctttgttgagatggagtctcgctttgttgcccaggctagagtgcaatggtgtcatctcggctcactgcaacctctgcctcctgggttcaagtgattctcctgcttcagcctcaatagtagctgggattacagacgtgctccaccacgcctggctaatttttgtatttttagtagagatggggttttgccatgttggtcagactggtcttgaacttctgacctcaggtaatccgcccacattggcctcccaaagtgctgggattacaggcatgagccaccgtgccaggcctgtgaagctctattgacgaaggaagcagtgcatgaatttaccatctggtacaagctccttctcttgtggaccagtatcaaagaatatgtggaaatcagagaaattgggatctcaaagaggtattttcacttccatgttcattacaactttattcacaacagccaagatgaggaagcaacctaaatgtctactgacggataaattgataaagaaatgtggtaaatacatacaatggaatattatttggcctcagaaagaaatcataccatatgtgacaacgtggatgaaactggaagatgttatgctaagtgaaattagccagtcacagaagaacaaatattgcacgattccgcttacataaggtatgtaaaatagctaaacacatagaagcagagaatagaatggtggtttccaggggctgcagggaggggcaaatgggaaaatgcttgagttgctattcaatgggtataaaatttaatttaggcaagacgactaatttctagagatctgctgtacaacatggtgcctagagaacattactatattgtgcacttgaaaaattgttaaggccaggtgcagtggctcacacctgtaatcccagcactttgggaggccgaggcgggtggatcacgaggtcaggagttcgagaccagcctggcaaacatggtgaaaccccatctctattaaaaatacaaaaattagccgggcatggtggcgggcacctataatcccagctactcgggaggctgaggcaaaatctgggaggtagaagttgaggtgagccgagattgtgtcacggcactcctgcctgggcgacagagcaagactccgtctcaaaaaaaaaaaaaaaaaaaaaaattttaaaagggccaggcatggtggctcacgcctgtaatcccacactttgggagactgaggcgggtgggtcgcctgaggtcaggagtttgagaccagcctggccaacatggtgaaaccccgtctctactaagaatacaaaaattagccaggtgtgggggcacacgcctgtaatcccagctactcaggagcctgaggcaggagaatcgcttgaacctgggaggcagaggttgcagtgagccaagattgtgccactgcactccagcctgggcgacagggagactctgtctcaaaaaaaaaaaaaaattgttaaaaggatagatctcatgttatgtgttctttccacaataacacaaaatctagaatagattgccatcctattttgtcagtatatcagaaaggaacagaagacatttgatacataaatatgtaagtggtctatattttataagtggaatttttttttgtaattgtaatacatttttcatttataggaaacatgattgtagatgtaagactgaaggaaaaaatgccattaaaatttaaatctcaagaaaaaaggacaggcctcttgcctctttgcctcattgaaatcctgaaagcaagatgcatcaatagcagctctacaagagccattagtgaaaatttggccagggttctcgctcttgttgcttctgctccaaccagcatggtttgacccagattatgtgcagccaatttttccatcagtatgcaaagtaagaggtagacttcattacgttgggctaagtgatcttccttgaatagattaccaaaatcatccacccagtgaaagaaaccatgctagctctttgcacgtaaaataaattaaaaagaaaataaaagaaagaagaagaacaagaaaaagaatgtgtggagcagtaacatttcctggactacattttgagcagcactgtaaaatatccctcctactgaatcacttgaacccgggagactgaggttgcagtgagccgagatggctccactgcactccagcctggcgagagagcgagattccgtctacaaggaaaaaaaaaaaaaaaaaaaaaaatccctcctacctgactaagcagcctcagtatgaatcccttctcaggatttatctactccactgaagtactacttcaattgttagaaagctcttcacaggttgaattgaaatctgggtccttgaaactttggttcctgtttttttgttttttgttttttgttttttttgggggggacggagtctctctctgtcgcccaggctggagtgcagtggtgcgatctcggctcactgcgagctccgcctcccgggttcacgccattctcctgcctcagcctcccgagtagctgggactacaggcgcctgccaccacgcccggctaattttttgtatttttaatagagacggggtttcatcatgttagccaggctggtcttgatctcctgacctcgtgatccacccgcttcagcctcccaaagtgctgcgattacaggcgtgagccaccgcgcccggtgattcctgtttttaactcactcttaaattacaaagaacaggtctactctctcttttatgaaataatatctcaaatatttgaaagtagctattatgtctcaccttagctttccatttccaagttaaccagccctcttccctttcactgctctcgaggagcttattttaagtctttttactgaggtcactctgccccagaagacatcctttccagtaagtgaactagtcctcagggagctcccaggccagggttagataatagtcacaaaactaaggagttggttttgagggacagctttcaggaaggacagccagcattatttccacatacaagtaattaaaatgttcccaagcacctataaatctaacataccatgggagtaaagaatgctttatgacttagccacttttaatattttttaatgccaaaaagttttaattgattttctacagtaactatatacctatttgggaaaattgccatatgcgagctttctttctgcattaagctccagttaccttgtttccttgaggctttcgtatgaagcaaatgccattcttacagatctcatttacttgtgaatgattatcactatttgttcaataaaatcttccccacgttgaagctgctcctgatgaagtcagggtcttcaagaattcttgttctctgtgtcattatcatacaagtatcacaccattctttatggttctcaagaaccaaagcatccgcggcaaattacccggagagctcatatagtaaattttaagcacaagtttatagaaatccttgaactatatatactgcaactgtttacaggcaatgctctataactcctatagctttaggtactttgcagaagcgagaaaatttattatcagataaagtcttggccgggtatggggggtcacgcctataatcccagcactttgggaggttgaggcaggcagatctcctgaggtcaggagtttgagaccagcctggccaacatggtgaaaccctgtctctcctaaaaatacaaaattagccgggtgtggtggcgcacacctgtaatcctagctactctgaaggctgaggcagaagaatcacttgaacctgggagacggaggttgcaatgagctgagatcatgccattgcattccagcctgggtgacaagagcaaaactctgtctcaaaataaataaataaataaataaataaaatgtcctcatgaaacacctgtggcttagcattccagcctgggtgacaagagcaaaactctgtctcaaaataaataaataaataaataaataaataataaataaataaaatgtcctcatgaaacacctgtggcttagcaggaagttggaagctaaagaagtgaccagcgcctggagtttggctcctggctgaatccacatgggctctttggttctttctttctttccctggaataaggattcaaggagaatttctccaataggatatatgccatgggagtatgattgaggaggggcaaaaacgtgatataataagaacagcaaaataacagtatgcaattttaaaatattttattatagaaagcttaaagcatacacaacagtaaactgtataataaacctctatgtacctatcaaccaactttaacaattatcaatattttgctaatcttatttttacctatcttgccttactttttggctggaatattttaaatcaagtctcagacatcataacaattatctgtaagttattaaaaaaaatttttttttttgtagagacggggtctcacttgttttcccaggctggtttcaaactcccagcttcaagcaatcctcccacctcggcctcctaaagtgctaagattaggtgttagccaccactcaaggtttataatttcttcagaatgtgtttctgacaacttttttttgcctaaccaccatgccattatcacaactaacaatttcaacaataattatgtttattaaaattaaggctcacgcctgtaatctcagcaatttgggaggccgaggcaggcggatcaactgaggtcaggcgttcgagaccagcctagccagcatggtgaaaccccgtctctactaaatatacaaaaattagctgggtgtggtggcgcatgcctataatcccagctactcaggaggctgaggcaggagaatcccttgaacctgggaggcggatgttgcagtgagtcaccgtactctagcctgggtgacagagggatacgctgtctcaaaaaaaaaaaaaattaatgaaagtaattaaagtttagttatttaataaatgacagcatgtacattctgaaaaacagaatatgtgcagtattctgcagacagaataatttgaataaaatttgaatttaaaagataccatttcaaactgtaagccccctaaaaatcagtggaccttggcttcacttgtttaaatcctcatggcttctagaagttttgggtggggggacatctttaaaaattatttttctaacagaagtcttactatttttcaacttattttctatgagtcctaggaggtagaaagagatttttcttgtctgatagacttgaaagtattgggttaggtaagtggaagaaagatcatatttagaaggtaaccgttgaatgtttaatcactattgttttgacatctagaagtattgtcataggttacaatttaaacatcagaagatgggggtgtatgagaatatcacatttagggagatgtcagttgtccagaagttttgcagagaatctggaaaataaacatgagagtaagttttctttctttctttctttttttttttttgagagagctttgttgcccaggctggagtacagtggctggctgactacaacctccgcctcctgggttcaagcaattctcgtgcctcagcctcctgagtagctgggattataggcgcctgccaccatgcctggctaatttttgtatgtttagtagagacagggtttcaccatgttggccaggctggtctcgaacacctgacctcaagagatctgctcacctcagcctcctaaagtgctgggattacaggcatgagccacggcgcctggccgagagtaagttattaatagttctactgatgtcagaaataagatgtagtctgaattccatgaattgtttccagttaatggaaagttgaattgtggtggaattggtagggaaaaaaagcagttatggtcctctgtctccattctagttcatccttatttaaagaatattactccaggcagtgagcacatgcgcgcggtggctcatgcctgtaatcccagcactgtgggaggccgaggtgggcggatcacctgaggtcaggagttccagaccagcctggccaaaatggcaaaaccccgtctctactaaaaatataaaaattaggccaggcgtggtggctcacgcctgtaatcccagcactttgggaggctgaggcaggtggatcacctgaggctgggagttcgagaccagcctgaccaacatggagaaactacgtctctactaaaaatacaaaattagccaggcgtggtggtgcatgtctgtaatcccagctacttgggaggatgaggcaggagaatcgcttgaacccaggaggcggaggttgcagtgagttgagatcgcgccactgcactctagcctgggtgacagagcaagactccatctctaaaaacaaaaaaagaacatttcttcaacaaaataaatatattcacgtatgcataaattttttaaaactttttttctttttataaaaaaatcagttttctcaggttgaaatgttaaaatcacctctgatgaagatagagaactaaaatataaaatatgggtttgtctctgattcctttttggtttataataatttgcatatggctttccatggatcactttagcagtttgtgctaaagtcattagttcttcctaagatacaaaagaaattctcaaaatgcttgtttcctattaggcagggaagttgtttttctcatctctcaagttgcatgaccaaaagtagcaaaaatactttatctctagggaagtgaaagcttgcttctcaaattgctttagtgaggctttaggaaatggcccctggctggtatcataggatataataccgtcttgcaaatagtaattttgaattcagttctttgtatctatgagataaaagagtcttcttccattgactgtcttagatgggcttatcacattcaacagtatttactgagcatttgttttaagaaactactaccctagttgctaactcattgctccctagacattgtatttggattgaggagcagaacatagacatcaacaaaacagatctggaacccgatatcatgtacctctaaatgtgaagtatgcggtagagctaatgttttgtcagagtttaaagaaggaagcaataatatgggcaaagttgttgagcaaggcttcagggaggaagtagaacctgaacaggcttttaaaaacactggcaccatttggattggtgaggaggcggtagaagggtgtcctctctgggtgggacagcacaaacaaaggtgtgggaacaaaactcaacaaggcacatttgggcaacacttggttgagcaattccatgggagtgcaagactcatgggcgaaatcattggaagccacatggtggaaggctttaaatgtcaatgtgttcttcatgccatggaaattcagaaggcttggcagtttgcaggaaagaccagaattgaagaatacaggagctgaggggatcaggggactgctataacaacagggagttgacagagcacgaactcacatgggagctctgaaagtgaaaaggcagggatgggtgtggagggcagctagaagaatgctttgcaagacttgaagaatgactgaaaactagggaagatgggggaatccaaaacatttcatggctttggaatttggtgaccaggcagatggtcatagagggtcaaagctgtccacgagctccagcaacaggaggaagcacagcattctgtgctcagactagtgtggcaggcctgcagaatgcgtgtgggcccttgttcctgtgcttggctgagggcttcctgagagcagttgctccatctctgacccaccggaccactactgcctttggatcctgggtggtgggcttcactcacacagtcgaatgggtttctcatgcctttgtccctgggctacagtcctccacttcacaccacaccggtcaagatggaatgtggccacattatctcactacagcaaacatgcccatagtttgcaaatttggtacatcaaccgccacgctcataaagatgatggtttggaccaggatagcaggagtctggtcaagagattaatgcagggtcagagatcaggagtcttatcatcttgatctctgcaagctaatgatttatccttcttcaattgcttaacattaatcacatttatataacatgaggcctaggaacaatacttgaccccacaagagattgtgattccaaacaactagtcagatgttcctccttttgtggttttatttcatttgcattcttttttattttgatatttttcagtttggcctttgtaattgcaaacagcttaaggcaattcaccacccaacccacttcacttatttatgtttcctgcctggctcagcaagcacttgaatttaaactctggtctacacaaggtcaagatattcaggtcaaatgtctattaaatcaaatgttttctatattctacacaactagtagagttcagaggatcagagatttggggacctgaagggggtcttttattaattccccccttgcattatggttgagacaatcgaggtccagagggtaacgtaacttgtgttagggaccaattaagggctggagtccatgtcttgagttacattttaagatgtcaattgagaacggatacgggtttcttaaaactcaaatttatcctcaatcttgaaatttattcagttattcatttaataaatatttgtggataacttattatacaataggcacagtgctaggagccatgggcataggtgtgaacagacagacagatcttgccctcatggaacttgttttcttttctttctttttttcttttttttttttttttgagagagtctggctctgttgcccaggctggagtgcagtggtgatcttggctcactgcaacctccacctccccggttcaagtgattctcctgcctcagcctcccaaggaactgggattacaggcacccaccaccacgcctggctaatttttgtatttttagtagagacagggtttcaccatattggccaggctggtctcaaacttccaacctgaaatgatccacccaccttggcctcccaaagtgtgagccactcttacaggtgtgagccactgcacccggtcagaacttgttttctgatgctggtagttgaggtgggtgctatggaggcaataagtacggacacatgagtaaggagtgaggcgataagtggtcattttagattctttaagggagtccatcttacctaattttttcaataatatcaccagaatcaatgatggcacatctgcatttttcagttaaaacacataacacatttaggttacaatggaacacagcttttcaatgtactaaaatggctgtttttttgtttttgtttttgtttttgtgacagagtcttgctctgtcgcccaggctggagtgcagtggcatggtctcagctcactgcagcctcggtctcccaggttcaagcaattcttgtgccttagcctcctgagtagctgagattacaggtgcgtgccaccatgcccagctaattttcttttctgttctggttttttattttgttttgcatttttagtagagatggggtttcatcatgttggccaggctggtcttgaacacctgacttcaagtgatccacccgccttggcctcccaaagtgctgagattacaggcatgagccaccgtgcctggccctaaaatggctgttttgagttgacacagagccatgtccaaacacccgtttccacttcgcctatttaaatttccctcctggctctgcaggcattggagtttcgacctgagattctatgccaggccaagatatctagattgtttgcattctatatcaaaacatataattggccagccgcggtatctcacgcctgtaatcccagaactttgggaggctgaggcgagcagatcacctgaggttgggagttcgagaccagcctgaccaacatggagaaatcctgtctctactaaaaatataaaaatagccgggcgtagtggcgcatgcctgtaatcccagctactagggaggcagaggcaggagaatcgcttgaatgagggaggcagaggttgcggtgagctgaaattgcgtcattgcactccagcctgggcaacaagatcgaaactctgtctcaaaaaaaaaaaaaaagaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtaggggcgggcgcctgtagtcccagctacttgggaggctgaggcaggagaatggcgttaacccgggaggcggagcttgcagtgagccgagatcccgccactgcagtccagcctgggcgacagagcgagactccgtctcaaaaaaaaaaaaaaaaaaaaaaaaaaaaagaaaagaaaagaaaagaaaaacacatataattaaattattaagtaaaaattatttgtggcatggtgttttgtagattttgcctgatccagagaaaaggtaatcaatgcatgtttattgaccacatcattgatttgtaggagtcaaattatgttaaagtagccaaagttaatctatcacagaatcatagtattttgtggctagaagatatttaacagatgacttagttcagctcccttatttaatagatgggaaaacagactctgagggaggccaagtggcttacagaaggctacacagatagaagttatatatgttatttacagtacatctactgtggttaagagaggcctccttgcatttattttagagcggagttggtagaaatagttagatatagcagtttagagcatgagctctggtgtcagacagacctagagaaaatttaagtaaaacttaaaatttacttgactatgtatgtgcccctgggatattagttaatatcttttagctgtagtctccttattggaaaaattggcaaagttagagttcagtttagggttagggttagggcctctaagttttaataattggtaaaggttattattatccattttgtaccatcaacatgtcaacaggagtataatgacttagatggagtcatatactcctctcgggagagatataattttttgatagaagcctggccaacatggcaaaacgccatctctactaaaaatacaaaaattagtcaggcatggtggcccacgcctgtagtttcggctactctggaggctgaggcaggagaatcacttgaacccgggaggcagaggttgcagtgagccaagatcatgccacagcactccagcctgatcaacagagtgagactccggctcaaaaaaaaaaaaaaaaattttattaaaaaaagtttgctcaggccaggcgcagtggctcatgcctgtaatcccagcactttgggaggccgaggcaggcagatcatctgaggtcaagagttcgaaaccagcctggccaacatggtgaaaccctgtctttactaaaaacacaaatattagctgggcgtggtagtgggctcctgtaatcccagctacttgggaggctgagatgggagaactgcttgaacctgggaggtggaggttgcagtgagccaagactgtgccactgatctccagcctgggtgtccgagtgagactccgcctcaaaaaatgaaaaagaaaaagtttgctttatcaattgaataatctatatgcaaataattatggcaaaagtaaaaagacttctttcctggggttgtactcactgagccctcaccctggaatgttctttgcctagccttccacacagttctcatctccttcaggtatctgctcagctggcaccttctcagtgaaggcttgcttgtcattttgtttaaatggaaactttgttcccatttcctgctttatttttctccatgacacttacctcctaataagtaattttctaatttgctttgtttatgatctcttgtaaatttcatgagtcctaaacgggtgcttggcacatataatttttttttttttttcttgagagggagtctcagtctctcgcctaggctggagtgcagaggcacagtctgtgctcactgcagcctctgactgttgggttcaagcaattctcgtacctcagcctcctgagtagctgggattacaggtgtgggccaccacacctggctaatttttgtgttttttgtagagacagggtttcaccatgtcggccaggttggtctcaatctcctggcctcaagtgatccacccagcttggcctcccaaagtgctaggattacaggtgtgagctaccacgcccggctggcattcaataaatcttcgttacttatccctaaataataaaaaatgtgaatcataaatcccactgtacttgagctactagaattaaaggagataattattctgccaaaatgttgtgttttaacacatgtatcttcatttcttctagtgctttaatcctcctgaattcctggtgttggggcaataacatgccatggtggggttacctcagagtagggggtgcctctttaaatgcctggaggtgaatgaaagaagctattcccaacctagcagccaggctgtgacttctgacattgcatttcaatgccgtttttttctttgcataaagatgtagaaacctgtttaggctgtggtctactaccaaatgtactcattagaaaaaattgctttttttttttttttgagacggagtttcactcttgttgcccaggctggagtgcaatggcgcaatctcagctcactggaacctctgcctcccaggttcaagcaattctcctgcctcagcctcccaagtagctgggattacaggcgcccaccaccacgcctggctaatttttgtatttttagtagagatggggtttcctcatgttggccaggttagtctcaaactcctgacctcaggtgatccacccacctcatcctcgcaaagtgctgggattacaggcgtgagccaccacacctggctttagaaaaaatttctaatgactggctgttttcatctttcagattattgtctatgactataacatagtatggggctgggaaaaaataatcttcaaaactcttttcaaatatttaacttctattcaatacaatatttggatttgttcaaaaactatgaccaggttttcttgcactcatcaaaagcatatttctttccagtagtttcaatcatagctacccattataattaggaacttaaaaaatgaaataacagtgctaagttcctatccaaagggagtagggagactgggttatcaatgtattttcaagctccccaggaatctctaatttgcttaaaccaacttctgccaaatgaaagtaatacaaattgagcagtgtttatccactgggtacaggcaagaacccaaatatagctattttagggtcattgtgctgtataaggatgatataagagccgggcgcagtggctcacgcctgtaatcccagcactttgggaggctgaggtgggcggatcacctgaggttgggagttcgagaccagcctgactaacatggagaaacctcatctctactgaaaatacaaaattagccgggcgtggtggtgcgtgcctgtaatcccagcttctcggggggctgaggaaggagaatcgcttgaacccgggaggtggaggttgcggtgagccgagatcgtgccattgcactcaagcctgggcaacaagagcaaaactccgtctcaaaaaaaaaaaagggataatataagaaatgattcttaggcctaggttaaacaatgaacaaacatccactcctaggctgtatggggaaaagagaaatgttgtaaatatctctcattgcaaatgacactatattccttagtgtttttctccttggacttacctccaaaaaggtacctgacatgagaggaaaaaatagaaatcgggatttggattttatgcgaggttctgggaaaaatgttcctactctttcctatacaggaactaagtcaaattcaaggccaatgggattataatttgctttatgctataatttgtaatgtttaactttgttttagcaaaaaagtctgatattcaatcttccattaacactttagccatagaatctagactgctacgtgtaattgttaacaaacgcatggtttcttttctttgttatgaatggaactagacatctccattaacacatttgctgtttttctcatgcagtaggctaactgtacagtatttaatggtctacaggtttaaatatttcttatatgccttggcttgcacagaaagtgcttctgctaaaccagttaataatctggccatcccaagagtccagaatgttgagttaattttttacggaggttcccagatgtattggaagactcactcttggcagaccttgccaatattttttttaagattacatttggcttttcttgtatttgatatgaaacacatgttaaaaacaatacctgacaaatatgaaatgcatttttctgcataagcaaaaacaccatgaatacagcttttacaaagttttggatggcagagatacagggttttcactgcaaaactgggttagcatttaggcaagttaatcatacatctcgacaatgattctttatccaacatctctttggtattcagtgggcaggtcattaggactatgaagaaataagtgggagaatgtccagggaatgaaaaacatctatataacatgtggagaagtggatagatttagtgagtattcaactttaagaggtgcaggttctgatcccagccagatcacttgagttcttaacttctgggaagttaagaataataatgtgagtctttgagtgtttcaagaagatcctgtattagttgcttccctttgcaggtattttccacagcatttccatgtgttttctctaggtgctctggcagggcatcatatgcagctttatttttgccttttctttcagtctatattttctattctatttatttttacagggcaatgggaaatactgcaatatactgcaagtgtcctttctctttacgtgaattgaatttgtattttattgtttctttttccaggtctagccttagaaattttataatatggccaggcgcagtgtctcacgcctgtaatcccagcactttggcaggtcgaggcaggtggatcaccaggtcaggagatcgagactatcctggctaacatggtgaaaccccatctctataaaaacacaaaaaattagccaggcgtggtagcacatgcctgtaatcgcagccacttggggactgaggcaggagaatcgcttgaacctgggaggtggaggttgcagtgagctgagatggtgacactgcattccagcctggagactccatctcaaaaaaaaaaaaaaagaaaaaagaaagaaatcttataatatttacaaaatgtaattgtaggccgatgcggtggctcatggctgataatcccagcactttgggaggccgaggcaggtggatcacttgaggtcaggagtgtgagaccagcctggccaacatggtgaaacgctgtctctactaaagatacagaaaatgagcctggtgtggtggtgcatgcctgtgatcccagctactcaggaggctgaggcaggagaatcactggaaccagggaggcaaaggctgcagtgagctgagatcggaccactgcactccagcctgggtgacagagcgagactccatctcggaaaaaaaaaaaaaaaagaaaagaaatataattgtggatccagactctggccaaggatcaaacagacatttaagatatttgagggcaggagggtaccactgaggaagaatgatgctaccattaactgtctctaaaaagaggaagtaaatgccactgcaatctgctattgaggtttccctagatctggaatatcaagcatttcaattcacactaaagttcagaataataattactaataatatttttaatggagtatttacaatgggccaggcagatttattgtgtcattatctcagctgatcctcagaaggactgagtgctctcagtagtcccatttctgtggggaaggggagtcatggacaagttagcctttaaaatcttatccagtcttttattcctgctttccaggagtaaaagaaaaaaataaataagtaaaaagaaagtgggccaggcatggtgacctgtaatcccagtactttgggaggctgaggtgggaggatggcttgagcccaggagtttgagaccaggctgggcaacatggcaaaactccatctctaccaaaaaaacaaaaacaaaaaaaacaaaaaaaaacaaaaaaacacccaaattagctgtgcacagtggcacatgcctgtagtcccaattactcgggaggctgaagtgggaggatcaatcacctaagcccggggaggctgaggctgcagtgagccaaaatcctgccacttgccactgcactctagcctgggtgacagagcgagaccctgtctcaaaaagaaagaaaggaaagaaggaaggaaggaagaagaaaaaagagaacaatcttatcaaggaaggtgatatcaacaaaatggtgcaataggaagctccaaactcctataccccaaccaaaacatcagaaagtaagcataaactgttaaaccaaatctgttaaaatctggaaaacagtcaaaagtttatagcaaccaagcaaatgctgaatcctgccccccctcatccaaaaaggtgtttttttttcttttacttttaaagatttttattttgtttttgtttttttaaatagagacggggccgagtgcagtggcgcatgctataatcctaacactttgggaggccaaggctgtggattgcctggagtttgagaccagtctgggcaacatggtgaaaccttgtctctacaaaaaaagtacaaatagttagctaggtgtggtggtacgcacctgtagtcccagctacctgggaagctgaggtgggaggatcgcctaagcctcggaagttgaggctgcagtgagccatgattgtgccactgcactcaagcctgggtgacagagtgagaccctgtctcaaaaaaaaaaataaaaataaaaataaataaataaaaaataagagatgaggtcttgttatgttgtccagcctagactccagctcctgggctcaagtgatcctcccacttcagcctcctgagtagctgggactgcaggctcatgccaccatgcttggctaatttgtttttattttttgtagagatggggtcttgctattttgcccaggctggccttgaactcctggcctcaagccatcctcacactttggcctcccagaatgctgggattacaggtgggagccacctcactcagcccctaagaagacattttaaaataagtaggaaagcgttgtggtgttttcacttgctctttccccacctcctgcccagcttagtggtagtcttaggagttagcctccatggctggtccctggtccctggctctggcatgtatgtctttatttatttatttttttgagatggagtctcactcactctgtcacccaggctggagtacagtggcacaatctcaactcactgcaacctccgcctcccagattcaagtgattctcctgcctcagcctcctgagtagctgggattacaggcgtccactaccatgcctggctaatttttgtatttttagtagagatagggtttcaccatcttggccaggctagtcttgaactcctgacctcaggtgatccacccgcttggcctcccaaagtgctgggattacaggcgtgggccaccgtgcctggctgtggcatgtatgtcttttctaaactatctggagctatctgaaggactaatgcaaggtgcctgacactcactcaggacagaaaagtggagggcattgctggaaaagcttttaaggcagatatacaaactgaagctggctgagacaaaagattacacctaaagccaagaaggaaaagcatgttgtcctaaagtgctttacatttacttgctcactttatgctcacaacatccctatgaggaaggtataattgtcaccatccccattttacagttgaggaaactgaaataactgggaaaagtaaatgcagttagcttttaatcacttcatcacattgactccaaatacgcacgtactaaaagcaaaatgaaccaggtaacaactaaaacacatatagtaaatgagtaataaatcttatttgaaaattatactttaaatatatttcttttaactctagtatttattactgccttagtaacctctttgaaatagaagactgaatggaattcattcttttttttttttttttttttttttttggagacggagagtcttggtctgtcacccaggctagaatgcagtggcacgatctcagctcactgcaacctccacctcccgggctcaagcaattctccctgcctcagcctcccgagtagctgggattacaggtgcctgccagcatgcccagctaatttttgtatttttgtagagatgggttttcaccatgttggccaggctggtctcgaactcctgacctcaggtgatccacccgcctcggcctcccaaagtgctgggattactggcataagccactgcacctgaccggaattcattcttgatagcatcagtatttgctttcttcccagatagtacatagtactgtttttattatgaatttttttgtgggaaaatagagatgataaaataggaaacctttccacaaagctatggttaatattagttagaagtaaattttcatttctagaacataacattgaaaaaaggtaagaggggcatagagaaggcaaaagaatatacttcttgaataaacaagtatttctaatgcttattatttataacttagatatccccagactgtaaactgtagaagaagggactgtgtcctgagttattcagaagccaattttttgtgccttagcataacagtataggaatattggccatagtagtcgatcagtggagacttgttgagtgaatgaatgatagacatgctttttacttgtatatcaagttattactgggctctgcgcaaaggcagaagtggatcctatgtaaacagatacgggtgtttgcttatgataccttatttttaatgtaccccaagatcccccatggagaatttcaaatgctgtttataaaaggaaagaaaattcaggtcttgtagttgttcttttttttttttttttttttgagacggagtctcgctctttcacccaggtgggactgcagtggcgcgatctccgttcactgcaagctccgccttccgggttcacgccattctcctgcctcagcctcctgagtagctgggactactggcgcccgccactgcgcccagctaatgttttgtatttttagtagagacggggtttcaccgtggtctcgatctcctgacctcgtgatccgcccgccttggcctcccaaagtgctgggattacaggcgtgagccaccgcgcccagcgcgggtcttgtagttgttcttgctacaaattactgggcctgcagaagagagatactagggaggagatttacagcaaggctttgtcgcacatatattgttcttgttcgtcatcttgacttggtctgtaaacgtccctttcccttcccgttaaacttaacaagaataagcctgtatcctggattaggtggcaaaggtatttgaaataaaaataaagaattttaagaaattaaaaaagaataagcctgtagcacccagatgcataaaggaaaatggatctaaacagtttattacttaaacagctgctaaagtcatctcatccttgttccatttactccataaccacacaaacgtgacaattccatttagattggtcacatgtgcttaatgtcttaaaggaaatgaatgaatatattttctgaacactcatggaagtgatccatttttatacaaaatcaatttttgaggggaaaggtaattcctgattatcaaagaagtggccagggaagaaaagatctgcccccatgcttcattaaccaccaccagcagtttcaggtgggttctttcagaaaatgcgcatgcatatacatgaatatatctgcggtgagttcctctttgtttgtgtgtgtgcccaggtgctcacatgtacatctctggtctttattttctgtagagaatagtcagaatgaggccccagggtcaggaatggaaaaatcaggtaaaaagaaaagaaaacatctttttttttccttaaaaagaaaacatcttgtttagaatttttggaatttctttctaagcttaatctttcttttattaacactttgttctcaacttaaagccattaaaaagcctatatgcaaaaaataaaataaatcagctcaaggcataagaatttgatatacagctgggtggtaattaacaggacttgaccttacaataattagatgctgagaaagactggagcacagcagctcagaacacagcagtttatgtaactctcctggagaagagttaggctttaccccttgatgctatgaaaaatcagcctcaaagattattgaggcagatcaaaatttagagccgcacacggcacctcacacctgtaattccagcattttgggaggctgaggcagtaggattacgtgagcccaagagtttgagaccagtctgggcaacatagtcagaccccattgtgttagtcagctttcatactgctataaagaacagcctgagactgggtaatttataaaggaaagagttttaattgactcacagttcatcatggctggagaggcctcaggaaattcacaatcatgtcaggaggcaaaggggaagcaagatgccttcctcacaaggcggccggaagaagtgccgagaaaggggaaagagcctcttacataaccatcagctgtggtgagaattcactcactatcatcaaaagagcagagggaaaaccgcccccccatgattcagttacctccacctggtctctccttgccatgtggggattatggggattacaattcaggaggagattaggctttctgttcaggtgggaacaaaaagcctaatcgtatcatccatctctacaaataaaataaattaggctgagagcagtggctcatgcctgtaatcccagcactttcggaggccgaggcaggcaaatcacttgaagtcaggagttccagaccagcctggccaacatggtgaaaccctgtctctactaaaaatacaaaaatcagctgggcgtggtggcacgtgcctgtaattccagctactcgggaggctaaggcaggagaatcacttgaacctgggaggcagaggctgtagtgagccaagatcacaccactgcactccagcctggggaacagagaaagacgctgactcaaaaaaatgaaatgaaatgaaataaattagccaggagtagtggtacacgcctgtggtcccagctactcaagaggttaaggtggaaggattgcttgagctggggaggttaaggctgcagtaaactgtgattgcattactgcatgccagtctccgtgacagagtgagaatctgtattaaaaaaaataaaccaaaatcccaaaagataacttgggactgtgtagtggcttattactacattcctcaatgatccaagctactcattgaaaacctaaagtggaaaatgctttgtccacatatattaaataatacatatatttctttctccaccctgtaaaaagagagttagcaataatgctatttggttagaatatgcagtgtgaaaataaaatgatattcataataattacacagaactaattttttaaatggcaatattcaatgctggcaagggttcggtaatgctggtattctcataggttgctcactgtattttcatttttaaaacattttctgaaagctatcacaaaatattttaggagctttaaatgctcaatatttttatcccagttgtctcactttaggtaatttatctcaaataaataattcataaatctatatgcacaaagccatcttgacactatttataattgcaaaacactggtacttaatgcagaaatggttgagtaaagtatggcatatccactatttacatggtatctataaagtgtttttaatagtatggaaggccaggtgtggtggctcacacctgtaatcccagcactttgggaggccaaggcaggtagatcacctgaggtcaggagttgaagaccagcctggccaacatggtgaaaccctgtctctactaaaaatacaaaaattagccaggcgtggtggcagaagcctgtaatccagctacccaggaggttgaggcaggagaattgcttgaacctgggaggtggaggttgcagtaagccaagattttgccactgcactccagcctgggtgacagagtgagacttcatctcaaaaaaaaaaaaaaaatactatggagaaacattacctatattaagttaaataaaagaaatcacgatagagctgggcacggtggctcacgcctataatcccaacactttgggaggctgaggcaggtggagcacgaggtcgagagttcggaccagcctggccaagatggtgaaaccccatctctagtaaattacaaaaattagccaggcatggtggcaagtgcctgtaatcccagctattcgggaggttgaggcaggagaatcacttgaacctgggaggcagaggttgcagtgagccaggatctcaccactgtactctagcctgggcgatagagcaagactctgtctcaaaaaaagaaagaagaaaaagaaagaaagagaaagaaagaaagaaagaaagaaagaaagaaagaaagaaagaaagaaagaaagaaagaaagaaagaaagagaaagaaaaagaaaagaaagaagagggagggagggagggaaggaaggaaagaagtaaataaatcacaataaaaattatatttcaggctgggtgcggtggctgacacctgtaatcccagcactttgggaggccgaggtgggcagatcaattgagtccaggagttcgagaccagcctggccaacatggcgaaaactcgtctctgctaaaaatacaaaaattagctgggtgtggttgtgggggccggtaatcccagctacctgggagaatgaggcagggaaaattacttgaacccgggaggcagaggttgcagtgagccgagatggcaccactgcactccagcctgggcgacagagtgagactccacctcaaaaaaaaaaaaaaatgtatttcagctgtgtatagaacagataagtcaatgtaggaaacaatgtttattgtgttcatgtagtgggagtacggatgctcttgttttctatttcttcaatttttaataatattttaatattatattcataatttaaaatttatctagcatctatatctctaagtttatctatctacatactttatgttttcattttttaaccctctatctctatactttagtataaaaagaatagctttgtgaaagtttaggaaatggagtagagagatgagtttcatgattacaaaacgttgtattattattaaaaaagaaagatgtgcatttgagcccgctttctcatacttctttcagtgtaaaactattgatgaacttgaatgcatttgtatcccacttatagtcttcaattctaatttggtgttctggtagagtttctctggacttttgcaaaaataaagctctctcatactagttcaagagatggttcatgttgcgtcactgggtaaagaggaacaggtagtgtcaaagttcccttctgaggattctcctttaggtcccatgagcatcaatcattatttctattgactagtttccccaataactttctcccaaagtaaatgaaaatccacatgccagggcagcactatgttgaacttgtcaaagaccaatactgaatatgccagacacggttatcttcagctaccattttgaaggcctgaaccctcatagaggtattaacgaactcgaaattgcatacttgcatatgttgtaatcattttcaccctgctttccaaaaagaaaaagaagaaaaaagcaataaatatgggatttaaatataattcatgcagaaataggccaaaacattcctaaagactctaaatttattcctaatcacactgatgccaaactaaattggcatggttattctactagattctgattctttttttttttggccagaaatttgctggaaaaacacagaactggaaaatccatccaagattaaacagaggaaaaatattagaaaaaaatattaaatagaggaacaaaaacctattttagttgtagttataaatttctagaaattcatctttgaatttagagaaatacatcagtgtcatagtaaaataacctttattctttatagacacccttttctgaaaccaagcagttgtattcaaaacaagtccaaatttaagcaagaaaaaattgttttaataatagaacattttaaaaaaccaatgtatttctggccaagagtggtggctcacgcctgtgattccatcactctaggaggccgaggcaggcagatcacctgagtgatcagaagttcaagattagcctggccaacatggtgaaaccccatctctactaaaaatacaaaaaattagcctggtgtggtggcatgtgcctgtaatcccaactactcaggaggctgaggcaggagaatcgcttgaaccccagagacagaggctgcagtgagccaagatcgtgccactgcactccagcctgggcaagagagcaaggctctatttcaaaaaagagaaaataaaatacaaataaaaaaccaatacatttctagcttgtaactagaaggagagacaaaaagaccaacttaaaaatagtaagtgtaatgagagtatgatgtgaaggagctgttaagtgatctcaaattaatggtgctcagaaatgtgaacttctggaattcacgtttaaagactaattggagggccgggtgtggtggctcatgcctgtaatcccagtatttgggaggccggggcgggtggatcacctgaggtcaagagtttgagaccagtctggccaacatggtgaaaccccatctccactaaaaatacaaaattagccaggtgtggtgatgcatgcctgtaatcccagctactcaggaggctgaggcaggagaatggcttgaacctgggaggtggaggttgcagtgagttgagattgcgccattgcactccattctgggcaacaagagtgaaactccatcttataaatagataaataaataagactaattggaaaacttggaaattatttagaagacagctccaaggatggcaaaatgagtcaagtattggaaaaaaagaccaatgaggagaggcaaacaagacataattaattttcttgaagagaagaccaaatgacaattgaagaagacagtctatgaatttatagagagctttatatacagacagggttggttatcatcgctgagtataaaacaagggaaacaggcttggtgtgtagcataatggctttgttcgacacagtaaagctaactaaatgtcaaaataagatgcaggtggaggttgagcagtcttttctaaagccatgaataataagatagcagcttctttgtatggctctgactgaaggtgagagatgtgctatgtaagctttcacatcgcttccagggctaagattcaggtccttggggaatatcttcctgaattcagggagttaatgccaactctgaaatcaaattactggaacatagtaaagaaagcggggggaggaagcaactagaatcaagatgaaaatgtaacttcaaaccctgtttagaaaaaaataatgagattactttaaaataataaaatttattattaaaaatttagagaagttttgacaaggaggaagtggaaaaaatagatatttttatttatttatttatttatttatttatttatttatttatttatttttgagacagtttccctcctgttgcccaggctgcagggcaatggcacgagctcggctcactgcaacctccacctccagggttcaagtgattctcctgcctcagcctctcgagtagctgggactacaggcatgcaccaccatgcctggctaattttttttgtatttttggtagagaaggggtttcaccattttggccaggctggtctcaaactcctgacctcaggtgatcctctctcctcggtctcccaaagtgctgggattataggtgtgagccgccgcacctggccatagatattttagataaggaacaagatcaagcattaaactgtgaacaaggtatttctaattaactaattttttttttcaaacacagccttaggaaacgtgactccaaccatggagagtttaggtcagccctgattttgaggccacatgctccatcctcacaggtgggtgaggtcccttagttggtattgtttgatgattctattagttcttgacttttctgtatatattttaatgtacagtaaagggattgtagtattggcaggtttgtcccaaaatagactgtgagtcagttatgaaggagggggattccaggaactagaatttaagagtgaggaagttaaacacaaatttacatatgactcagtactaacacattttacataatattgggtactttctcttcctgtaattgcctctatgcttcatttgttgttttcaccaatagccctaaataagtggttttaaaaaacattaagggaggctggtagatcacgcctgtaagcacttttgggaagctgaggtgggcgaattgcttgagcccaggagttcaagaccagcctgggcaagatggcgaaactccgtctctacaaaaaatacaaaaattagctgggcatggtgacacgtgcctgtagccccagctacttgggaggctgagatgggaggatcacctgagtctttgaggttgaggctgcaaagaacaacaatctccccactgcactccagcctggatgacagaccgagactctatctcaaaaataaataagtaaataatgaattttaaacacacacacacacagacccacacacaaccattaagggatgactaatttggggtgtcttgccagcaattcaaatgtctaaaatagccttattctagcattgaatgttaaagcctttttctttagacagactaattgcagaatgaaatggtttgctacctgttgagctccaattctccccttctcaaaaaatcaagaggctatgaactcgcaagtgttaatgggattcagatagaagccatcactgctattttaaattttcctgtgtctcccactaacattatatccaaacatcaaaacatccacaacaatcatccccaaggttgctgctgtattatttataaatgaacacattgttgggtgaatacattccacttttgaaattaattttctttttctttttcttttttttttttttgagatggggtctcactccgtcacccagtttggaatgcagtggcgcgatctcagctcactgcaacctctgcctctggggctcaagcgatcctcctaccttagcctcccaaacagctaggactgctggcacatgccaccatgcccggctaatttttttgcatttttggtagagacaggatttcaccatgttgcccaggctggtctcaaactcctgagcccaggtgatctacccactctggcctcccaacgtgctaagattacagtcatgagccactgtgcctggcctgaaattaattttcactggtttattttcataaaataacgctggacacagtggctcatgcctgtaatcccagcactttgggaggccaaggcaggcagatcacttgaggtcaggagtttgagaccagcctggccaacatggtgaaaccccatctttatgaaaaatacaaaaaattagccaggcgtggtggcatgcgcctgtgatcccagctactcaggaggcagagggaggagaatcgcttgaacccgggaaggcagaggttgcagtgagccaagatcgtgccactgcactccagcctgagtgacagtgaggctctgtctgaaaaactaataaataaataatattttcataaaataaactcaatttcagttacatacagttttttaggaaagtgcttttcttttgtagctttgttttttccgtcctattgcatagtctggcttcactgaaatagctttccaccaaaatattctcttctctcaagcaatagtatactgaagagaacaagtaagttatttatttgcaagcccataggatttaaattagaataaacttgtccttgagaataatatactctaaataattcatatgagtcacaaaattttataccagaaaaagtgtgtaaaaaacatcttattccccaatattatgattccctcagtttgtatgacttaataattctttttttagagtataattgttccagagttcagaaatttttaaaagagattatctgtatctctgggaaaagattgacttccagctggaaagataatcttttcttccattttcccaccttttgcatcagaaaagtaaacaaccgatttcctgactaaatacacctggattatttctcaagagagcaagaaatgggttgatttatgcattagaaaagtgaccataaggtcgtggagaatcaatgactttagatgtaggaaggatcttggaaatctagttcaactccctcataaatgacaaggattagatataaaaagtgcttttaagaggcctattagcatcaggaatgaggtaagtcccttttcagcattaattacagtaactgctgtataaagaaaggggattctggcaactgctctccacatggcagaaattcaggacagacttgaaatcaaagaagtaggggctaaagtctaatgaactgacataaaactttttttaattggaactaaagaatattaattctctcacatgattcccaaagtcagtgtttttttttttaattctctcgaaactttcatgcatcaaaagatggttccaacatacaagcatggaaataattagtgcttttaattagtacaactgggaaataaggcataccagccttaataagggtctccaatgtggaacacattaaagtaaaaacaattttttcctaatatcaaagtgcattctaccgactaacagaaaatgagttactctgcaaaatggagagtataatcggattcagaacaagttcaaagtattaagaaaggagatgccatgaactgtgggacttgagaattagatcgtctcagacggccaccaatctatttttcagaacacactatccatatcgtagggtttaactattaaactgtaaatattctaaaatacttcataatgcctattttgtgaatcagaattgaagatgaaaatggtcaaatatattagaagcatgctaaacagcatttcagaacagtctaacagctgaacgcatacttggcaagaagagagctgctgtcacattacctcagaccaacagtagcaagcacatctggaatcctaatgatcccaggagcttttgggcatttgaaggacagccatctggtgcaaaggaagtctggacaaagtgtcccacccaacagaaagaacctcattgtgctgctatgaaaagcagctggccccacttccctctgataatacaccaccttctcaactggtgagtgatcaagagaaatccattatgtgcacaaagtgctcactagctgacctggatctaaaaccatgacaacctggcagataagacgcagtcagagatatatttgtgaaataaatccctttttgaaagggcgtcagcaaattctgctacctctgtctaacctttcagcaactgatgtagatagtatcagcctatgggctcttctaggtctcaattctttatctgtaaaattaagagattgggctacgcacattttacggccctttttagttctaacatcccatcagcttgtgattttacagaaaatactgtagcgccaaaagaatggatgaccaaagaacaagggatgacagcagacatttgaaggtggcccctgcatgttgcttgatggcattggatcattgaggggacaaggttgcactcaaagatgacctctcatttgtaaatgtgtcttatcatcttgcaagcaaattaagccagtgttatctttgctctaacctatctgcaaattatgcacagcatgttgggtctgccccacattaaacacactgcaggactctcaagtagatgaaggcagacatgcagcttcagcagaccatgatggtgaggcagtggataagagaaatgattgaaggtcatgagagggaggagagcatgacagggatgggaagcgaggacatcagggcacagaaagccctagtcaggagggaactgcaggccaggcgcagtggctcacgcctgtaatcccagcacgttggggggccatgatgtgcggatcacttgaggccaggagttcaagaccagcctggccaacatggtgaaaccctgtctttaccaaaaataccaaaattagacagggatggtgaccgacgcctatagtcccagctactggggaggctgaggcaggagaatcgcttgaacctgggaggcagagattgcagtgagctgagatcacgccactgcactccagcctgggcgacagagtgagactccatctcaaaaaaaaaaaaaaaaaaaaaagagggaactggagagtttaaacacctacaggaggaggaatttaggataattgtaagatccaataaataaccatgtcagtagatttatggaggaatggagctagagatgtatagtgaaagagtctaaaaatataatgtagggaaaggcattttggccagttaaatattgttcggaatcctggctctgccgctgaatatcctgtatattcctggacttgttaaataatgtattttcctcatcagcaaattggaaataatgctatctcttacatacagtagttgtggaaattaaatgagataatgcatgtcaagtgctgaagatacttattggtgcacagtagacattcaaaaatgatatattagttgtcattattcctagtactgttattcttgttagctgaataatgagaacaaatattgaaattccccagaatggttgtttgtgaacaagtagagagaaaaacgattacatcaggcaccaagattaaaggaagtgtcttcgaggttagtagatgatgacagtgagggcagaggaagggtgggtgtggttgagcaaagttggcgaagttcttgaaagtcaagttagtgcccgccgaactcttggctctgagccagacaagactggagaagaagccctttctgcttgagggcatcagagaaaatgtttcatctttagtagaaaatcaaatctcaattaaggcagcactttcctgaagatgtttcttttctttttttctttttttttttttttttttgagacagggtccagttctgtcactcagactggagtgcagtggcatgatctcggctcactgcagtctcagactccctggctcaagcaattcgaccacctaagcctcctgagtagctgggactacaggcatccactaccacatccggctattttttatattttctgtagagatagggtttcaccatgttgcccaggcttctcttgaactcctgagctcaagtgatctgctgccttggcctcccaaagtgctgggattgcaggtgtgggtcaatggacccaggctctgaagatgtttttttctttttagagatggagtctcgctttgttttccaggctggtctcaaactctaggcctcaggtgatcctgccacctcggcctcccaaaatgctggtgtgaaccaccctgcccagcccaaagatgcttttggtctgatctatctggggaatgctgagcctctccctcctcggaatttgtaagagtgcacacccaaatgcaggctctacgaagtctgtcttcctagattgaaatcacatgtagccaacaaacttgtttatttatttatttattttttgagatggagtctcgctctgtcacccaggctggagtgcagtgggacaatctcggctcgctgcaagctccgcctcccgggttcaggccattctcctgcctcagcctcccgagtagctgggactacaggcgcccgccaccacacccggctaattttttgtatttttagtagagacggcgtttcaccgcgttagccaggatggtctcgatctcctgacctcgtgatccgcccacctcggcctcccaaagtgctgggattacaggcatgagccaccgtgcccagccttgttttattatatgaagttacaatcctgtgtcacaagatgggagggcagagggaggattttgaggaaagcttaatgaccgaatggtgtttactgtcaggagtcccagaggaaagggagagaagggattaatgtggctaagtgagaaacaagataggccagagacaagtgaggttaaaactgcatgaagggattgagcaagtggaagcaatgaccaacgtgctggtgctcatgaaccgcagagggaagaaagggagcaactaggaattttgaaattaggaataaggctgggcgcggtggctcacgcctgtaatcccagcactttgggaggccaaggtgggcagatcacctgaggtcaggagttcgagaccagcctggccaacgtggcaaaaccctgtctctactaaaaaacaaaaaattagccaagtgtggtggcacgtgcctgtaatcccagctactcgggaggttcaggaaggagaatcgcttgaacctgggaggcggaggttgcagcgagctgagatcgcgccattgcactccagcttgggcaacagagtgagactccgtctcaaaaaaaaaaaagaattaggaataagagtgagggaaatgggcaacttgggccagtagcagagctgttttgaacatgggaaatttacccacagttgctttatagtccttcagacatttagaattttaaatttttttaatttaaatttaattttttttttttttagaaatggggtcttgctatgttgcccaggctggtctcgaactcctggcctcaaacaatcctccctccttggcttccccaagtgttgggattacaggcgtgagccactgtgcccatcctagaattttttaaattttcaaaacagtaatctgtccttgagtgtgaactagattgtactgacaatctgaatagatatttcaactaatggttaaaaaacaaacaaaacacccaaaacacatcttagaatgattctcatgtcttccaaataaaaatactttaaaatgttgtcaatacttttacctatttagcttatgcctttggttatagaaaatatagaatcaatgataatgaattaataagaaaataaaaatagatatttcaactaatggttaaaaaacaaacaaaacacccaaaacacatcttagaatgattctcatgtcttccaaataaaaatactttaaaattttgtcaatacttttacctatttagcttatgcctttggttatagaaaatatagaatcaatgataatgaattaataagaaaataaaaaatatattccatctttaatatactgatggttcagttttatttctaaattgtctgagatggaagtatattaaacataaatggtgaaagtataatggggacaattcattatgtcctttggaaacattttcattgtaaattccagttgtatttattttttatttatttatctatttatttattattatttgttttagatggagtttccctcttgttgcccaggctggagtgcaatggcacgatctcggttcactgcaacctccgcctcctgggttcaagcgattcccctgcctcagcctcctaagtagctgggattacaggcatgtggcaacatgctcggctaagtttgtattttcagtagagacggggtttctccatgttggtcaggctggtctcgaactcctggcctcaggtgatctgcttgccttggcctccgaaagtgctgggattacaggcacgagccaccgcgcccggccataacgtgcagttttaaagtattatccttgatgaaattaaattgttaccaattttccaacctgcatgattcattaactctgcactaatgaattatactgcctgacttattcccaggaagctctagatgttgctcatcaatctatggataattgttgtttgtggtttttaagctccattgcatttttatctatatagatggagaattaagtcttgatgtgacaaagttgaaaaataataaaaccaaagttcagaaaactctaaacaatagttttatttatttattttaataatattcatttatttattttatttatttttaaaattatacttcaagtcctgggatacatgtgcagaacatgcaggtttgttacacaggcatacacatgccatggtgatttgctgcacccatcaacccatcatctacattaggtatttctcctaatgccatccctcccaccccaccccctgacaggccctggtgtgtgatgttcctctccctgtacccatatgttctcattgttcaactaccatttatgagtgagaacatgcagtgtttggttttctgttcctgtgttagtttgctgagaatgatcatttctagcttcatccatgtccctgcaaaggataagaactcctttttttatggctgcatagtattccatgatgtatatgtgccacattttctttatccagtctaacattgatgggcatttgggttggttccaagtctttgctattgtgaatagtgctgcaataaacctatgtgtgcacgtgtctttatagtagaatgatttataatcctttgggtataaaggattgggaaaagcatagtatctgggctggatagcaccgtccctcacggcatagtccctcatggcttcccttggctacgggagagagttccccgacccccttgcacttcccgggtaaggcaacgccccccacctgcttctgctcgccctccatgggctgcatccactgtctaaccagtaccagtgagatgaaccaggtacctcagttggaaatgcagaaatcactcgccttctgcattggtcttgctgggagctgcagaccagagctgttcctattcggccatcttgcccgggaatcttatttattttttgagatggagtttcactcttgttgcccaggctggagtgcaatggcgcaatcttggctcactgcaacctctgcctcccaggttcaagtgattctcctgcctcagccccctgagtggctaggattacaggcacccaccaccatgcccagctaatttttgtatttttagtagagacggggtttcgccatgttggccaggctggtcttgaactcctgacctcaggtgatccacccgccttggcctcccaaagtgctgggattacaggcgtgagccaccatgccctgccttaaacaatagttttaaaaacctctaggacctgtagtttgttttttgtttagagatgaggtcttgctatgttgcccatgctggtctggaactcctgtactcaagggatcctcttgcctcagaatatcgtggactaaaggtgtgaggcaccatgccaagccctgtggtttatttacactgtaggctgtaatagtttagctttccaggcagtgactatgtcttagaattaaagataaagacagttgcttgagatgccttagagagggctgcagttcaatgggagaaaatgccagaattatttttctgtgagaatatttcaggttacagtctagattagacaaatagcatctttaaggttttgtcaacaatagatattcaggggaaataaaaccttcagaatcagggctaaaaatctaaaaattctgtcctagagaagggcaaacttgaagatttttacttcacttttcctgctagtttagctaaagaaatatgaaaatgggctgggcatggtggctaatgcctgttatcccagtgctttgggaggccaaagtgggtggattattgagcccaggattttgggaccagcctgggcaacatagcgtagaccttgtctctacaaaaaatatttaaaaatggccaggactagtggctcatgcctataatcccagaactttgggaggttgaggcaagtggatagcttgagcccaggagttccagaccagcccaggcaacatagtgagacctcatctgtatcaaaagaaggtaaaagaaatacaaaaacaagtcttaacaactaagcaaagaaataagtaccttgacttgttctcacttgttctataagagttacactggcacaagctcatctaatgatgtagttgctttgaaatctctacttccttttttacttctttttgctgaacaaaaatatttaatgaacaggcttggattaataagtttggtgatggtgtccaatgaacacaaatgaccacgtaaagggtagtagtagattggacaccttatacatagttcagaatcatcatatgatcttcatggttgaggcttgtttcttttcttttttttcttttttttttgagatggagtttcactcttgttgcccaggctggagtacaatagcactatctcggctcactgcaacctctgcctcccaggttcaagtgattctcctgccgcagcctcccaagtagctgggattacaggcatgtgccaccccgcctggctaatttttgtatttttttttttttagtagagaaggggtttcaccatgttgttagggctggtctcgaactcctgacctcaggtgatctgcccacctcaacctcccaaagtgctgggattacaggtgtgaaccaccacacctggcccttgtttgattccttttaggcttgggaaaaaagggtgaagatgggggaggacagaagcagagataaacgaagtaaatgttcatacattctctcacttgaacctctcagcaaccctgttaagtttgtatttgtatttgtatttatttatttatttgacacagagtcttgctctataccccaggctggagtgcagtggtgtgatctcggctcactgcaaactccacctaccgggttcaagcaattctcctgcctcagcctcctgagtagctgggattacaggtgcctgccaccacacccagctaatttttgtatttttagtagagacagggtttcgccatgttggctaggctggtctcaaactcctgacctcaggtgacccactcgcctccaactccctaagtgctgggagccactgtgcctggccaagttcgtattatgattcattttataaatgggaaacttaaagacacagctggcaaatgtcaaagctggactttgaactaagatctaacaccaaaaccatgcttgatgcatagtagggccagtgatttatttttttttttaatattaggtaatagcaagtaatatgcccagagacatgatgggctgacaaagtattgacgggtcttgttcttactgtcccttctatgccccagtgctcaacttccccttaacccattccttatccttccccaccaccattccacccccaataaagtcacccaagacaggaaaaattgttaactattttcagaatactttggtaaagttgaggaaggggaaggaaacaaagtcttccagagcagagggggaaaatccctcttttgatgaaacatcctgtgtagcaactgtgaagcctggatttccccaggatgaggttagagtagcaggctgctgcttgtcacatggcctcagttcaaagtcacacctgtgggggcctcccgtaaaatttacctatatatggccctccacaaagccacaaacacagaactcaaaatggcattcaccacttctgagatgctgaacaggaaggaatagcactgtttttacaaattaagtgcacagtatatgtcacaaggaggaaataaaccctatgagtttgaacttgcacatcctctcaatactgaaagattaattttggtggctgaggttaataatacggttattcgtgtttggatatgaatgtaactcgaccgattgggaaagcaggtgctagattgatgtaccatgcctgagacccatgagtcattgtcactgatttacaagctggccttgccatgaaaatggaagccagagccaactctatgtcatacaatttatgccattcactaaaattatagataatttcagcctgtgcatttgcaaaacagtctatgccatttttgctttaaacatcttttgtacttggtctctctgacttgtctaaataagtattatcattcataataaccattaccaatccattatgcaacatcatgaaaatatatacagcttttagatttaatccatgaaataaagcctatgacttctgcttgcatctttgataaacggccaagttctcacagctgttatgatttcaattatgaagaaaattggaacttttgcattcttcagtggctaaaaatcactcagaaaaaaacacttgttcacataagctatttttttccctcgtgtgtatcatgagccttgggtctgattagtgtagttgattaaagcaatgtgccaaaaggcaaagggcccttgttaaagcccaaggaaggtcagctagattaacttcccaagtttactgaaaatctgttctattagtagtcttcagccaaattaggcaagggagtacaaacagatcagtacaaatccagtctttaatgctagcaaaatgtagctcaaaccacagttaacattgatacaaggtcaataatgtcatcttcccatacagagacagatgacacacatgcagaagcatcttagaaacacctgctctcctccgcctttttttttttttttttttttttttagatggagagtccctctgtcgcccaggctggagtacagtagtgaaatcccagctcactgcaacctgggcctcctgggttcaagtggttctcctgcctcagcctccccagtagctgggattacagtcatgtgccacgacgcccagatagtttttatatttttagtagagacagggtttcaccatgttggccaggctggtctcaaactacctgcctcggccttatttacaggttttgtctcctcatatacaaccaatctcaacatagagaactccctaactctgatccaggtaggctctccctcatcaagagattaagagttctgaagttaaatgaactacaaaatgaactacagtttataatccattgcctcacatccaaagtgcttcctctccctttctttttatccccctctcccttcaactactattctctgaagcttttcagttctctcaaatcttaattttatttttttcctccacaagaacaaacttggtaaataaccaagattgttcgtggtttcaggctcctctttttaatcatttttctcatgtcagtaatgagagctcctgagttaatattatgctttcccaaacctggaatcctcgtcttttttgcagaagaagaatcaagcgtattgtacgaaatctcaagcatatttatccttaacaaggtcaaagtcagaaaccttaatccaaaaccataaacctcctgcagaaaaaatctctggaattcaactctctctcgtctattctttattcctactgataccacttttgtgattgaaacatgaaacagatcctcatctcctgaagatgatatatagaaattgttttaaatgccttgtgaaaacccttaataacccgaattctgttccccagttgagctatattttccttgctccaaatttaccatgtcattccaggcctccaggcctttggttatttgtcccatctgtctgggcttctcttccccgcccttccttaccttactaacttactcatccttcacttcttagcttagatttctcttctgctgagaagccttcactggcccctacatcgtcagctatgggaaccctcttatgtgtagtctctatctccccctcttctagcacttgtcacagtgtgttgtaactgcgtggttgcttggattttccccctgtcctggaaacacagcctagggtgcttactgccaagcttatgatagaaactctcaataaacaccagctgagagaataaaccaaggctttgctgtgtgctgggagaggattcagcattctggtatccgtaaccctgttacataggtggtcactacctgaaaggtctgctttcatgctggtgtcagatttgcttgttttaaaaataactcagggctgctgatacatgcaattctaagccaagaagagaaccgtaatggtcatcaatttctttctttcttttttgttaccaccaagttaatgcatttaacgttttctaatctacaaagacctataacctctgctccccacgttacttaactagagagctacctatctgctactcatcaaacccagccagagatgccaagttcctgaattttttttctcacatagaaatctagatgaatcccctgaaatggtcattttaaaatcaagtcaaaaggaaaacaacaggaaatactcactagagtaaaagagaaaagtgaatcgaggacagacttgtgtatttacaactctcaaggccaatgaacattggaaaagcaaactaaaatgatagatagcaagctgtggaatttggcttgaccttaaagaggattttaatatgctcttatatcactgtctgctactcaaggtcgataagaaaagcgtggttttcttacggaacagagctgagtcacttatataataccagtgcatttcagttgattgtgatgattttttcaagagatgatgtcacacaaattgagttttgcttgaatcttgcctaaaaatagtttgatttatttactaggtcaaaaagacaaggggatctaacatcaatgacaagtaaaaatagaaagatttatttatcctgaacactatggacaaatgtgtgtctcagcacatttaggtgtttatccaaggctctttgtgtaagtagaatgaaccagaagcaatttactatatgtgaataagaaatatcaaggtgatattaatggtttgtatttcccttttctgtagaagatttgtaagaagagtcttttcaggtccccaaaggtaaactttaggattaaattatatggttttaagaaattatcactaaatctttcccccattttttttaacccttaaacatttttgtttgaaacagggtctcactctgttgttcaggctgcagtgcagtggcaagatcatggctcactgcagacttgacctcctgggctcaagctgtcctgcctcagcctctcaggtagctgggactataggtgtgcactactatacacggctaatttatttcatcgtattttttgtagagacagggtctcactatgttgcccaggctagttttgggttcctgggctcaagcaatcatcctgccttgggctcccaaagttctgggattacaggtgtgagccattgcacccagcccttagaatcttcatatttttgtttaatttgttctttgtagagtagttttcactacagggatgttacttggtaaattaaattctatcatttcaattaacaacccaagaaaaatatatgtataatgataaactttgaggaaaaagagaaataactgcaaaaaaaatgaattggcatgcagttaaactttgcttatcccttaaattttgttcctgcttatagatttttagtagttcatacaaagtcttcttttaaaattttaaaagtctcaaaactactaaaacaggatattattttagtggaaaatagccatatggtttctgggaaggattttactaaaggaataaatttaattagaagcaggaaagatttggttacatacaacaaaagccaacaaaatatgctcaaccccaagggtaagtgtaactgctggctagagatttccaggagaggacagggagtagttttcctagaatattttatgtcctaaatagcctggatgaagtcccttattcccttccagactcatcactgggaacgcggcacactggtgggctatgattccctggagagcttatgaaataaaaatcaagtgagctacgagtgcagccagaaacttgctttacccacaagtcctgaccctgaaacttaatttttgtgacttgaattgtgtctctctgtttaaaatttatttatttagagatgaggttttactctgtcacccaggctggagtgcagtggtgcaatcattgttcactgcatcctcaatctcccaggctcaagcaatccttccatctcagcctcccgagtagctgggactacaggtgggtgccatcacgcctggctaatttttaaaattttctgtagtgatgggagtctttctacgtgacccaggctggtcttgaacttctgggctcaagcgatcctcccacctctgtctcccaaagtgttgcgataacaggcgtgagccaccatgcccagctaaattatgtttctaaatacagcagaactatgtacttcgtgataggtaaagctattgtttggttgattcttagagaagagaaagggagtccatgctatctctttccacactctaaatcctgagatataaatctttagattcttgatcctcacccctggaagagaggtcagcagtgactcgaacaggggtgacctcctggctctaggagccccaggaaacaggattggaaacatggaagtactcctggaggagaaggatttagcttcctggttatcaggctctctggctgctcacacaatgtgcgcgttgcacagacagtaagccagttataatcgaactctttcacatgaaattcttctcttgggaacaagggcttgatcaggatctttttgggagagtgtgctgattttagctttcagctaacgtagacattctctctctgttagcacaagaaacaaatctggttcatttttgtaaatttaacaaccgagactcagatttaaaaaaaaattgattgcgccactgctctccagcctgggcaacagagtgagattccacctcaaaaaaaaaaaaaaaaaaaaaaaagccgcagacaggattgtaaggtaatttaaatctacatagaaataattcatctaagtttatttagtctgatcatttgttttacgtgctttctcaaggataacatggttgaaaatttagtgaaaaataaggactattgtgggtgataagcttaggaatcaccagacacctctctccagagaccataatacatcatgccaagagcaaaaaactgggagaaatgagcaatttgaagtactgttattttaatccccataagcctatataaaattttttttgatataaattaaaagaaaccagaaatctataaagccatctggctgatttaagtatattttttatagcatctttttaagaaagatcagaaaaactcaagacaatataaaagtatgtcagtatggaaactattcctagctgatcattttacttccaagccttctgggcttcaaagggacagctcaacaattttgagaagaaatataaaagtaacaacacaccttcttgagcctaacagatggagtaagacatttgaaatgctgaacaagagacatgggtcagaatccatcccagaattgtatgaagccagcttaattaaaagtgctttctaggctgaagcagagcatcacttgagctcaggagttcgtcttttgtttttctttttttttttttctttttgtggagaacggggtctcgctatattgcccaggcaggtctcgaactcctgggctcaagctatcgtctcgcctcttgcctccctgagagctgggattacagacatgagccaccgcgcccagctgagctcaggagttcgaaaccagactgagcaacagcgagaccttgtctctactaaaatttaaaaaagaaaaaaaacaattagctgggcatggtggtgaaagcctgtagtcccagctacttggagggctgaggattgcttgagcccaggaaatcgaggctgcagtgagccctgattgtgccactgcactccagcctgggcaacagagtgagaccttgtctcaaaaaaataaaaaatttttttctacagtgcccctctattattgtctttgtaatttattgtcttcctcctttgtaaaggaggaagaagaggcagtaaccttatatttaattatgtcaacaactcagtgttaattcttctgtttgcagcaccgtggctaataacttcaaatcgcatggatccttccagaggactctggcttcactaggcctttaaaacagcacacagtgccttggcttcagcatttggtcgctgactaagcacctttcaagctgccttcaattgaaagacggacagcggactctgaggaaatccttgctcagccaaatgtatcccatatgagagggcaaacttaatgagaatcagtccctggcatgcagcgcctctggaatgtgcgtgatttacagccagcatgggctacagagttttctgtcctagtctctccttttctgtcctagtctctcctttttttttttttcaaaaaaaaaaaaatgcatcaacaaagtatcaattttagctaataaaggcaaaaagaaaaaagagcacactaactttagcacatgtatgcaaggtcccgggaggagataagaaaatgaacacattcgattcacaactgcaaggagcttagagaatacatggacacgcacacacatatcacacagggcagagcaaactgattgacaggcagaagtacaaagtgctgtgggagcataaatattgtgttttccattttcctccaagtgcctttatttgtagcaatggaatggtctcatggtgcaaaatcatatttgtgatgctgcctggcttcctatcaatagggtggagttgtacctgttcactttctacgagtgaggctcctggtgagtatggtgttttccccaaacgcacaagtaatagattaatatgggattgaaacatttaaacgatataaagaaagctaatgtcctccttgactcatctcctccacctaatcactggccagttctaatccctggaaggtggtaatcaccattgtcatttgatatacatacttccacgtcttttaatttacatttacccacacatatatactcacactcatagataaacacacatatatacagacaagaagaaagaaatacaaagtttaaaaaatgtgataatggtatatacatgttcatcttcaacttgcttttctagcataatataccatgggatatgtcaatatatacaaatctcattttttttttcttttttgagacagagttttgctcttgttgcccaggttagagtgcagtggcgccatctcggctcactgcaacctccgcctcccgggttcaagcaattctccagcctcaacctcccgagtagctgagattgcaggcatgcgccaccacgcctggctaattttttgtatttttagtagagacagggtttcaccatgttggccaggctggtctcaaactctgaccttaggtgatccacctgcctcggcctcccaaagtgctgggattacaggcgtgagccaccgtgcccggctacaaatctctttgtttttaatcactgtatagtgttctatggtatggatatgtcataattaataatgctctacaagtttataattttgttatctcctgatgtttccattttttcaccatttccaacattgcaatggatattactgtacctatctcagttatcacataagcaagtaattatctggggtagatgtggagacatggatttgctaaattaaaaggtaagagattcccagctgggctcagtggttcatgcctataatcccagcactttgggaggctgaggtgggtggatcacttgaggccaggagttcaagttgcagtgagccaacatcacgtcactgcactctagcctgggtgacagagtgagactctgtctcaaaaacaaacaaaggcaagagattttgattttttttttttttttttttttttgagatggagcctcgctcttgtcacctaggctggagtacaatggcatgatcctgggtcactacaacctccaccacctcccaggttcaagcgattctcctgcctcagtcttccaagtagctgggattacaggcgcccgccaccacacctggctaatttttgtatttttagtagagacagggtttcaccatgttgaccgggctggtcttgaactcctgacctcaggtgatctgccctcctcgacctccaaaagtgctgggattacaggcgtgagccactgtgccctgccttcagtcttcttgagttggctattactaggaagtatgagaaaaatgtccctctctgacagaatttgcccatttttctttctatttgttagttatttctttaaatatttccatgttatgttaagtgcatgaagatttgtgaatgttttatcttcttggtagatatttttcttcaacatgaaatattcctctttggtcctttttcctttttttttttttgtattttgtcgatatttatattgctaaaactactttccttgtattagactttatctggaacattattattttccaaattgccagatccttttacaaacatagtttacaatgtccccagcttttgctgtgatcattttggactatggtttccacatcaaacttatcatcctacctgccttctctttttcagagatacttaattatcccttatctacacaatggtatactttgtcttctagcacaattataagctaaagtgtgtgtgtgtctgtgtgtgtgtgtgtatgtgtgtgtgtgtcatttaaggcagaaagtagagatgacattacatggtcaggctgccatcttgatacgatcctatgttttccttaacaccagatttccttctccacctccacttcaaaactttcctttccttccagcttggttgatctagatactaaaggtgccgtgggagatacaatacagagtagagtttgtgaatacgtttagtcagcatacacctctcgaaaaactacttttggtctccatctctttgtggcctataagttagtttcaggctgaatactacaacatgtgttccagtagcatgcattatttagtaacagcttacacagctctaagttatcatctttcccacctcattcccaggaagatttgtttaatttataagcagtccatttcagacagcactcctcgggatatcacaatattgctgttcttctgggtgattcattggcattatgaatacccttgtttcttccatgggtaaaacatgtttcaaggccactaactgggctattggcaaggcctggtacaaactaagtgcaatgtaactcttagcaatttgtgaccattaaacatagcatttataatgtgctagttttaaagttgaacaaaacaacaacaacaacaaagcaacccacagcccgtgtctacggccataccaccctgaacacgcctgatctcagaagctaagcaggatcggacctggctggtacttggatgggagactgtttgggaataccaggtgctgtaggcttcgctgggcgtggtggctcatgcctgtaatccccgcactttgggaggccgaggcaggcagatcacctgaggttgggagttcaagaccagcctgaccaacatggagaaaccctgtccaggcatggtggcgcatgcctgtaatgccagctattcgcaaggctgaggcaggagaatcacttgaacccaggaggcaggggttactgtgagctgagatcgtgccattgcaccccagcctgggcaacaacagctaaacttcatctcaaaaaaacccaacaaacaaaacaaaacaaaaaacccacaattagttcataaaagacttgcacttaatttgccttcttattttatttaaaacattcttacctcgttttctatattttatctttacatatagaatacagagtttaattttattgtacttttccttttacctccctttttttcttgtttattttcacttataggtcattaaatgccaagcataggatctcagacgaaaaagggattcagggttaactagctgaggcctatcatatgatgtttgagaggttttgtggcttgcctgaattcctccattgacctgtggcagagctggcacaagaatatgggtcacctgactccagcacatgcacatcaatttacgtttacaaaagagtttttaaaatacaatctcatctactaactactacaaaactactggaaagaaacctgacggtgagtacatattacctcaatttttataggagagaacactgagcaggacaaatgaattaatgatttgcctaaaataatctgcatcgggagatgtcaggagaacaacctggggtctttactaccggcttctgcatctcacagcctctccaccttctcaccttgcaacttcactttctaaaaggacagagttgccttttcaatgatttatttcatcatttcataatttcatccctataaaaacacaaaatatagattttttttttttttgagacagggtctggctctgttacccaggctggagtgctgtggtgccatcttggttcactgcaccctcctcattcctgggctcaagcaatgctcctacctcagcctcccaagtggctaggaacacaggaatccaccaccatgctcagctaattttattttatttatttgtagagacgagttggtctcaaactcctgggctcaagccatccaccccccttggcttccctggggttacaggcatgagccactgtgccctgctgatgcatattttaacgattaaaataataataataaaaaaaacccacctggcatggtggctcacacctgtaatgccagcactttgggaggccgaggcaggcgaatcacctgaggtcaggagtttgagaatagccttgccaacatggtgaaactctgtctctactaaaaacacaaaaattcgccaggcgtggtggcgggtgcctgtaatcccagctacttaggaggctgaggcaggagaatcacttgaacctgggaggcagagattctagtaagccgagatcgcgccactgcgctttccagcctgggtgacagggcgagactccatctcaaaaataaaataaaataaataaaaaggcttaggcctgtaatccgaacacccaagcgggggcagatctcttgaacccagaagtttgataccaacctgtctccacaaaaaataaaataaaataaaataaaattagctgggcatagtggtgcatggggcgtgtagtcccagctacttgggaggctgaggtgggaccactgcttgagccctggaggtcgaggctgcagtgagccatgattgcaccactacactctagcctgggcagtagagcaaaaccttgtctcaaaaaaaaagtaataaaataaagtatgtgtcattttgatttgtgataaccttaggaaaaagccagcaaagtctgggaaccaggtaatcgattgcaaattggagaatgatttacctgctatctaagataaaggaaaagggtaaatcacaatgttgctttaaattcctttcagctttgtttattgtttccttttgtgtggaatttcactgttgcattgatttaaacccagctcctatcaaatgggacatagagtaggccctcaagtaaacatttagcactaggcatgtgtgctctgtataggatatgtagaaccctctctctgcttctaagtcataaatagttctttagagtctaagaaattggcaaactcaggctgggcgcagtggctcaggcctgtaataccagcattttgggaggctgaggcaggcagatcacttgaggtccggagttcaagaccagcctggccaacatggtgaaaccccatctctactaaaaaaaaaaaaaaaaattacccgggtgtggtgtcagatgcctgtaatcccggctactcaggaggctgaggcaggagaattgcttgaacctgggaggtggaggttgcagtgagctgagatctcgtcactgcactccaacctgggagagctgtgtccattcatttacatattatctatggctgctttccctagaagggcagagctaaatagaagttagagactgtattttaggcaaaggctaaaatatttactatctggccgtttagataaaaagttgactctatcccttgcatcaggagcgataaatagatgctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggcattatgtggttgggacagaaagaaatttaatgttgaccatcgaaagaggatgcttgcatttcagaggggctgatacatgagactgcggtttatcacagcaggtctaccctccccagagctcagtttctgcccttgtaaaatggagataataattatgcctactttacaagggttttgtgaggactaaatgagatgatgcaggtaagcccagtgcttgacaccaggtgaatccttcacaaatatttgctattgtggttatggcttcattccatggaaagagttttatacaaagggccattggagaaaagatggagggtacttggtccagtcaggaaaaatcagggaaggctttctggtggaagtgatggttaagttgaatcttaaaagctgagttacactttgggaggccgaggtgggcggatcacgaggtcaggagatcgaaaccatcccggctaaaacggtgaaaccccgtctctactaaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagctgagttaaaggaagccaggtgaagagaaatgggaaagatatttctagtagaggggatggcagaagcccaaatacagaggcaagaatctgctgagatgaatagaaaacaagctccaaaaaggagaggcaagaactaaagctggatagaaagtttaggtcatggggcaatgaggggaccctgaagtatttatttttatttatttatttacttactatttagggatggggtctcgctgtgttgcccaggctgatcttgacctcctgggctccagtgattctcctgccttagccttccgaagagctggggttacaagcatgagccgctgcacccagctcactgaagtattttaagcaggagagtaggatggtcaaatgtgtttttctttttctttttttttgagacagagtctcactctgtaacccaggctggagtgcagtggtgcgatcttggctcactgcaacctccgcctcccaggttcaagagattctcctgcctcagcctcccaagtagctgggattacaggtgcctgccaccacacccggctaattttttgtatttttagtagagatggggtttcaccatgttatccaggctgatcttgaactcccaatctcaggtgatccaccacctcggcctcccaaagccctaggattataggcgtgagccaccgtgcccagcctcaaatgtgtttttcaatacagtatgaaggacggatttaagatggtcaagatcaaaggagctagatgagagtcaggaatggattagaaaagaaaggtaagggccaaacaagaatagtagctttgggaatggaaaggaggaaacaataatcaaatctacttttagctctcaagactatatcctcttctccatccaagtacaggttgagcatcttaaatctaaaaatccaaaatctgaaatgcttcgacatctgaagctctttgagtgtggacaagatgttcaaagaaaatactcattggagctttttggattttcagattaaagatgctcaaccagtaattataatgcaagtattccaaaatctgaaaaaaaaaaaaaaacccaaatctgaaatacttctggttccaagcattttggataagagagactcagcttgtatcttctcgattcctaaagccattccttaaatggtattgcccttttagtcttttcttttcttttcttttcttttcttttcttttgagatggagtctcactctgtcacccaggctggagtgcagtggcgcaatcttggctcactgcagcctctgccttccaggttcaagtgaatctttcacctcagcctccaagtaactgggattacaggcctgcaccaccatgccctgctaatttttgtattttagtagagacggggtttcaccgtgttgaccaagttagtcttgaactcaggttcaaggttcaaggtatccacccaccttggcctcccaaagtgctggtattacaggcgtgagccacagcgcctggccatctttttttaaaaaataaaaataatctgtggctgggtgcattggctcacctcatctcttaaaaaaataagtaaataaaataaaataatttgttatttaaattgattgatcagtcgattgtagaggtggagtgtcactatgttgcccacactggtcttaaactcctggcctcaagtgatctgcccaccttggcctcccaaagtgttgggattacaggtgtgacccactgtgtccagcctccctttttaatcttaacctcactgataccacagcttctttccaaatgcaaaagctgtcttgttgctacctagctttaaactcctcagtttggttcctcatctctagcagcagtggctttcaaacctgtttcatcaggattgatgtattataagaaagcccatatgactgaaacaattggttccccactaaaacctatcctttttacatgaaatgcactgacatctcctattctattctttcaaaatgctgattgcaatctattgaactgatttcatgaaccactaatgggtgccacacaaattgaaaaacgctcatctaaatggtaaaatctaaatatcttggcctgggagaccaagtctcctagggtctggacgcctatcttctattgtgcccggaatgcatccagacctccattatatcatttactttgcagttctcttaaagattgttctcctgaatctttgattcccttgaccagccttgtccacctggaaactcctgctctaagtcacaaacttgggaaagccattgtctggcttcttacccattctttcatccatttgggtattcatttgtttaagtgggagcacacattcattgctttgcttgtgtatttcccttattagaatgtgagtttcataaggactgagatattattttctctcatatattcagtagtgggacatttataatttcttctgtgtgttccctcttcctagcttattcctgctctattttctgtctgtgttcactttgtgttgaagctcacaaggaaagagactcactattacatccccagagcttagcacaactcccaacatacaggcaatgctgaagaaatggttgctgattggctccatgctaggtatttttcaaggcacagggaatgacaaataagaggcaattctgtctttaggaactcagagccttgcaggaaagcccaacaaggaaatcaacaattggaagacagtgttaaagcgagcatgagttcatctctggggagaagtaggaccgggctgtgatggggataggtgaaatgcagcattttggagagagaggaaagcatgtttcaaagcatgctcatagagagggccaaccttggggtgagtatgtgtggcaagccagaaagccaaaaagctaagtgggtcagacatcaaatgacttgaatgtttggatactgaaatgtcatccttaactcacagggagggtacgctgaaggattctaaatgttagcatgatctgatcagatttgctatcttctaaatgaattgggcccaggggaaaagcatcctaggttagaggaataagcactgtccacagattagatggaccccacagattgaggccccttctggagacagtgcttattccaggggtctccaaacccgggtaacacaggacagctttaaaaatgcaggctcagctgtgcatggtggctcacacctataatcccagcactttggaaggctgaggtgggtggatagtttgagctcaggtgttctagactagcctgggcaacatggtaaaaccccaacactacaaaaaatacaaattagccaagcatggtggtgtgtgcctgtaatcccagctactcaggatgctgaggtgggaggagtgcttgagcccaggaggttgaggctgcagtgaactgtgattgtgccactgcactccagcctggcaagagactcttgtctcaaaaaaaaccacaaaaacaaaaacaaaaaccagaaccaaaaaacccagggtgaggtgcagtggctcacgcctgtaaccccagcactttgggaggaggccaaggcaggcatctctactaaaactacaaaaattagctggtgtggtagtgggtgcctttaatcccagctactcgggaggctgaggcagaagaattgcttgaacctgggaggtggaagttgtggtgagctgagatcgtaccactgcactccagcctgggtgacacagcaagattctgtcttgaaaaaacaaaccaaccaacaaacaaaaaccgaaccaacaaaaaaaggaaataaaaattaaaatgtagtcttaccagtggcttttaacatttttaaattttattttcaagctctatgtgacctagatgaagggcagggaaggctaaatggagcacgaaatgaccagggtcctggaggtgtgagaggtgggcagacccaggcaggtgtgagaggtgggcagacctgggttttttgggcaatgggaggaggtatcactataaaataagacagagtggaaatgccatcctacagcctcacttggagctctctacagtattgttcctcaaagacatcttcctttcttcctttctccactcccctaagtcccccacatctaaaataacaccatatagctcttaaactccgtaataacctaggtatattatgaattaaataggtttctatgggtaagaataaggttaagtgtggagcagaaagggttactaaacagcaagtataatattgttttttctattattctgaggttaagcagtcaatttacaagtgatttggatttcctcacaatttactgaacaaagaagaaaatctaagatataaaaagggttttctacagaaatgaataataaactgaattaagagaattggattccagttctagcttcgtaactaccttgagcaagacactgaattcatgtgaacttgaaggcgcttatccgtaaaatgatgatcttggagcatccaagaagtcctttccgactgtgtcacagattcaaagctcttcgttccctgaagtcctgctactgtgacttggaactctctgtttctatggtgtgcagcactcagcacaagtttgttgaatgaacaaatgatcaaatgacatttgcccttccctgcctgacattccagtcacattcttccataactttgcatttcttccattagataaataaacaaacgcaaaaaatccacaaggcttttaagataattttatgcccttaagggcagttgtttaaaaatctatttaaaacacaaagataaagactgaatgaaagtctcattattagagcgctgtacattgcttaattaaattgaaagtggtaaatgaaaggtaagatgattaacatccaaactggggtcttattaccactctctgatgttactgcttgttcgttgagtcctcttataaaagaaattgcacagtacactcaatttcagttttatacaaaaacagctttcctccaaattatgcttgtgctgtattggtaatggtttctatttctgtattctatttttttttctcacttcatgttttataaatgaagaaaatgttaaggtttaattgttccctgaaaacaggaggacagtcaaagctaacaaaaagatatctatgaagtacctattatgtccaaggattgtgtgaggttctgaaattatggaagataaaagaatgtattgagaataaattggaaatgttcaaagatcctatggaaattgctggaattaaaaaaggctcagttttcaaccatagaatcagaagcacaagaaaaaaaaaaccaaagaggaaaagaaaactggctgtgacctccgtacaattgagacagaggaaaatgactgttaacatgaatctgtgtaaatggagaaggaaaaaggatgcatttcaggacagctacatttaaataatcaaaataatttaaaaagtgtaggcaaggtagtgagacttcctttctacagaaaaaattaactggatgtggtggcatgcacctggagtcctagctactaaggaggttgaagcaggaagatcacttaaactcagaagttcaaggttactggctgggagcagtggctcatgcatgtagtctcagcactttgggaagcctacatgggtggatcacttgaggtcaggagttcaagactagcctggccaacatggtgaaaccccgtctttattaaaaatacaaaaattagctggacgtggtggtgcgtgcctgtagttccagctactcaggaggctgaggcaaagaatcacttgaacccgggaggtagagattgcagtgagctgagatggtgccactgcactccaacgtgggcaatagagtgagatcctgtctcaaaataaataaataaataaataaataaataaaataaaggcaagagtaaaaatcaaagaaacattcttgcaacattatccttggtgataccacaccctacagatatgctgtattcttttaatagatatcaatgaactgacttgttaaagaaagaaagtggaaatgtagtatataacccaaaatgcattacattaatatggccctcattaatcccctcccccccaaaaatagcaagtcattctgctatatgggagaatttcatacatgaaattttacaaggataggtgatttataggaacttctgattattatgctttttgccattcttttattataaaaccagcactcaaaaagaatcaggtattggttctacatacgaatttgaaatgagcaggtgtgcagtaagcactatattacagtctggttaagtaaaatataaacacttagctttgcttagaaagcctactgttgggaaaagctgggtgtggtggcttatgcctgcaatctaatcccaatactttgggaggttgaggtggagggatttcttgaggccaagaggtcgagaccagccggggcaacatagtgagatctcatctctacaataagataaaaaaatatagctgagaatagtgatgcacacctgtagtcccagacactcagaaggctgaggtggaagggttgcttgagcccaggaggttgaggctgcagtgagccacgatcatgccattgcactccagcctgggcaacaggcagaatgagacactgtctcaaaaaaaaaaaaaaaaaaaaagttgtttcttcctggcccattccatcttcaaagtgccttttctctgtataaggacatatcttccacatagggtatagttcctagtaccatttgattacctatcttactcacggctgtcttgaaggcaaacagaaattcctaagtatttgttgaataaatagatgagtaaaggagtgaatagatgctttgtggtggtaatttagcttatttttaaaatatatatattttttaatttttttgtagagacaaggtctcactatattgcccaggctagtctcaaactaccgggctcaagcgattctcccaccttggcttcccaatgtactgagattacaggcatgagccacctcgcctggccaatttagcttcttcatttgtgttcctccctagattgtaaattctttatggattctttatggataaatatttcactggacatctttatgttgcttgtaatgccaagcacagtatcttgcatgcatgacactgttcaacacatatttgttgtattaattgaaagtgtgtgcctgtcaccctgcgaggtctgaatgaaatagcagatccaggccaggtgcagtggctcacacctgtaatcccagcactttgggaggccaaggcaggcggatcactttaggtcaggagttcaaggccagcctggccaacatggtgaaaccccatctctactaaaaatacaaaaaaattagctgggcgtggtggtgtgcaccagtaaccccagctacttgagggctgaggcaggagaatcacttaaacccgaaaggcagaggttgcagtgagccaagatcgcaccattgcactccagcctgggtgacgagcgaaactccatctccaaaaaaaccagaaacaaaataccagatccaatctttggaaatttcacaccctcatctgctcaagcttcctggaatctggattataaccatgttttaaagtccccattccaactttcttatccacctacccgttcatagcttagtttttggtcattttagtgtttatcttagtattttagtactgttagaagatctgatttcaagtgttgtttctaccacctattagatgtgtggtcttgagcaactaatttaatctctaaatctattttctcatccattaagagtactgagtatatctatgtaacaagtggtaaggatgagtaggtggtagtaaaagagaggcatctgaatcctctgcaagcatttaaaagaaaaatacatatatgagttacttaatgttgtaattattcacagttagctttccaaagataaaactggctaccaatttgttctttttttttttttttagagacagattctcagtcggtctcccaggcaggagtgcagtggcgtaatcacagctcactgcagccttgaatcccatggctcaaatgaccctcccatcttagcctattgagtagctgggactacaggtgcaccaccacacccagctaacttttaaattttttgtagagatgggggtctcactatgttgcccagggtggtttcaaattcgtggtcttaaatgatcctcccgtctcggcctccgggatcaggcacaagccaccaagcctggtccaattctgatatgctataaccagaactggactaggagagttgctcacgtgcctaataaggtttaactatatacttatatacttaactatatacttatgtttgtttgcatttgagccatgataggcccactcaattttctccttgtgggatgagagagactggtttaaaagcagttcaagtggaaaattcctggagttttaaattccctctaagccttataggaaatgtataatccattctctggactacttgggtaggttatatcagtagaagcattgaggccagaaaaacagaggtgataccctgacctctgtcgtgttgagtcagatctggagtactggctctagacttgttctgattttatttaattttatttatttatttattttgagacagggtctcactctgtcactcaagctggagtgcagtggcatgtgttcttctgattgtaataggggtattgacaaactaggaacgctctaagagcagatagaacagtgaaggagattgaaatggttaatttgtgtgtcagctttacaatcagttaacttctaaaagagtttatcagtgagcatgctggctcatgcctgtagtcccagcacttgggaggccaaggagggcggatcacttgaggtcaggagttcgagaccagcctggccaacatggtgaaaccccctctctgctaaaaatacaaaaaattagctgggcatggtggcgcacacctgtaattccagctactcgggagtctgaggcaggagaatcacttgaacctgggaggcggaggttgcagtgagctgagatcacaccaccgcactccagcctgggcaacagagtgagactccatctcaaaaaaaaaaataaaataaaagagtttatctttggtaatttgggtggtccttatctaatcaattgaaaagcattaagagtaaagctgaggttttcctgaggaataataaattatgcctcaagactgcagcctaagacttctggcctgccccacagatttcagacttgccatctccacagctgcatgagccaattcattgaaataaatctcttcatatatatcatctaatgattctatttctctggagaaccctaactgatacagagatcacactagaaagatagagataaaaactcagaaaggccaggacaacagtttttgaatatttgaatagctgctatgtgaaagatgagccaatggatggcggtaatgggaagacatatttgggcttcccatgtaccaaaacttaaatgtgtcttttgtttaaagaaggcagctgagccggtccaagtgcaatggtgtttacaactgattgatcacaaccaattacagatttctttgttccttctccactcccgctgcttcacctaactagccttaaacatacatatatacaggctgggtgcggtggctcacacctgtaatcctagcactttgggaggctgaggcgggtagatcacttgaggtcaggagttcaagatcagcctggccaacatggtgaaaccccgtctctactaaaaatacaaaaattagctgggcgtggtggcacgtgcctgtaatcccagttactcaggaggctgaggtgagagaattgcttgaacccagagggtggaggttgcagtgagcgaagatcacgccactggactgcagcctcagtggcagagtgaaactctgccttaaaaaaaaaacaaacataaatacatatacatatgaagaaggcagctgccctacagaggacacatcaaagaagtctggccgggcacagtgactcacgcctgtaatcccagcacattgggaggccaaggtgggaggatcatttgagcctgggagtttgagatcagcttgggcaatacagtgagaccttgtctctacaaaaaataaaaattagccaggcatggtggcaaacacctgcagtcccaggtactcaggaggccgaggtgggaggatctcttgagcccagaaggtcaaggctgcagtgaagttgaggctgcaatgagccatgatcgcagcactgcactccagcctgggcaacagaacaagacgctgtcccctgccaccaccaaaaaaaaaaaaaaaaaaaaaaaaaaaaaaaaagcctgaccaatctttcactcttttaagtgccaaaataatgcattttgggtttcaggcattaaatgagtcccttccttatagctctttatctctttacaattttatttccagtttggtgttcatctggggtattatgctattttatcagtgccaatccattcctttatatgttcaaatattctttttgtttatttgtttgttttcgagatggagtctcactctgtcacccaggctgcagtgcagtggctcaatctcagctcactgcaacctctgcctcccaggttcaagcaattctcctgtctcagcctcccaggtagctgggactacaggtgcacaccaccacgcctggcaatttttgtatttttagtagagacagggtttcaccatgttgaacagggtggtctcgaacaccagacctcaagccatctgcccacctccttggcctctcaaagtgctgggattaaaggcctgagccactgcagccggcccatcacatcagtcttatgcctttacatactcagagcttagctcacacttagaagtgagaacatatgatatttggctttttctttctttctttctttcttttttttttttgagatagagtctcactctatcgcccaggctggagtacaatggaatgatctcagttcactgccaccccacctcctaggttcaagcgattctcctgcctcaacctcctaagtagctgggactacaggtgcacaccactacacctagttaatttttgtatttttagttgagacagggtttcaccaacaggccagtttggtctctaactcctgacctcaggtgatctgcctgccttggcctcccaaagttctgagattacaggcatgagccaccacacccagccaatatttggttttccattcccgagttatttcacttagaataatggcctccagctacacccaagttgtggcaaaagacattattttgttctttgttatggctgagtagtattccttggtgtgtatatatcacattttttttatccactcattggctgatgggcagttaggatggttctgtatctttacaattgcgaattgtgctgctataaatatgcatgttcatgtgtctttttcgtgtaatgacttcttttcttttgggtagagacccagtagtgggattgctgaatcaaatggtagttctacttatagttctttaaggaatttctctactgttttccatagtggttgcactagtttacattcccaccagcagtgtaaaagtgctcccttttggctgggctcggtggctcacgcctgtaatcccagcactttgggaggccgaggtgggcagattgcctgaggtcggcagattgcctgaggtcaggagttcgagaccagcctggctaacatgttgaaaccccatctttactaaaaatacaaaaaattagccaagcatggtggtgcatgcctgtagtcccagctactcaggaggctgaggaaggaaaatcacttgaaccagggaggcagaggttgcagcgagctgagatcctgccactgcactccagcctgggcgacagagtgagactctgcctcaaaaaaaaaaaaaaaaaaaggtggtcccttttcaccacatccgcaccagcatcaatttttttttttttttactttttcataatggccattcttgcaggagtaaagtggtatctaattgtggttttaatttgcatttccctgataattagtgatgctgagcatttttttcatatgtttgctggctgtttgtatatctccttttgagaattgtctattcatgtcctttgttgactttttgatggggtttttttttctttcagttttcgtttccttgtaacacatctattctgtaaggataaagatgtctgtaaaataagagaccattaacttgtgctaaaggtcagtattttttttaagggataaaaagataaaatttgctgggaaacaaatgttaggaacaactgactggtattggctgagaggacggagttgctgaagagtttgccttccaaggtggactgtcccacttcaccagtaattttcttgtgaaaagtgttgactaaaaccaaaccaaacaaaaataagtttttaaagaattaaagtgagttttctttagaagtcttattgcaggctgtagactgatgactacagtctggaagtagtttgtagagaggtttcgttagtaacctgttttggctaatattttaatctatttatatacaggtggtggaggtttagtatgtataaaattgtattagatttgtttagaagttatattaaagtagaattatattaaggtttgaacgtaagagtatatttgggctgcgcctcgtggctcatgcctgtaatcccaacactttaggaggcctgtctctacaaaaaataaaataattagctgggcatggtggtgcacacctgtagtcccaactgcttgggaggctgaggtaggaggacctcctgagcctgggagattaaggctgcagtaagccgtgattgccactgcactccagcgtgggtgacagagcacagagcaagaccttgtctaaaaacaaaatacaatatttttttttttttttttttttgagacggagtctcgctgagtgcagtggcgcgatctcggctcactgcaagctccgcctcccgggttcaagccattctcctgcctcagcctccagattagctgggactacaggctgggacacgatgcccggctaatttttttgtattttttagtagagacggggcttccccgtgttagccaggatggtctcaatctcctgaccttgtgatccgcccgcctcagcctcccaaagtgctgagattacaggcgtgagccactgtgcctggcctaaaaacacaaatttttaaaaaagagtatatttagttatctggttataggttatagaagtataattattaattttgttagacattattttgtgtgtagaaaaagacaaggactagggctttttattttttaaggaatatagtgatttaggtaaagagaggttgggggcatttgggagttgtatgtcttattttgttttgtctctacagtattttcttggagaagtctttttttgttttgttttttgagacggagtgtcacagtggtaccatcttggctcactgctacccccaccttctgggttcaagcaattttctagcctcagcctcccaagtagctgggacttcaggcacatgtcaccatgcccagctaatttttgtgtttttggtagagatggggtttcaccatgttggccagactggtctcaaatttgtgacctcaaatgatccacctgcctcgggctcccagatagctgggattacaggcatgagccaccactcccagccttggagaattatatgttatagagtcaggagttttgtaaaattatgttggcaagtagaaatgaataaatataatttttttatgtttgttattttgtcctataaatttttttgttataaattaattgtctggttgtatttataagattaatgattgtttatatagataagaaggctttttttttttttttaaggaagattggtaattttgagttgtaggagtaaggaatgagtattgggcctagtgtgtatatttgtctatttattggaaaatacgttttggattgtatttattttttatttactgtgatttggttttttatatttaatataatattttaataagactactataaggatagtataggttgtgtataatagtatatatttaatagtattaaagtgagttgtagattggaaaatgtgataatgacttaataaagttagaatatcaatttgtacattttaagatgaattgtgtgtttttgtatttacatgtattagagtttttttatggaaagtaattttgtactatgcaagagacataggggaccctgtgctctattttgttttgttgttaaagtatcttttggagagctgtatgttgtcacagagtcaggagctttgtgaagttactttgttggcaagcagaaatgagtaaacatagcttttcatgtttgttattttgtcttacacaaagatgccatctccttacctaacctaagatgtgactctaatagataaaatgataaggaacataaactaagacaagagatctcttgggatgtcttcagatcatgagggctaaacatgactcagaccggaaggttagtgtttaccaagacccttcttacagctggggaaaatgaaggcaaattaagtttagcctaagctaaaacaggagcaacttggttatggtaaaaagagatattgccctatgggaagggctactacaagaattctttccatacttaaacttcagtagcaatctgacaagtttttaagtggagtctgaatgtaaaacattcagagagaacccttggtcagtagcaggatagaggttgcaataaacacagagaactagtggcatttcaaggaacagtgaggagacaggtctggttgaagcagaagctcttttgtgagatcagtagaaaatacgcctggagaaaaagcctgtttaaaactaaacatcttttccaagggtaaaacataaaatccttgaaattaggctttctaatgggcaaagagatgtcttcaaccattttatgatgagaaatacattggttcatcctcagaggtctctgaacaaaaaggggaacacatgtgaaggtagtcatgagggagcctctgtgaatcataaggagaactgattgcaaaaccagaagccagcagaaacaaaacaattcataaaattacagaggcggtattcggaagttctaaatacttttttttccatctcagaaatgcttggtatcctaataatattttctttgtgatacgttttctatactcttagtaattttccctggtcttgatctcatcattaaagaggatgaaaccaacaccaggaaatgtccataagcaggaaaccacatttttattccatcactcataaagcatcattcataataatcagtgtcagtttagctatagcaacagatgctaacatacacatagtaagagcctacaaaggctcttttaaatgtcagtttaatttaaaccttaacctcagattttttccacagatacagtgagaaaccacaaagatcctcctgtcctaatgctccctccatactctgcaataaaagttcttgttttggaaatagagaaacctgtctgaatcagcagtcttggcttgctgtgtcctccatgaccacaccacatgttccatacctttagccttcataggggctggaaaaaactctgtctcccttgtctacccattttcactgtggagttcggctgcacatttcaggtggaaaggaggtagtgtactaaaattgcaaagtatttcttttaattggcaatgaatttaaacaatattcattgattcttccactatgaacaagctagtgttccctgggggataaacagatgaataattggataagcctttactactcaggaagtgtatagtctagaggagtgcagtccaataggaatagaatataaaccacagacacaatgtaaatgttctaatggacacattaagtgaagtaaaaagaaacatgaaattaatttcaaacatatactttatttaactcaatgtacccccaacattatcattctaaattgtacttaatataaaattattaatgaaatattttatattctctttttttttccatactgtgtttaaaatctggtatgtattttacatctaaagtacatctcgattcagactagccacaattcaggtgctcaatagtcacatgtagctggtggctaccacatcagaccctataggtctcatatgtagcagagaaaaagacatacagaggctgaggcgagcggatcacttgagcacaggagttcaagaccagcctgggcgacacagtgagacctctgtctctacaaaaaataaaaaagtagctatgtggcctggtgcagtggttcatgcttgtaatcccagcactttgggaggctgaggcgggtggatcacatgagatcaagagttcaagaccagccttaccaacatggtgaaaccccatctctactaaaaaaatacaaaaattagctgggcgtggtggcaggcacttgtaatcccactactcaggaggctgaggcaggaggattgtttgaacccgtgagggggaggttacagtgagccgagaccacgccattgcactccagcctgggcaacaagagcaaagctccttctcaaaaaaaaaaaaaaaaaaaaaaaattagctatgcatgttggcatacatctgtagtcctagctactcaggaggctgaggtgggaggattgtttgagcgcaggagttcgaggctgcactgagctatgatcttgccactacactccagcctgagtgacacagcaagaccctgcctctaaaaaaaaaagaaaagaaaagaaaagaaaagaaaaagacttgttggagcctactcccactctgtggagtgtacttttgtttcaataaatctgtgattttctgtcaaaaaaaaaaaacaaagacaaatgacagcaatacaagctccatttggtttgggatgaggaggacattttccatggaagagatggcacttgaaattaatgttccaaataatggttgtgagttgagcaagcagagacagaaaaaatgaagagtgtagttcacagtgaaggacccgtagaagcaataacttaggggaggaaaatggcagggcgctgcagctctgttcaatacatggagcttctcattgtgcctcagataatgacagaacttcttaaggaggcctgcgaagtcctagctagtttattttctactttgctgttcaaacatattccctattttcaggctctctgcttgagccacagaagtctctgggccacctcctataaactactcatgtcttcccacccagggctttacatgtgcagggccctgcctggaacttatctggtttggcccatcattgtttctagcacctagcagagggctcagcacatattcagtcctcaaaaaatatattgaagtgaatggatgagtgatttgagaggcaggtagggaagaagatgatgagaaggcaggaaaggttgcttgagggcttgttgctgagggccttgggtgccacattaagggtttgcaatgaattcagtgagcaaaccaggtccatgcctctaatctacatcttaataggacttgcatattagatactgagctgcagctcagccacgtgtgggatgatttggagtgaaaggtaggcagtgaagcgccctgttaggagccctctgaaggagtccagaggagaatcaatcaggcctccttactgtagcagagcggtggatgtaggcattagttacacacttaaaataaaaattacaggaggctgttgaactaagctcctgcactaggccccaacagaccggactaaaaatcaaaatggagtcacctatgctacagttccacatcagcaaacccaaactaagttgttatctgaccttacgagaaatccaaagagagataacagccaatatcccacacagcccagtttcagtcttcagttggcatgataataaagccttctttgctttgatccttatgcaagaaaagtggcctaaagacacctaatgttaatcagttgtttttctattgttctgtctccctgttctgcctcacaaggaaagtagccttaaaatgacgaataactctttgttctttgtttctttcttcaggcctcctctgtctatataaagctaatcccctttgcttagctgattggaacacttattctattttatgggatgaactgttgcctgattctaaaattgcaataaagccaactgaaatctttaaactacatttgtggccaggcacgatgggtcacgcctgtaatccaacaactttgggaggccaagacaggcagatcacttgaggtcaggagttcgagaccagcctgaccaacatggtgaaactccgtctctactaaaaatacacatacaaaaaatagccaggcatggtggcacgtgcttttaatcccagctattcaggaggctgagggacaagccttgaacccaggaggcggaggttacagtgaactgagatcacaccgttgcactccaacctgggtgacagagcaagactctctctcaaaaaaaaaaaaaacactagattttttgaaattttgttttttgacacatattatggcaagacaacaaatcattttgtagaaattgtacactcttagaggtgaagcaaacttttgccattttatagacaaagaaagtgagactcgttttacagatgaggaaagtgacacccagagaagttcctttagtgaaacctcaaagacttcattactctgcacaaatggaatttgttttgaaatgaagcccagggggccgggcgcggtggctcatgcctgtaatcccaaaactctgggaggccgaggcgggtggatcacctgaagtcaggagttcaagaccagcctggccaacatggtgaaaccccgtctctgctaaaaatacaaaaactagctgggggtggtggctggcgcctgtaatcccagctactcgggaggctgacgcaggagaatagcttgaacccaggaggcagaggctgcagtgagccgagattgcgccactgcactccagcctgggtgacaaagtgagactgtctcaaaaaaaaagaaaatgaagcccaggaataggttatatgttctaggagaaggaattattttacaaacattagattaagtagatacagaaaagtgagagaaaaagatgaaaaggatccaaaatgcatttgaataggaaagaaatggctgtaaaaagcttttggcagtagacatgactgaccttaaaacacttaagctagtcacttactctatcaagaattctgacttgaacagtcacttaaatatttccgtcttttaaagaaggttggaagtactactgatacatcttcccaatgatcaaaatgtcagagttctcacttgacagaataaaaaaagacaaaagagggaaattaaatgacagcaccatgggcacggaaggtgattccctaaatcgtatatcatcttcataattggataactctcttgtttccagactgtgctttcagataaactccctgttttcatctgtgtgccataaaagacacgaagagggagagaatatttttaagttctgaagaattaagctcctgcaatctgtactttaggatctagataatgtaaaatggctcataatttgccagtttctaataagctgtacaaatctcactattacattgaaaacaatttgtatatttcaaaaaatgtcttaaatagttacaacttaccaagataacattgcaaaggagtattagccttaatatttcaagaggctttgctggtcaatgtccccaaatggtaaaaacttaaggttagaggcaaatgagagagttagatcagtgtttatttatttgccaaactactattaaaaagaaaaacaagcaaaaacacctaggctgtatgattgacattcatacagccttgattagatagaagtttcactttacaaacaggttttgacattgtgtagataaaactttgatatcaaacctttaaacctcaagatttgataatatttactttaataagaacttctatcttctacttaaatgtcaaaaagaacagaaatcagaccacttactaaaaggaagcagacttggaatccacattggttatctttcgtgagttaggaaaaagttaatagtataaggccaaactcaaggaagcctgaatattaagatgatttatggagacactgaagacataaatcagatataattatctgatttacaaaaactagtcatttcacctcctcaaatggcctcataattccttgatgacgcatggcagaaaagtgctcatgtcaaactaaaatgcagacaaatggaaagataaatggccacatcccagtaacaatttgacatcccattattcctcttgaggatttcacctgtgtacatccagaaggtgctaggtgaatgaaaggcattcggtttttaggattttagcaacacacatgagaaaaggttcacttttgcgcccactgacaatcagatgaagattcaggtcatgttgcaagtttttctgaacatgtggctgtgcagatagctcaggtcctgagcaaaaacaacagcaaagaaccctttggcagtgaagcctatcttggcctctgatcccttggtccttcctactcaccttcctgtctttatttttcttcagcacgtttcccatctaatatactgtgctgtattttttttcattgtgatgaaatatacatcacataaaatttaccactttagccatttttaagtgtgcagtttggtcacattagtacaatgacgttgttgagcaaccatcaccgctatccagtctccaaaactgttttcatcttcccaaactgaagctccatacccatgaaatagtaattcctcatcccccttcttccctagtccctggcaaggaccattctactttctgtctataaatgggactactctaagtacctcatgtaaattgaattatacagcatttgtccttttgtgaccaagtattttacttataaatttgtgtttattttatttcatttttgaaatggaggctcactttgttacccaggctggagtgcaatggcattatctcggctcactgcaaccctcgcctccagggttcaagtgattctcctggctcagcctcctgagtagctgggattacagatgtgcaccacccccccaaccagctaatttttgtatttttagtagagacggggtttcaccatgttgaccaggctggtctcgaactcctgatcctccccccttggcctcccaaagtgctgggaatacaggcgtgagctaccacgcccagccagtgaatctttattaatgtgttagataacaaagtctagaggaaagctaataattactgtaaatttctcagtaatgatgagcataaacgatatggtgccttgaacaactgtcatatgacatgaaaatatctatgatttttattagtgacaaaattgcaggtcctggtaaaacgattgtggtttttggctacatttataattggagagactagatttcagctagagatgagtgaaaatgaatatgtaattttttttttcatccaagttctgaatttcctccattgacattctcctgccccccaagggatgtctggatgctgggttaagagcccttggctgggtagctggatagtgcagttggggaagagtaagctattctgcatggttggagaatggagtccaatggatgaggaaggagaagcaggagaaagaagaagagacgagggggcagagagctgagccagggccccatctcagctatataaatataagggtaaggaattagggctctgttttgagagtcacaataaaccactgacatattttaagcacagggatatcaaggtcccacttgtattttagaaagcccttctaggaccaggtgtggtggctcaaacctgtaatcccagcactttgggacgccaaggcaggtggataacctgaggtcaggagttcgagacaagcctggccatcatggcgaaaccttgtctctactaaaaatacaaaaattagctgggcatggtggtgcgtgcctgtaatcccagctactgggggactgaggcaggaggatcgcttgaacctgggacccggaggttgcagtgagctgagatcgtgccactgcactctagcctagacaacagagtgagactccatctcagaaaaaaaaaaaaaaagccctatagatggcaacctggaggattctatggggaatagttgcaggaggccaggagcaggacagtagcaagaggccattaaaaagatggtagcagttctccaggtaaggttcaaggtggcctgagcttgggaaatggcaatgcagacagtcagtaaggacatgggagtgggaacccatggcaatttagaaggtagaattaaaagtggattctcttttactcctaggatgaagaatctgaatgtaagcatgagaacaaagaagttcacttcaattttctcaagttcctgctgtaacagatggtcagcatagaatgctcagcgaaaaaccacagtagttgccagagaagtcatgtgatgtaatgggaagagaatctcaaatgtcatcagtcgacgtgagtcttcttatctgtgtgaccatggggaagttacttatgcttcctcatgaccagtatcctcactggcaaagcaaggctaaggacaccagcattcctgagttgtgagtcacaagggagagatgatcattggacattttgtaaatttttcattttgtttatcatattattgtttttataggcgagatattgctgtgttggccgggctggagtgcagtggggcaattttagctcactgcagcatccaacttctggttcaagcaatcctctcacttcagccttccaagtagttaggactacaggcatatgctgctgtgctcagctaactttttcattttttgtagagacaggatctcactttggaaggcagctatgctcaccactacactgccaacaccaggatctcactttgttgcccaagctggtcttgaactcccggactcaagcaaccctcttgcctcagcctcctaaagtgctgagattacaggcgtgaaccacaccatgcctggcccattttgtcaattaagtgttttggaaatgctacttgttcattataatcaatcagtaaaggataattattgtagaaattagtatttactaagagttgaaaaagcattcagctcttttttttttggcagagctagctgaggttttattttggaccaaaaaaaaaaaaaaaaaaaaaacagttgaattgttttgtagctggaggcatgggcaagggggggtccccaagcagtaaacttccccgcacgtgggctgagggctaggactgagcctcaggtgggtctcctgttccctgtcctaccctgcacaggggcctccctcctgggctctggggcagccgcaagaggggcaggctgggaggggctgccatggctgttcactcgggcaggacatcagaggacttggacaccagcttcccattgcgggtctcgatcttcttcacaaccacagccctggtggagctgatgtggctgaaggagctagagttcaggccgtagctgaggctgggacttgtgaggcccccataggctgagcacagaccacctgcatagccgctggtggtcttcgtatggatactcacattctgtatcccagactccagccggcatttctagccctccagcagcttcctgtaggttgcgatctcaatgtccagggccagcttgacgttcatcagctcctggtacacacgcagctatcgcgccatgtcctgctaggcccgctgcagggcggcctccagctcagacagcttggcgttggcatccttaacagccagctccccatgctgctcggcatctgcgatggcagtctccagggaagccctctggcctttgagaccctcagtctcagcctggagccagctgatgttccggttcatcttggagatctctgtcttgtttttgagacagagtctcactctgtcgcccaggctggagtgcagtggcacgatctcggctcactgcaagctccgcctcccaggttcaagggattctcctgcctcagtctcctgagtagctgcaattacaggcgtgcaccaccaccccaggctaatttttgtatttttagtagagacagggtttcaccctgttggtcaggctggtcttgaacttctgacctcgtgatcagcctgcctcggcctcccaaagtgctgggattacaggcgtgagccactgcgcccggcctagatctcagtctttgtatgctgcaggtcatccccgtgcttcccagccagcatctgcagctcctcatatttgatctggtacatgctctcagcctcactccggctgcggttggtgatctcctcgtactgcgccttgacctcagtgatgatgccgtccatgtccggggagcggctgttgtccatggacagcatcacagacgtatccgagatctgggactgcagctcccgatctcttcatacagctgcctcaggaagttgatctcgtcagtcagcccttccaggtgagactccagctctaccttgttcatgtaagcttcatccacatccttcttgatgaggacagattcattctccatctctgtaagcttattgatctcatcctcaccagcccctgcatgttgccaagctctgcctccagcttcagcttctcctggccccgagtctccagctgccgcctaaggttgttgaagtagctctcgaacatgttgtccatgttgctccaagctgtcttctgctgctgcaggaggctccacttggtctctagcatcttgttctgctgctccaggaaccgtaccttgcctatgaaggaggcaaacttgttgctgagggtcttgatcttccccttcttttgggtgcgcaggcctggatgttgggatccacctccagattaagtgggctcagcaggctctggttgactgtgacggcagtgatgcctcccatgccgctggccccaccatagcctccacccaggctaccctggaagctgctgctgcccactcaggaggagcttgaggagctgatgcaggtactgggcccactcgtgtaggagcggctgctgaaggcccgggggccagagatggacaacttgtaggacttctgggtcaccctgatggacatggtggaggcaggagtggaggcaggcgggctgaaccaggcagagattccagaaggagtgaagaagctgcttcttgatagcattcagctcttatttatttatttatttatttatttatttatttgagatggagtctctctccgtcgcccaggctggagtgcagtggctcaatctcggctcactgcaacctctacctccttggttcatgtgattctcctgcctcagcctcctgagtagctgggattacaggcatgcactaccatgcccagctaatttttgtatttttagtagagcaggggtttcaccatgctggccagaatggtctcaatctcctgacctcgtgatccacctgcctcgacctgccaaagtgctgggattacaggtgtgagccacagcacccagctctcagctcttaatttaattgcatttaaagaaagcaatctgtgcaattcacagtagctggcagccaggataacccagggaaacctcatccttacaaaaaaattacaaaaaaaaaaaaaaaagccaggcatggcagctcatgcctatagttccagctactctggaggctgaggtgcaaggatcgcttgagccagtgaggtcgaggatgcagtgagctgtgattgtgccactgccttctagtctcggcagcagagctagaccttatctcaaacaaaacaaacaaaacaaaaaaaataatagctgagtaagtgtcatagatcacatggaacaaaagctggctctggaaacatatgcagaatttagctaagtgtggagtaagggtgaaattgtgagcaaaacaagcttcctgagagatcagaggtggggagttatgccaagaagtgaagggagtgaggtaaggtatgctgatgtgtgcagaacagggaggactttgaaaactatgcagagtggttggctgacatacagtaaaactcataacaagtatgctcattagcataattattaaactctggcttagtaaaccacttaaaaaaaaagatttccaatgtggaaatactcaatgtttggatatgcctgttcattctagtttaggcatttccttctgacaggtttttagagcctctggtagcttttccaatccctgtgactttttttttttttttgccctgagtttggaggagtcggataatgaaatttaaactaaagcatgttagcatcacctatactcaagaaggtccaaatacctcaattcttcacaaaataaaatgcttttttaattcaaaaaaagaaagtaagtcaaaaagagagagagaaaaaaaacacacagcagataactgagaaaataagagagtttattgccactaaaaaaggaacctggcttctaacatcatatttgccatttctctatgtgactctagggaagtacttttctctctcaatgccttcttccctcaggaaaaccttattactatgagaaagatgttaatttgtctaaagtgctgtaattttttcatggggatgttaaggagggaaaggcagggagaaagaagatggggagagatgagttaagagatgagttaaggtgaaagatggtggtggcaggcggggcgcaatggctcacgcctgtaatcccagcactttgggaggccgagacgggcagatcacgaggtcagaagattaagaccatcctggctaacatggtgaaaccccaactctactaaaaattcaaaaaaattagccaggcgtgtggcgggcgcctgtagtcctagctactcgggaggctgtggcaggagaatggcatgaacccgggaggcggaggttgcagtgagccgagatcgcgccactgcactccagcctgggcaacagcgcaagactctgtctcaaaaaaaaaaaaaaaaagaaagaaagatggtggtggcttgcaccaagggataggccctggagataaagagaaaggagttaaaaataaatgtttggtttttttttttttttttggagatggagtctcgctctgttgcccaggctggagtgcaatggcatgatctcggctcactacaacctccacctcctgggttcaagcaattctcctgcctcagcctcccgagtagctgggattacaggcatgcgccaccacacccggctaatttttgtatttttagtagagaggggggtttcaccatcttggctaggctggtcttgaactcctgacctcgggtgatctacccgcctcggcctcccaaagtggtaggattacaggcgtgagccaccgcgcctggccaagaaatgtattttggaagtaaacacagtagaatatgctgatgaattgcactgacgttgggagaaaagaaagagaaataatttctagatttctcactctcacaaatgagttatgtagtagtatcatttactgaaatagagaaaaataggaagaaaaatcaagagttgggttttgaacaggactagctcaagatgtgtgtgagacatttcaatgggaatgtttagtaaacaattgggaacagaggtctggcattcaggcaactaagtttctgaataacagattacatttaaagcacaggaatgaatgaacctgtgtgtggaggaggagggagagtggatgggaaagtgagaaagatggagaactacagtaagagggaaagggcaaaaagatgttcagaggctggtgagccaaggactgagtttgagccatccccacattattggtaagacagagcaggaaggcctgaaaggaaactaagaaatcacccacaagtaggaggagaggctggagtgctgggccacagaagccacaactgagtattccaaggaggagcggtccacaggaaggaccaccttttcttctcttctcttttctcttttcttctcttctcttctcttctcttctcttctcttctcttctcttctcttctcttcccttctcttctcttttctttttgagacagggtcttactctgttgtccaggctggagtgtagtggtgtgatcatggctcactgcaacctcaaccttctgggctcaagcgatcttcccacctcagcctcccgagtaactgggaatacaggcatgtgccaccagcctggctattttttttattattatttcctggagacctgagggtcttgctgtgttgcccaggctggtcttgaactcctgggctcaagcaatcctcccatctttacctcccaaagcactgggattattggcatgagccaccactgctctggtaaactgaaagggaaagttaagatatggatggataagtgtcaagaaggcaaaagaaatacgaaacaaaagagcttgatagtaaagaaaacagaaggatggaatgccctccaagtttttgaggccttaatgagaaatattttagtgaatggggaataataaagagattctaaagatcattcagagtgttgatgagttacatggattatgattttgaatttcaaatggactttaagtctttatgtaagacagattagaaaacaaaatttcacattaaattgattaaattaggtcaaaactcatcaataactaattatacattggacataagtatttccatatctttttgtccctcagtgccttgtgcatatgtaactaaaaaagcagagtaatttggtgtcatttgatttaatgagatcctgcgcaaatgaaatacctttttaacactgaagttagaccattgcagtgctccagggacaactatctatagaagataaattaattatgttcactacttcctaagcctatagaaacaactaaataactaaatgagagaatcaacctgttgatgatgtgcaggtcttttgagaaatgacctttaatcaataaaatcccagagcacagaggtttcatagcagcttgtcttcagaccgactcatcagtaaaatcacaacttacaccacaacaaaacgttcagaaaagtaagctatagaggtaggtcataattttgaggtctgtcttgataatatctaacatattttgagtgcttagtgcgtaccaggcattggggctaaatactttacatgcgttaggtcatttaatcctcataacagttctttgaggtattattgttattattattattattttattattttgagacagagtctcactctgtcgcccaggctggagtgtagtggggtgatcttggctcactgcaacctccacctcccgggttcaagcaattctcctgcctcagcctccccactagctgagactacaggtgtgcgctatcatgcctggctaatttttatgtttttagtcgagaaagggtttcaccatgttgaccaggctgatctcgaaattctaacctcaagtgatccacccacttcagcctcccaaagtgtcaggattacaggcatgagccaccgtgcccagcctgaggtattattattaaatccattttacagataagccttagaaagttaaggcttagaggccaggcacagtggctcacgcctataatcccagcactttgggaggctgaggtgggcggatcacgaggtcaggagatcgagtccatcctggctaacacggtgacacccatctctactaaaaataccgaaaattagcggggcgtggtggcaggcgcctgtaatcccagctactcaggaggctgaggcaggagaatggcgtgaacctgggaggcggagcttgcagtgagccaagatggcgccactgcactccagcctgggtgacagagcaagactctgtctcaaaaagaaaaaagaaaaaaaaagatagttaaggcttagaatattaaatgccttgcccgatgttaccatgctcggaaacaatttagttaagaggccaacactgtttgtctgatctcgtattaggagtccttaatgttcttctcctgtaaatgttcagatttaaaaaaaagatcatagataaattcagtacagttggatacagtttgaaaaattattttatattttagtgaaatagaaagttttagccaggtgtagtagtgctgggtgcctgttgtcctagctactcgagaggctgaggtgggaccatgacttgagccaaggaggttgaggctgcagtgagctatgatccagccactggactccagcctgagcgacacagcacgattctgtctccaagaaaaaaaaaaagaaaagaaaagaaaagaaagaaactttgacacagtttctctttgccactcttcatattgagaggtgaagtttattttccttccccttgaatctgggctggcccaatgacgttttgttttgttttgtttttgattaataaaatgcagcagaagtcacactatatgacacccaggactcggccttatgagatcgtcagcttccacaggctctcttgaagcactccctgttagaagccggcagccatctaagtctatcttaagaacatgttactgtgaggatgcccaagctatgtggagagagaaagaggccaatagagatgcactgacaccaaacaagaagctttctcggactttctggctcagctcaaccaccagctgaatgcagccaaggaaagactcagccaacgtcacagggagcagaaccctccaaatgagtgacactgaattcctaatccacagaatcatgagtaaataaatgacagtagcttttgctcatcaaattctgggtagtttgctttgcaataatagtaacataaatttagtagagttggacacaatttgaaagaaatacaggctgggtgcggatgctcacgcctgcaatcccagcactttgggaggctgaggtgggaggatcactcgaggtcaggagtttgagaccagcaaggccaacaaggtgaaaccacgtctctactaaagatataaaagttagccgggtgtggtggcagactgaggcaggagaattgcttgaatctgggaggcggaggttgcagtgagtggagattgcaccactgcattccagcctgggcaatagggaggatcacttgagtcttgaagttcaaggttaaagtgagcaatcatcgcaccactactctccagtctgggggacagagcaagatcctgtctcagagagagagagagagaaagagaaagaaaaggaaagaacaaagagaaaaaaaaacaaggcagtttacaatgaaaaacacataagaggagagtgaaaataaaaacacaagattaaaaccaagttcagtgactaagaagttatttctaaagatttgtccaatttgttcactgaaatttatatttaaatttacctttgagtttcctggcaactgaggcaaacctaagagattatatcatgctaaatgtgatttccttcagaaaagaaaaatctttaacctactactaaattattaagagcactttactacatggatccctttacagggaacagtgaatgatagagaagacaatgacttcagaagagatgatatttaaccaggcacggttgctcacacctgcaatcccaaaacactttgggaggccaagacgggtggctcacctgaggtcaggagtttgagaccagcctggtcaacatggtgaaacccccatctccactaaaaatacaaaaattagctgggcatggtggctggtgcttgtaggcccacctactctggaggctgaggcacaagaatcacttgaaccccagaggcggaggttgcagtgaaccaaaatcgcgcccactgcactccagccagcctgggcaacagagtgatacttcatctcaaaaaaaaaaaaaaaaaaaaaaagggaaagaaaacccggtttctactaaaaatacaaaaattagcccagcgtggtggtgtgtgtttatagtcccagctacttgggtggctgaggcaaaagaatcacttgaacccaggaagcagagattgcagtgagccatgatcgcaccactgcacccaagtctgggtgacagagcgagaccctgtctcaaaaaaaaaaaaaaaatgttatttacaatacagatgtgtctcagatgatggaatttaaaaaaatttattcaatgtattttgctgttttttcagagatggggttttgttctgttgcccaggctagagtacagtggtgtgactatggctcactgcagcctccacctcctggactcaagtgatcctcccacctcagcctcccaaagtgctggaattacagggatgagccatcatgtctagcacatgatggaactttaacataaaccaaacagaataaaatgcaaagaactttcaatttctatatgagttttcagattaactcccctctttctcctccatagaccttaggcatttcaccatcttttggctttctgtttcaacatatacttattgataaccccccaggggccaggtcctgagggtttaattgtatgtaaaagagaaggaaggtccttgtcctcatagagctcatagtccaggaggacattaattaatgctgaaggcattcattaaaaagctttaccaatatgcaattgcaaactgacaggtgccataaaaaatagcacaaggccgggcgcggtggctcaaagtgcctgtaatctcagcactttgggaggccgaggtgggtggatcacctgaggtcaagagttcgagacctgcctggccaacatggtgaaaccccatctctactaaaaatacaaaaattagctgggcatgatggtgcatgcctgtaatgccagctactcaggaggctgaggcagaagaattgcttgaacccgggaggcggaggttgcagtgagccaagatcgcaacactgcactccagcctgagcaacagagtgagactccgtttcaaaaaaaaagaaaaaacacacaaggagctataatgagcatgttatggagggacacaatccaagtttctggggaagggagttggggagtgaaggaagcttgtgatttcttttttcctttagagacagggtctcactctatctcccaggctggagtacagtggtggcatcatggcttactgcaacctccaccttctgggttcaagtgatcctggcacctcagcctcctgagtagctgggactacaggcactcaccaccacacctggctaattttttaatttttttgtagagatggggttttgccatgttccccagctggtctcgaatccgctcgcctcagcctcccaaagtgctgggattacagatgttagccactgagctcgacctggaagcttatgatttcttattttctctttcccaccttaaaacctgacacatcaaagtgctcaattcatgttggctgttgatgatgagaatacaaagaaataaaagggggggggggcggaatttcaacactaattctgaaataaattctgaatctgttatttcaaaggatattaactttagaaatgaagacacattagaaatttgcattgctctgagttttgtaaaagaatgaaatgtataatgcaagacataactgccaaggtactagatgaaaaaaaaattatacattctgaaattccatctgatagagatcagttctgaagggttaatctcaattgcctgatttaatgtgtttgctttgcaccagatgaataataattagcaatggcttcaccaacttattagtgacaacgtagagaaggtgtgggcccttttacgtaaaagctgactaatagacaaataaattagatatgactgttttgccaaagctgataactaaggccctgtatacaatgagtgccaagtcctggttgtttctacgtaacatttaatctttgaaggcaagtggttgaaggagaaagcaattatattgacgttcgttgtagaaattcatttacagattgttactacaattgtccctcagtctctgcgggggattgattccaggacccctgcagatcctaaaatccatagatgctcaaccccctgatataaaatggcatcgcatttgcatatagccaatgcataccctccctaacatttaaaatgatctctagattgcttataatagcaaatacaacataaatgctatgtaaatagttgttatactgtattgcttagggaagaatgacaagaagaaaggtatgtacgtgttcagtacagatgaaaccatcctctttttttcccaaatatttgacctgcagttggttgaatccacagatgtggaacccgtgaatacctggaagcagttaaaatcactccaagattttctttaaattcttctcttcatcaatactctctctattccaccaagtaatgatatcataattacacatggtagctcttccccaagacccttgattaaattgtttttattgattcatcaagcatatattattgagcgtctactacacaccaggcacacagacagaactgtgaacaaggcagacaaggtcctgcacccagcacgtgtatattctaggtttcagagaagctatgtgaggctgtgaagaggattcttttttaatgtctttatttttatactacccctccacagccttaccccaatcttttaaaccacaccggaagctatgtactcatcgtttttttcctgtaattttttttacagtacaacctaaataaatactggcccagaaagattcagagttcaaagaaaattcagctgctttcggaaagatcattctatgggaaagatcacatttctgagtaataaacattataaatacatattccgatttatttttaattctcaaactattaactttcatttttcccctctggcatattttaatttttgtcctacagggacttgagtctaaatatgttttaacaatttgggggacttttcttttttcaccttgctatttctagagactaaaatctttgagctaccaaggtctttcaaactggctgatgtcactctaacaaactcagagatagcaagatgttccttaagccactgggttagaacgagaatcctttgttttctatgggcacaatcctaggaatgtttcttctcttttttttgagacagagtctctctctgtcacccagcctggcgtgaagtggtgccctctcagctcactgcaacctccaccccccgggttcaagtgatcctcctgcctcagcctcctgagtagctgggattacaggtgcacgccaccacaccctgctaatttttgtatttttagtagagacaagatttcaccgtgttggccaggctggtctcaaactcctgacctcaggtgatccacccgcctcagccttccaaagtgctaggattacaggcgtttgctaccgtgcccggcaagcctaggaatatttcacttcatgcttttctcttttgccttgctgtgagcttatcctccagagacaacagagagagagaaagagagagagacaggagagagaaagtggaagaaccacatgaccagtcatttcccgaagcaaatggcgttttgggtgaatgccctgacctaggagggaaaaagaggccaaggttaccctaatgttacagaagtagctaagtgaattcttctccgaaaaacgtcacagcaggctctagaaagcaattagagtaatattttggcacctcgaactaccaaatagaagattcctctactgctctagttacatctttgattttcatttccctttgttgtaaatacttacaatgtcatttcagaatgctgcagagaaatagatgtgagagtaaacaaactataataataatcctttctccacatgccatggcagctgcaggaggaggccaacgcagcaccgaacttgccttactgtctgcttttcctgtcctcctcctcctgcacctccttcacctcctccacctccttctcctccactttcccacatggtcttttataaatttgccagcatcactgtgcagtttgccagagaaacctggccacttgctgggtaagcctgctcttagaccaaggaccagggtaggtcactgctgctgtcctcatttctgggccagaaggattcactgagagtgaggtccagaaccacctgctttcccattacagaggatgtggatctctatagagacactgcgtatcccttcagttaaagctcttcgaagactctttttaccctgcgagctgaactttcttgagccccatagaatggataaaaatcttcatccccaggttggtgaggagccaatgatttcacgctcaaacaagctgacaagctaggaatcctagctttccttagcaggcaggaaacagcatcccactcataagtcaggagtcttttctgccaatgttaggaatgttgatatttacctttatttttggacttatttctaaaaaaaattaactagtatgtaaaaaaaaatcacactttaaaaatatgcttctacaatatttgctctagcgaactatctttagcttgacctaaattactaattaaacttttctattgatccaattcccattactgttcctgcctttatgctttcatattcggaaatctccaacatgcattttgatggctccaccccccacgttcctcactcctgccccctcattttggttttgctttaccttgttaagcacttacagatcataaaatatgggtgagctcagaatatctcttactccagtgttacatatggcacccgcatttcagcaccagccctttaaaaaatggtgcagaatttcaaggaactcagctacactttccattcaaaatccctcccaagcactgtagctaagagcctatctcaggattttcttgagagctgctggggaggcaaaatatctatctaacgaaaatggctcatcatccacattctgcagtactgagactaattccccagcactgccaaacctagactgctgaactccctcatccaaactctctaagacttagtggtcaaagtgccaaaggcatccgtcttactcacactctgtggctcctaagaccatgctgaaaagtgaggataagtaataattgaaagacatttttaggattctagttgggaggatacataatgcagatactatatagtttttgtttgtttgtttgttttttgagatgctgtctcactgtgttatccagcctggagtacaatggcgtgatcttggctcactgccacctccgcctcccaggttcaagtgactctcctgcctaggcctcctgagaagctgggattacaggtgcccaccaccactcccagctaatttttgtatttttagtagagacgggatttcaccatgttggccaggctggcctcaaactcctgacctcaggtgatctgcctgccttggcctcccaaaatgctgggattaaaggtgtgagccactgtgcccagcctactatatattactgaagttagtaattcatattaatgcaaaataaaaggagattagtgaatcactgctacgtctgtcttgtttggcctgacaagaaaagtatcatagaagagaaggtgtgttatgggcattggatcagcaaataagctgaggtcaagcttccctaagtacccaccagctctgaaggggaagtgacagcttgtctttgagccagatttaggttacatttcagtcttaatttatatctaatccatatctaaacatagagagaaataaaatgcattagatttctgagccaccaaagcctgtttaaaggaagacggaggaggaaggagaagagggcaatgacttaggggcaagtaatagaaggatttgttcttttattttatgcattcttttattcaacaaatatgttttgacaagtaggggatacagtgaacaaggtaactggttttctgtccttaaagaccttccagccagttgtggtggctcatgcttgtaatcccagcactttgggaggccaaggcttgtggatcacctgaggtcaggagttggaaaccagcctggccaacatggtgaaaccctgtctctactaaaaaaaaaaatacaaaaaaattagctgtgcatggtggtgcacacctgtaatccctgctactcaggaggctgaggcaggagaattgcttgaacctaggagccagaggttgcagtgagatgagatggtgccactgcactccagcctgggtgacagagtgagactgtatgaaaaaacaacaaaacaaaaaaccttcctgccctgtgggagctacagaggaataagcagtactaatgtaacaatgcagtgtcactgggaccatgtgctgtgttgtgggcgcaggctcaagaggaactcaaacagcttagattttagccattccgaagaaagcacagtagcagccactggagtctccgccgtgttccgggaagcatgatcaaacatatcttgaaaaaatctaaagcagacttcagatttgttagaaagcattcctaccgctctcagtagtgacttggagaatctacctcttcatagctaaggctataacaacatcaacaacaacaacaacaaaacacctctttgggttgtcttcacaagtagtttccaattcagtagagccaatcctgcaacagtattggcatcatcgcagtgcactccagtgacgcaaatggaaagactgctgctggtaaacgaactacctgaatttgaattctggctatacctcttcctaggtctacgatttttaacaaatcagttaacctctgaccctcagtttccttggctataaaatgggcataatgaaggattgtgagagttacctgagtaaagtgctttgaacggtgctgctcaataatgttatccctctgagaagacatcgaaagtttcccataagaaaagggcctttgttattccaatttggatactttaagcaggcaaaatagaacagtaaaaggaaaacaaatgtaaagggatgctgtttatgaaatagttgtgaagaataagcacttcagaggagcttaatttaacttctcagctctgctagagtaaacattgtaaccagactaaaaacctttcctttgttcctgcagttattagagaaaggaggaggccagagaagtcatatcatttcacttctctgaacttcaccctggattatttaatgttgacaggcattcgggatgtatagagattaaggacacagactctggagcctggtgctgggatccaaaccctgatcctgtcactaactagctatgtgacttggggcaagttcttcaacttctgtacacctcagtttcttcatctatgaaatcacaataataaaagtacctatctcaggtatttttatatatgataatttttttttttccttgagatggagtctcactctgtcatcccagctggagtgcagtggcgagacctcagctcactacaacctccgcctccctggttcaagcgattctcctgcttcagcctcctgagtagctgggattatgggcgcctgccatcacacctggttcatttttgtatttttagtagagacagggtttcaccacgttggccaggttggtctcgaactcctgactttaagtgatctgcctgcctaaccctcccaaagttctggcattacaggcgtgagccaacgcgcccagcctgtgtatgatgatttaaatgtgtaatgtacttaaagctcttagaaccatgcccagcaatattaatgccatttaagtcatagttattagaaaagctactgttattaaagaataatgcaaggaattgttcaaatgcatataatcataaaatagagagtcaaggctgggcacagtgggtggctcacacctgaaatgtcaacactttgggacgctcccttgagcccagaaactcgagaccagccagggcaacatagtgagaccttgtctctgcaaacaaccaaccaaccaaacaaacaaacaaaaataacaacaacaaaaatacagagtcaaaatggaacggtcttgtcaaagttggtagtcactatgccgttagtttcatgaagataaaacatggttattttgttcctactctatttgttgaaaaatgaatgaatgaggcatgaaagacttgactagtttgatgttgagaacttagcaaaaaggaaagcacacgagatctggaagtgaaaacccaaaacatgagtcctggcttaacctcattctaatttgacaggtgatttaccacaggtactcagtttcctcatctttgaaagagggaagtcagagggagaatttctgaggttcattccacatccaaaattctgcagcgttagatagcctttcgaattttacaaaaggtaatgtaatcatggctatggaagtttttttcacataccttgtgtatttccaaaaaggattatcgagttggagacaatgtcatttgtttgcgttttctaaatcattatgtaagaatctgagccacaaacagaacaaatctttaaatccatgaaaatggattacctttagctggactgacaacttttaaaactcttggattgggagaataaaactgataaggacatttttccattcatcttaaatgaatttttggagactcttaagagtaaaatataatccatatacatctaatgctaatttatcatgaacacttaaagaatgaaagtagaactcttatccagtttagttcagcaattctctgctaaatgaaattaagctgctttagttgagcttttaaaatatgaggatgagaagcataaatccaaaggattttgtagaactagcatccggactgtctttcttcagattatgttcctagaatctgggttccccagggcagcctctcattactgtcagtattaaggactagaaaggagctggaagaggcttggccgcttttataggtttttggtagtggcataaagatttcacttggttgggggaggggggtagggggacagaagagtctgttgtggaaactaaaagaaaagaaggggagagtggtctgaaatcaaaaagtctggattacgtatacaagctttgagttgaacaaggtttaaattttagctctgctactttttagttatgtgaccttgggcgaatggtttaatctctctaagtcacactttgcacatttaataatgtttcttaccttatagggttactgtgaatattaaatgagctaatacatgtaaagcattcctacccagaacatagtcagctctaataaatagtgactgacagacagctacaagggcagataacctatattctccttcagtttcttatgctccctctggaatgtctcagaagcataggaagcactgtttaagcctcctgcaatcaaaaatcattctttttaattagccctaatagaccctatggtttttttttttttttttccaaaatctattcatagtttaatgtgggctatggacaaaggttcactttgtaagactgtctagctaggttaaaaataaaatatgcagaaatgtgtggaacttcaacaatagaatataagaaaatgaattattctgaactgcaaacaaaggcattgtagtatatgaatgtgtatgtgaagtaaaagtttggaaagtataaacatcagtatggtaacagttactacatctgggaaagggagaaagattggagaggaggtgggatataccttattattgttttaatgttttatagatgtatttacatattgtttaactaaaaacaaacaaacaaaaaaagcaaagtcatgtacaagcagaaataaacatttagaatacagaatttgtggaataaaccaaagtagacaaaaatcaaagaatttatccctggggcattcaatgacttgatacaaggtcaccttctacttagttaactgtccttgaggagtaaggagagcgcaggggcaggagagatgtctgatcctgtctccagcaactgatagacccaggttagaagttagatgaagctgcctgccagttatcttggtagaaacttctttctgcatgtactcagataagacatcagtaccctgggtggttctctgcaaaattcaaggtctgcagagtcaccaactgaagtctattggtaaacttgcttttaagcaaaacaaaaccaaatggcaaattagtatttctattagtacattttgataacaaagaaaataaaagacaatttaaaatttatgtaacttaaatctacattgcttaagaacatctgactgaggagttttagaatatccccaataccatgaaataaatacagtaattaaaaggcaatagagtttaaatactggataatgggctatggcatttttaaaattagcaaaacatttgtttattattgaaaattagggctgggcctggtggtggacatctgtaatcccagcaatttgggaggctgaggcaggaggaccacttgagcccaaaaggtcaagaccaccctgggcaatatagcaagaccccgtctctaaaaaaaagaaaaagaaagaaagaaaattaattttcataaagggctcttcccttggaaagaaatattttagctacagagaaaaactaagaagccttgtggagctctgtgaagttgcactgacttgctttcacttagcttgcagctcactagtgagatttcacatggtactcccactccaagagcaggggccaggacaggttggtttcattttggtttgaatgcatatgctttggcccacagacttggagaaagattttgctttactgatgagaactcagtcaagggtgcttgggagccttcgctggccctctagctgggcctgacatgttgcctgcatttctagccttgccttcccagcttgcccatttggtgcagggagatagtccagcccaccctgaaattcactgtgttctgcggatgagttaactgaagggctgtgtttcaggagtggcacagaaaggacctgaatgaaaggaaggaggaatgaatggagagaaccattttggtggaattgccctagggtattaaataggatggggcaactggggactggaggatgttccttctcttacgttgcttaggaaacactgtccttaagagtgtcagtgtcattcctttaacaatcattcatttcttacctcccgcttgtgtataaatttgcagatttacacagaccaccagtgtggccatcccagtgaactgagtttattgtgaaatatacatgcaaaaaaatccttttttctcacctacaaccaatgcaacattattcatactttgagttgaagaataaggagtttaagaaataaatgcatacagcaacataaccctgaattatcactcaaatacagacctcccactgctctctcccaaaaaaaaaaaaaaaaaaaaaaaaaaaaaggcagttattctaagcaaaagcaaaaattgaggcaacttaaaatagacaattttaaatgctggattccatcatttctgtaaaaggtcattctactcctttgctatttataccacagatagagacacagcaaattattggctgaatggatttgggaaaccagaagctgctgcttctgacgaacgaagatgataatgcatcacttgagactgagtggatgaaaggtgtagaaaagttgaacccttcaaagatgagaggaagctgctaaattagcccctgactaaattactagccataattgtactcaagccagttctctttgcgactgccttgtaatctttgttgtggcttgagagagaaaaatccccattcccagctcaaacccgtttaaggcatctcagcccaaccccctcctcccaatgcaactcttcatagccccctgcccctcctccaacaaattctaatcaagtcaggtatagttctcagctttaccactgccatcagaagcacggcttacattaagggtttagcaacaaaacctcaggcttacttcaggcaaacattcaaaagcatttaagagaagcacagaaaacaaaagaaataagcaaaacctgtccttacccgcttcttaaaaaattggaaggctgagcatttcttgactgggaatccattcatgtctttgtttaccattttccaccgtggggaattcacagttatagatccaggttggcacccgcctggttagtgcatatctgtttccccggtttacctcctgcagacagttaatgaagactgagcgggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggtgatgcgctcctggaggcggcttgagagaggagagttgtttttgattgtgcaagttccagtgggagctgtagttaagcagctgagagaaggagtaagaaagagcagaagccagagggagggagggagaacagcgccagaaaggcagagggagcgagaaggcgaggctggaagaagcaacggttcatgaatatct

SEQ ID NO: 2322 - DNA, 44476 bp, Homo sapiens
tatacattctctctgagctggcactcaagcaccgtgggaccttggctggcttctggggagcaagagatccatttatgaatacttgatttctgactgctgggtgagctggagtgtggtttataaataccttgctatctttaaggtgggctttgccaaaagaatagggtgacagagatgaatttcagtcatgcaacgaaccctcgacacttggaaggtgacagagggtagatggtgacagacaccactttgtgccgttgaactgtgttggtaccgggcgtggcccaaacacctggaggggccccacaggtgggtcaggcttctgggctctggtcactgctctgtttggtttcaaatcatgtgactttggccttcttaaaaaaaaatctaaagaggctgggcatggtggctcatgcctgtaatccctgtactttgggaggccgaggtgggtggattgcttgagttgaggagtttgagaccagcctgaacaacatggcaagaccccatttctaccaaaaatcaaaaaaatagccaggcatggtggtgcgtgcctgtggtcccagctacttgggaggctgacatgggagaattgcttgagcccgggatgggattggggtggaggttgcaatgagccaagatcatgccactgtactccagcctggatgacagagtgagaccctgtctcaaaaaaaaaaaaaaaaaaacctaaacaactaaggccatggtgaagtaaacctatattcaaaacaagagtcacaaagtagaactaaatgtaaatatataccaagagttgccggtagtcaggagtctcgtgcagttgaccttgggctgctcagagtccctgctcaaggtcactctaattttgtcccaaatttgaacaaaccacttttattatttcaccataaatctcatacttttggccaaaggcttcttcggaacttattgacagcgatgacaaagcccctgaaggttttcttctttacgagggagtaactcttccatcagcacagccttccctgcttgtcagagggaggtctctctttcttgtgcttcctagacttgcctggtcatgccttttcttattttaaggctaatctcaaaagaaaaaatagtgtgagcaccacttgactgcctgaaatttcatgactctattttagagagtcattgcctcatcgccttgccgtaacccatgacaatgctcctcatttgcggtgattaagttgaaatttgcaggtaaaactttagcatgttcctcaaacatcagagctgaccctgggtctggtctcagccacagcagaaaatgtatttaagagctcccttgagcaggcagtgggaggggttgcagcaatgagcttagaagcagctgccacaggctgtctgagcactgtgagctgctgagctggtggcctcagccgaggtcgcgtggctccttcctttcttgcctagaccttggctattttatcaacagaaacggcagggaccagtgagcagagagctcagcaagctcatggcgcaagagtcgtggagctgtgacctccaccagggctgagaacggccccttataccgccagctcttggctgcctggaatctctcgggaacctccacggggccctgcacagcacaggccactgtggatacttctgggatttgtggctgaggagagaaacttaggaaagacaaatgtcacggccctttcacagcagacactggttgggcctgtgctgtggcctggaggcccagctttaaacggtctctcctttctcacatttttttatcttaggggtggggagacttttcacataacagcctttgaggttgtggggtgctatggtttggatgtttgtccccccaaacctcatggtgcaatcagatcccccgtgttggaggtggggcccagcgggaggagtctgggttatgggggcggatccctcatgaatggcttggtgccgttctggaggtggtgagacggttcttcctctgttagtctggtgagagctgcttgttaggaggagcctggcgtccctcccacgcttcctcttctgccctgtggtggctgcacgccggctcccttcacttcctaccaggagtggaagcagcctgaggccctcgctggaagcatatgctagcgccgtgctttctgtaccgcctgcagaaccatgagccaagtaaacccctttttttaatgaattgtccagcctcaggcattccttcacagcgacacaaataggctaagacactgggagaacacagagaataaattttgcgatatttggggagatgatgctgcctttactgttattataaataaagtttcggtgccgccaaagaaacagcccttgaatatcaattttttttttcttctcggcaagaccatttactgctatagaagggtgtgccctcacagatggagcaatggcgcacacctggacaagggaggggacggggttcttattcctgacgcacgtggcccctgctgctgtatcattcccctattggctagggttagaccgcacaggctaaactaattctgattggctgatttaaagagagtgatggggtgagtggtttggtgggaaaaatggttatggcagagcaggaaaacggaatgagtcagggtggggcaggaaatcggaatgagtcagggtggagcaggtgatcggaatgagtcagggtggagcaggtgatcggaatgagtcagggtggagcaggtgatcaaaaaaggttgctttatgaggaagttaagttaaaagtagaaggcaaataattgaacatactgacatactgattctttgaagagaaatttaggacttatatctaacactgtttttttcataataaagtgagaggggctgtggtttcaaacagcataggcctggggtcggactcatctgcattcacaacccgtccccctccctgttcattagctgaatgacattgggtgagagcctccgtcccgtctctgagttccttagcaatgggtataataatgtgtgactccaaggcttggagtacgggagatacgggaacagatatggagctatagagttcatgcttagagacatcagttcccttccttctgctcctggctcatggtacacacatgttttgaaaaccatgccaggcatctgacctcaatgcacgcaagcatttagctgctgggtcattggcagaaaagcctcaagcaggggttcagggaaggctttaattaagcttggcctgtgggggctgctgcctgggctggatctgctgtgaaacaagaggagcttgatgttctaggagaaatgcttggggcccaggaccatctgctggagggaaaagaatgagtattcccagagaaacagaccagtgctggggctgttccctggaattcaggttaagtgtcctgggcttgtgaactgggcacaaaagatgctgcaagtctttgctttgggaagctgtcaagggtcattgcccctctcagcctaaacctcttagcacctctccgacgatgcttttcactttggtggtgactgataactcttcttggttgttgagaagtttggatgaaaagctctaggtgtgtattatagtttcatgttgctgttattacaggtccttagtgtcttacagaatgcagatttctgatctcatggtctgtttggcagacctccaggtaggctcattggatccctctgctctgggtttcatgaggctgaaatcaaaatccaggtgggctgggttccccctcagaggctctgggagcatcctcttctgccttgttggggttgtgggcagaatccagctccttcagctggtgggactgagcaggggctgccctgacctcccaaggcctctctcaagtctctgcccatgagccctgaacttcagagctcagccatgatgtggcttctttcttttgaagcctgattcaaagtcacacttggattctttctgacttccttttctgctccacagttctgtttgcagccagagaaagtcgcctgcttttaaggccttgtgtgatgatgctgggcccacccagatcgtccagaattacccaggcccgtcttagggtctgtggcttcgttatgtctgcaaattctgctttgcatatatggtgagaaatacataggtctcaggattagagagcatgcattctggagcacaccctgctcacccagggtggaagtgtgtactccaaggccccgcaggcagttctttgtaattagcacatcctgctcaccacagggcggaagtgtttacgccaaggccctgcaggcaggtcatttgtaattagcacattcctagtcatgagtggatgctttaggaattagtggctgatgagatatacggactaatttcaaggcgccacctgcagcagaacctatgttacagcatgaagaacccctgatattctttttttatatataatttttattttacaaatgtattgggtatatgtgaaagtgtgttatgtgtatatgatggatggtgatcagcccagggcatttagggtgtccattacctgagtacaatccattcttctagcctgcagtcaccctactctcgaaagagaatagttcttgacacataaaactggtatgaaatccaaatttcagtgtccataaataaagttttgctggaacacaggtgccttcattcacttatgtaacgtctgaagctgctttgtgttgcagtggcgaggggatatagacctgcaaagtgtttattactggggggcctggcaatgctgcgacccccagtgtgatggaagagcactagcttcggagtcagaggaagacatgagttcactttccatggggagtatggaaacatagtgcctgcactgtaaggtggttttagcggcagaaataccattgtacccagcaatcccattactgggtatatacccaaagaaatgtaaatcattctgttacaaagacacatgcatgcacctgttcactgcagtactatccatgatagcaaagacatagaaccaacctaaatgctcatcaatgatagactggataaagaaaacatggtgcgtatataccatggaatactatgcagccataaaagatgagatcatgtcctttgtaggaacatgaatggagctggaagccatcatcctcagcaaactaacatgggaacagaaaaccaaacactgcatgttctcgcttataagtgggagctgaacagggagaacacatagacatgttggggggaacatcacacactggggcctgtcggaagtcgggaggagggagagcatcagtgatgaagaatagctaatgggtgctgggcttaatacctaggtgatgggttgatctgtgcagcaaaccaccatggcacacgtttacctacggaacaaacctgcacatcctgcacatgtacccctgaacttaaaagttggaaaaaaaaaaagactctatgtcagaaacagtatctgcctggtgcacagtaggtcttcaatggtaagtagccaaatagatggttttgcagtgtcattgagggtttcctatgttgatgaatggttactgaaaatttctaagatcactactaaaaattgatattacctctaaggtcattaataagaaaggatattgaaataatggatccttttctataacatgcacaaacatgctttgtaaaaccacacacctgtgctgtctggcagaactttctgtaatgatggaaaatctcttctgttctgttcagtatagtagccatcagccacatgtaacttcctagcatgtaaaatgtggctcatatgactgaagaactggattttgaatgtcattagatttaaatttaaataccatgtatagcaagtggttcccacgtcagtgcaaccatggaacacttagacacccactgccagcaccaaaccatgtgagcctcgtacccagcaccttgtggtgggacatctctcttagttaaaggtctgtcttttttgcctaaagacaaagtagtagaaaaggatatgagtggctgcagagcaaacggtggctgaattttatacccctgccaccactttgccacccctgctgcttctatgaaatggaagcagtttattcaaccagaggccaatgtgcctttgaaacttatctctatggtggctcctctgtaggattttacaagggtctgtttgttttgcgtttatctcaaggtaacacattttaaacacatttgagtagcagggtcttaactacaaatggagcttggccaagagaataataaaaacagtttaaggaaatatttcttggaagctgctgaaaaggtatctttacaactcctgttctctagagaagcttgcaggcatgggggtcagtgagtggacatcgatttgtgggaaggctaaggacaaaggctatggagaatttttcaccccaagttaaattcatttctgccaattaaggcagatgtttcgggccaggtgttgtgactcatgcctgtaatcccagcattttgggaggctcaggtgggagaatcacttgaaaataggagttcaagacctgcccgggcaacatagtgagaccctgtctctacaaaaaaagtaaaaatatggtttggtgtggtggtgcgcacctgtaatcccagctactcagaggctgaggtgggaagatcacttgagcccaagagtttgaggctgcagtgagctatgatcgtgccactgcattccaacctgggcaacaaagaaagactctgtctccaaaaaaaaaaacaaaaccaaaacccccccccaaaccagatgtttccaaatgctcgatttcatttggaaacacaaacttagtcttgaaaactgttatgattttttgaggtaccacaaatggcacctcaaatatatataaatatattcaaaaatatttgtaatgagcttaaggaaagtgggttcacctagtttgaataacaggtttgatgagtcagcctgcctgttgacctcgggtggtgcctgtcgcagcgagacggatcctggaaagggcctgtctgcttggcggcatcagctgtagatggcatcgctacactgactaatgttttctgaagacgagcttttatttatttcccaaagagaaacatttccagagggagcattcttttccctttttttttgtttttgaagtactgagttgaagtgtttttttttaaattttattttaagttctgggatacatgtgcggatgtgcatgtttgctacgtaggtaaacgtgtgccatggtggtttgcggcacagatcaacccatcacctaggtgttaatccccacatgcattagctatttgtcctgatgctcctcctccccccacccccgacaggccggagtatgtgatgttccccttcctgcgtccgtgtgttctcatcgttcagctcccacttatgagtgagaacatgtggtgtttggttttctcttcctgcgttagtttgctgaggataatggcttccagatctacccaggttcctgcaaaggacatgatctcattcctttttatggctgcatagtattccatggtctatatgtaccacattttctttatccagtctatcattgatgggcatttgggttgattccgtgtctttgctattgtgaatagtgctgcaatgaacatatgcgtgcatgtatctttatagtagaactatttatattcctttgggtatatacccagtaatgggattgctgggtcaaattgaagtgttttactaagttgaatgtgagcttcagtggggtggggctacacagagtgaagtgtggaggctgctggtaccttgagaaagggtataaatgcttttctctttcttttgatctctttctctgttgaatttacagcctctggtatatgcatgtaagatggaatgctctgtgtaggttatcggaggcacaccaaaggaaaagatgaaagactgtatgcacaaaaggccagcctgcacctcccgtgccctctgcttcccagggaagccgatcaatacagatggagtgggtcatgccccacgttaccaggacccctggcttctcccaccacaggggggtggctgggagggaacattacattaattacttaggcaaaatgcctgagcgctctgtaccggggcatagtgagcttgctggagctgatggggaaaaagttaagctgtttccagagaaccgctggtgtatccagtgttttgtagtgacttagcgtatcacacagtcggcaagcctctgctgtgtgcccgtgactggcccagcactgcgtgattttgcgtggagcagaggacaatgatgaaggggtgtgtgcagggggagcccgtggacttggtgagacccacaggccacagccaggctgcttagtctgtaacccgcccacgctgcagcctcagcatctacacccttcgacccacagcctccctgtgtggagtgtgcatgtaatcaggagaggcagataataaatatatatgcccagccaggcttgtgctgtggcacagcaaacagggcagcgcgcagtcagcatcacccagccttgatgagcacgccgcgatgctgctacgagctctgtgaagacgcgattttaattccagccagtcggtaggttgtgtgtctgtgtggcggtttagcaccgtttcaaattctgcattgcatggtgggggcgacggtggtgggtgagctctgcgtcgtaatcttttcggagctcttccagcacagtccagtcaaatcctctttgacgacaggcctgttccacacctgtgctgctcagcagggaggccgcaggtgcctagggagcacacaaaatgtggtcagaacaaaggaggaactggattttgagttttatataatttcaagtaactgaaaagtttaaatgtgttaaatacctaggtgtggccactggcttccagattggacaatatgggtcccagcaaaggcaccatcagctcctgtggttccctggatcattggcctccctgcctgcacccatggtctcccctgcctggttgtctgtccttccctataccacccagcctggcatccacccctaaagggaggttcctgagcccgcagagctcactgagcgtgtgtcttcagtcccccgctgcacctcgagggggcctctgtcacggcattccctgggatggtcaccacctcgtctgtcccctccactgcaccacgagccgctgaagagcaagtgcatgctcagccccgggcatggcgtctgtgcatctgggagctctgcacacggtgctgaatgaatgagcacagaaccaggtggagtttgtttaaccaacactcccgtgacactcatcgagctccagcgctcttccaggggctttccgctatcagtcacgtttggatacatcgcggttggccatatggttcactttgcagctgcgggctgtgacaacttacttgatctgtcaaagacgcgttccttttcacttgtagcatgtgaatgataccaaaatcacaggttgttctgacgatcgaaatgagataaactgtatgaacagcgcacgacattcctgtgaactcacagtaaatgttagggggttcactaaggacacactggtgaatggaacaaaacttactgccagtgtggagtgcgcatctaatccggaaaggcagataataaataaatacatttttttgagactgagtttcacttttgttgcccaggctggagtgcaatggcacaatctcggctcaccgcaacctccgccttccgggttcaagtgattctcctgcctcagcctcccgagtagctgggattacaggcatgcgccaccatgcctggctaatctttgtatattcagtagagatggggtttctctatattggttaggctggtcttgaactcccgacctcaggtgatctgcccgcctcggcctcccaaagtgctgggattacaggtgtgagccaccgcatcaggacgataataaatattacagagaagcagtgacatgtatgctcatattatttgggaacaaagatgggcccggataaggggtgttgggatgcctgggggccgtgggggctgacctgtaaataggagatcagggcagtgttgctgaggaggtgattgtcaggcaaaagcttggagggaggcaaggagcaaacacacagctgtgtggggaagagcattcctggcaaagggaaccacctttgccaagttgcagaggcaggacagaagggaaagggccctaagtgagggaggtgcttgtggccaaggtgaggagagcagctttcattctgagtgaacagggaatgacttttgtttctgaaagcttgctctggggctgggctaaggacggcttgtagacaggcagggacacatgtgttggggatatttcattacccaggagggagacggtgctggtgtctctcctctccctctctgcctctgtgagtgtgtaatatgcataatgtgtatgactttttttttttttttttttttttttttgagatggagtcttgctctgtcacccagactggagtgcagtggtgcaatctcggctcaccgcaaactccgcctcctgggttcaagtgattctcctgcctcagcgtcccaagtagctgggattacagacacctgccaccacgcctggctgatttttttatttttagtagagacggggtttctctatattagccagggtggtctcgaactcctgacctcaggtgatctgcccacctcagcctcccaaagtgttgggattacaggagtgagccaccgcgcctggccatgtgtatgactttgattgtgaaaagtttcaaacataccccaggtgggtaaaaatatcagatggtccctgaatattcccactgtccagcagtaacaatggtcaccagcacacgcccatctcgcttcacctttgccctcatacacttccttccttctcagacagtttagaagataattccggccaggcacagtggctcacacatgtaatcccagcactttgggaggccaaggagggtggatcacctaaggtcaggagtttgagaccagcttggccaacatggtgaaacctcatctctactaaaaatacagtaattccggccaggtgtggtggctcacgcctgtaatcccagcactttgggaggccgaggtgggtggatcacgaagtcaggagatggagaccatcctggccagcatggtaaaaccccgtctctactaaaaatacaaaaaaattagccaggcgtggtggcaggttcttgtaatctcagctactcgggagtctgaggcaggagaattgcttgaacccaggaggcggcggttgcagtgagctgagatcatgccgctgcactccagcctgggtaacagagcaagactccgtctcaaaaaaaaccctcccaaaacaaaaattagccgggcgtggtggcaggcacctgtaatcccagctacttgggaggctgaggcaggagaatcgcttgaacctgggaggtggaggttgcagtgagccgagattgcgccgctgcactccagcctgggtgacagagggagactccatctcaaaaataaataaataaataaagataattccatgttctgggtccagtgggcaggtggacaggatgctgcacagactgggtgcgaggaaggggtctgaaggtgccaccaaggcttttgctggagcgaccaggaggatggggctgctcctcccggaggtgggaggctgcgatggggcaggctgaggaagagccagagctgaggcttggacctgtcggctttgagatttgattcaacgtccaaggggagatgttttgagttgtcagatggaaattcatgtcgggaaggtgctatgcatttggggataattggagtgtggatgatcttaggagcaatgactctggttgacatcaccaggggatgagggcgcaggaggaggagactccagtgagcccagaggcttcagcacaaaagaaccagcgaatcaggatgtcgggagcgccttccagcccgcaggtgtgaccaaatcaccctggaggggctgttcccattcgtgctcctgaccacagactatggaagtgcctgtttgctttaagaaagtgtccgtttcatagacaaaatggtattttagaattaattatattcctgtaatttcaaggaagagctgacttctcatatccatggactgtttgtattccttcttttgtgaatgaacataattcttagtgaggtgtttttgtgtagtttttctctttcaccatgaggggtagagaaaagggctaggaacagacgccacctcttggcttaggggcggggaggctctggggtcaggccagactctcccttcctccctcacggtctctttccatttctccaagtctctgctttctcaacctcaacatgagggtgctggggagttgggctaagtcccgtgttaggacccgccatggccgcatggccccgaatctccctcgctggccccgtctctgtggctcagtctctgctggctccagagcgtggcctggcctgcgcgtcagtggacgtctgttcccgtgtgggggtgttcttgtgggcgggtgggctctgctgtttcccacgtctagccagggcctgccacccagggtctcaatacatgtgttttgaatggcttcaaagactattaaaagcaagttattattttcaaaattaaaataatctctctcttttaaacaataaaataaaattttgcattttgtggcgatagggtttgtatagctagtgatattttatttttaaatactttagaaggaagccatgttctaattccttccccgtttcagcgtgtttaagcaaagtctctttttagttcaacctcattgagcagagggcacctgtcaggtacagttgacagtacatccagttctgtcactgcctgacttttgaaagtctcaaatcttagcgtcaggagcctagacggggcctcactcactcccgcagcccccaaggttgaccgagctgccctctcccttccaggaagcacggctgatgctccgaaggagggaagactgacccggtttctggacttcacccagctgatggacatggcatctgaatccgtaggaggaaaagtaagtgggtctctcatggccaaacaagggttgaaggcatccgtgctaagggcacaactcaccagtgcagagaacctcatgcaagaatcaacaagaatcaggctgaagtgttggcctgcccaaggaaacccgttagcgagaaagacttccaaagaatttatcttaaattggtgacaattctcagcaaggacaatactgccttagattttgtgtgtttcactagaggacagactgtggtcctctgctctagataggcaggcggtcctctagctctagttagatctgaggtcctctagctggagttaaatcggaggtcctctggctctggttagataggaggtcctctggctctggttagataggaggtcctctggctctggttagatgggaggtcctctggctctagttagatgggaggtcctctggctctggttagatgggaggtcccctggctctatttagatccgaggtcctctggctctatttagatccgaggtcctctggctctagttagacctgtggtcctctggctctggttagatgggaggtcctctggctctggttagatcggaggtcctctggctctggttagatgggaggtcctctggctctggttagatgggaggtcctctggctctggttagattggaggtcctctggctctggttagatgggaggtcctctggctctggttagatgggaggtcctctggctctggttagatgggaggtcctctggctctatttagatccgaggtcctctggctctatttagatccgaggtcctctggctctatttagatccgaggtcctctggctctagttagatccgaggtcctctggctctagttagacctgtggtcctctggctctggttagatgggaggtcctctggctgtggttagatcggaggtcctctggctctagttagattggaggtcctctggctctggttagatgggaggtcctctgggtctggttagatgggaggtccccaggctctgattagatgggaggtcctctggttctggttagataggaggtcctctggctctggttagatgggaggtcctctggctctggttagatgggaggtcctctggctctggttagatcggaagtcctctggctctggttagataggaggtcctctggctctggttagatgggaggtcctctggctctatttagatccgaggtcctctggctctagttagacctgtggtcctctggctctggttagatgggaggtcctctggctctggttagatcggaggtcctctggctctagttagatcggaggtcctctggctctggttagatgggaggtcctctgggtctggttagataggaggtcctctggttctggttagatgggaggtcccctggctctggttagatgggaggtcctctggttctggttagataggaggtcctctggctctggttagatgggaggtcctctggctctggttagatgggaggtcctctggctctggttagatcggaagtcctctggctctggttagatcggaagtcctctggctctggttagataggaggtcctctggctctggttagatcggaggtcctctggctgtagttagacctgtggtcctctggctctagtgtgtaatgagggtcacctggagaactcattaaacataatgtgcagaggcgctggggtgcaggctgtgctcagaagcagtgtgtctggtacagaaagggaagaccctgtgcctgcccccaggaagctacactctagcagggagacagatgtaagtccagaccagccctgtgactggcacaatgccagggtgctgggggagcacatggactccagccatgggtagcctgggggaattggggtgggaggggtggggatgggccagctgagtgctgctggaggcagcttgctggagagcagctggcgggcagggatgaggtgcagggtggttctggcagaggtgtctgcgaggagagcaagggagcccacatgctccaggtggctcagtgtttcaagaacacgctgcgcgtttgtgagaagagttgggagcacgagtctggagaggtaggagaggccccatgtgccctgtgaagccttctgctgaggagccacagagagatctggagcaagggggatcctgatatgtccacctacctgccatttgaaccctggaacaggtcaacctcagcacatcaggtcttccctctgctctgccactcaaacagccagcagctctgaaacagctcgtccttcctgcctttcgaactcctgggctggagtcagagcctggggcagggtgccctccaggctgcagtgaccacagagtcctggcttgggtggagtgaccacagcctgttttgctcaggaaaatctgatttaccttgtattctggatgtacaattagtatcattgacctcactctcaaaatgatcctgctttggtggatgaatgaccaggacagcccacctgcagggtgacctatggcggcccttgtgggtgaacacagaggccccaaccgcatacgtaacccagagcttttttggtcattgctcggtttgtaaaagtagcacgaaacctctggttcatgaaaaaaagaaagttggtttatttgcttcttgagtgtaagatgttagtgctcttacctccagatggtaaaggagaatcggaaaaaagggtgggaagagaagaagaaggaggaggcagacaatgaaatggaagcatttcaaggcatcatggcttaactgcagattctgtcgcttcccctaggtgatttcacgttttctttttacttcatctcataatgtttcactagggaatgaaataaaatggtatcagatttatggttgctttatctttctttctttctttctttgtctagattttatttgcaacagatgacttttttgctcctgcagaaaacctcataaaggtattgtaaattgacattctgcaatgtaaagggttgatgtagagaaatctatgccgccttgttattaaaatctccctgtatatttgggatggagtcatgtgatgtacactggcaaattagcatattagaatgttagaaagacatgcaaatcagcatgaactcatgccaaaacatagcagagacagggatctgagcaagtaatttgggactgcattgtttcctggggaaaattctgaggtcctcaaatactgctcttctgggtaaggtgaatttcatcatttgtgttgggaagaaaatggatctatgtcttgaattttctgggaaatgttttacctgcctaattataaaagtgcaggacagcttattaaaaaaatagagaaaatgctgacgaacatagggaagaaatggcggccctgctggcgtcctgctcctccgtcatacccagtgtggagatgcgaactcttgtgcgtggagagacaaacacaggtgcacattgagctaatgcccacgtacagcattcatgactggcctccattgtgggcagcggccatctggttaccctggtgaaatggttgctctctgtctgggcaggacctggctgggtccagagcaagctgaagtatggccctgagaaggcaccttacagtgttaacttacctattccccaggagaaagtgaaaataaaatgagaaagggcaacatgaattaactttttctaggtcacacagttactaaatgccaaagctcttaccattttaccacaggtccggtctttgaaacactgaaatgcatgtctaccttgacctagttgttccacagatttacatcgtttgcacaagtgggcaaaaaaataggtagaaaacattcattctggtattgtttggagaggagataaccaacctaagtgttcattgattgatagggaactaaagaaattatagctcttccagatatggactattatgtggctactagaatgaggtaggcctggcactgtggctcacacctgtaatcccagcactttgggaagccaaggcaggaggatcacttgagcctaggagtttgggaccagcctgggcaacagagcaagaccccatttctgaaaataaaaaatattatccaggcatggctatgtgtacctgtagtccccgctactcagaaggctgagctgggaggattgcttgagcccaagacgttgaggttgcagtgagccatcatcatgccactgcactccagcctgggtgacagagtaagaccctgtcaaaaaaaaaaaaaaaaaagcaagctctccattcactggcaacaagagagatccatgtatattttatgagtgtaaaacagagtttgaaggcgcacacatcaaacagtgagatgtgattatctgtgaagagagaggtgggcttggaaatggggtgggagagagggtagggcactatttcttagattttatacttgagcatatatatatatatatacacacacacacatataaacacttacacactacatatgtgtatatatagtcacgctataacatcacacgagacacatatatttctcctttttgaaaaaaataacattacagataaatgtaaagttcaccgttcacctccaacttgagtgccagtccacgccctccctttccaccattcacactgttgtaggatgggaaaatactttaggctgttggggctgctgaagcaaaatactgcagatgggtggtggcttaaacacagtgatttcttgaagttctgggggctggaagtctgagaccgagcctgagacagtagcagctccagcatctggtgagggccctcttgggatggccacctgccgctgattccctcaggtgacagagaagagaggggaagcaggccatctcctgcctcctcccacatgggcactcatcccatcatgggggctccacccttgtgacctaatcacctcccaaagtcctcatctccgaataccatcactctggggattaggtttcaacatacaaattttggtgggggacaaacattcagtctgttgcagagaattcttctaatgtattttatacacttaaatacacatatattcgtaaatatataagatattttgtattctaaatttatatacatattttcacaaagcacttagcattctgcacactttttttggtgggggtggggcaggatctcgctgtgatcaggctgtcaggctggggtgcagtggcacggtcatggctcactgcagcctcgacttcctgggcacaagcgatcctcctgcctcactgggactacaggcatactccactgtgcccagcgaatttttaaattttttgtagagatgaggtctctagctcctgggctcaagcagtcctcctgcctcggcctcccaaatggctgggattacaggcgtgagccaccgtgcccggccctaaacctgcttttctcactgcgtgtttgtgaatgccattggtgctgatgtgtgtagacccaggccaccctcttagctgccgaataataactgtccatgtcatcgtggtccattttatggccccctttccttgttgatgcacatttaggttgatgacattttgcacgtattgaaaacatccttgtacaagtgtgtgcacgtgtgtcggtttatccctgggaccagtccttggtttctctctctctctctctttttttttgagacagagtctcactctgttgcccaggctggagtgcagtggcatgatctcggctcaccacaacctccacctcctgggttcaagtgattctcctgcctcagcctcccaagtagctgggactacaggcacccgccaccacgcccagctaatttttgtatttttagtagagagggggtttcaccatgttggccaggctggtctcgaactcctgacctcaggtgatccgccctccttggcctcccaaagtgctgggattacaggtgtaagccaccgcacctgactagtttttctctttttttaaggaacacacatttttaaggaacatcacatggcatgagccagttttacaacagggctgttttcctgccactggttcagtagcgtgtgtccccagcttccctcacaccgttcagtgtcagtccaatcacaacagcagcagtagcagcaacacacctgaaacaatcaacctacccccaaaactaaacaccaaaaagtttggggccttggaggtctggggtttaagtgggaggtgtacctccttctctccttctgggttcagagcagagttttgcaattcctgatgagtaatggaaaggctggagtgtgtgctgtctttaagatgtgatttgattgtaataacattcaaaataccatcaactttcatgtataatgctaaatactgggcacttactatgtgccaggcacatttaaggttgacaacagccagaggcggtcaatagcacgatggctgtttgcctttgacagaggaggagcactgaggcacaggaaggtgggtaccgttggccacgggtcccctgcctgggaggctgggcaggttgtcacaccagggagtctggcgggatccctggttggcgtctcatgcatcagcttccatcagagcatccctgccgccctgggtcctgctacccctagtcccttcctctgctcctgcctggggagattccctaagcagtaacgtaagatcctccttgcacgacttgatggaaacagggaaagtatccccatgctgggccagcataacgatttctgagcatccacgctatttgagggtctttcatgtcggctattccaacttcatgacactcctgcgaggatgcgtgtatcctcctcattctggaagatgaagaagtgtgctcagctgtctaaggaggctgtgtggggcatcagagaccatgcatttcctcagggggttgcagagtgtgctgtgtggtttcacctggaccctgagcgtccagcctactcttcctatgactttggatgaattcctgattgaatagtctacctggcctgcttggaaatctgaccagcctctctcactttaatacccatgtaggttgctgttgggaattgcatttgtgcggcccacagagtgcctggtgatgtggttgtacctgctgctatcagtggtcaattctgtgtgctgaggcccacaaagaagtcacatttctttctctgaagatgataaaagcggaggcatctctcaatctggaaggggctagctgggcatgaaggtggtggcagaggctcccctagaccccggtttgcaccgttcctctggcactgtgggacagaagtggacttgctggaagccaggagatcacatgaatgttaatgatcaccttgttgtggtctttgccctagagtgacagcccgtgcttcaaagagcatgaatatacggagtttgggaaatggatggatggctgggagaccaggaggaaaaggattccaggtaataacaacggttcgttcatcgaagtgcagctgacactgcaaagttaaaaacgcaggctgtggcaaagccagtgtccgttttgggtcagctttaacatggggccctggaatgctctgtaatcttggatgtccttatctgaacatcaggctctaagtcaggaaggggcagcgtgagcccgggtcactgacgtcccaccaggcacaaagggtgagaagcacgttgtcgggaaaatgaaaaccctggtgaggtctgcggatggaaaaaagagtggattctcactgagcaatgtggcaggcattaggcagcgtgcatcttctgggtccttactacagtcctctggagtaggtctctttatccccgtttaaccgccatggaaacagattcctggactcagcccagggcacactgctagcaagataagctggggactgggccagggtctgtcctcaacactgtacctgctgtcttttacgattttatgcaatttttattcattgctattactcagtctcaatcaaaatataccttctgaagttgaagaaaagcaaacaaatccaggcattaggttgataattggatttttacttgccactatctcaagtattacagaaatatttgatatttctagttttctaactttctacagtacttgaagcagtattagtttctaacaaatctggacattttaaggtgagttaatatctggcagtaaataaccaagaactcaatagtggcagacttgacttcaagactctgaaggctttggtagatgcaggcaggtgtctgaccagtggtggggctggaggctggagggtgctgtgtcagttcctgagcttgagaggacaatgaacacagtgtctgcaggagaaccagctctgcttactacctgctgagcttggtgaggtgctttctacatcgcacactcagtctaagctttatggaagctaacggcatccctaatttacagttgagaaaatgagattctctactgtaagaggtaaataatttgccaaggacagtcataggaaatgatccatttggaaccagaatcaggtcttcctggatcccagcctgtgcattttctcttctggctagaactgaggattttcgttggggaatggtggtcacatgtggccaggttatgagagatcctacagtcatattagctaagaaccgccctgaacagttttttctgtgatggacggaatggcccctgctgtgggtcaggtgcatgtggggtgcactgcctcgcatgcagcatctgctgtgttggccctaacgagactgctcttgtcctctgtgttgcgcaggtcacgactggtgtgtcctcaggctggggatccaaggagtcatccggggcttcgacgtggacgtttcttacttcacgggagattacgctcctcgagtgtccattcaagcagcaaacttggaagaaggtgcgttaggaaccactgtccccaaaatgagaattatgggtcacatggctcctctggccagccacagccccacaactgctcactttccctaccacccagacagcttcaggcgcttgactaaggctactttactgtaacggggctgtaggaccaggactcctagtagagcgctctgtggtttttgatttgtggcttaatagtgttaacagccagatatagattttatcattcccacggtccttcagcttcacgcagaggcaggccatcatccctggaacgtgggtgagcaggttgctggtgggcgggagggagtggtttgtgcctcagatgacccgggtgatgtggacccaggtctgggacagctgtggggtgagcagcaccagccctgctttgggctgtcccagtgtgtgtgatgggggagctgctatggcattttaggcaagggttcctatctgcatcttggaatgctggacctatgaatcctgcaggctctataaatgagacgtattctgtgaaagggccatatacacagagcagacctcaggtgctgaagaagccaagaaaccaaagaaagaggctgacaaatccagtctgttggtaacgggtattttattgggggaacttacggacagaagcgtggccttgggcagcagcgagatgggtaaatctctgcactgttactgcccggactcagggctcacatgctgtagggaaagggtctgcgtgctccagcgggacaactgaaggcagcctccagaacagggaagagggcggtgtgcgtcacagcctctgatttgtgcgataatatcaaggttgacatgttctggactaaggacagtaaatcaagttggaagcaggacgtgttcacaggattgaggctaatcagacattgacatggcagattcgcatccaagatggagtcactttgtctccacagactttctgtatttttattcctttgttaccatctgatgttgactttagcattaattaaaaaaaatatacaattatgtgtgtgtttatacatgtacttagggaagataagtcaatgtgggttggcaagtttacactgaacatgctatgtgcacagcgctgcatgaggctctgtggacacgaacgggccctgctccctgaagatggctggggcacctgaacaggaaatgatgctacaagagatgctactctaaaagcggaaatgaccagtgacaaacgagtaagattgtttcggcaagcccctcaactgcccatgagtgcttctatttctgaattgccccagtatcaattctaaggatgccactgggagaggtggtgtttctggaattgaccttgtaatagtccaactttgaaaactctagcgatgtgataaacttgttgaagtttgagctaacttggagatgacatttactgtttgacaagcaaatgtagtatcaaacatcttgtactattttttgaaatgactgttaatatattaaatattgaggaacttcaacaagtgtgtctattactttgatcatttgatacttcgaaatatctttagtgttatttgcaaagcgagaattaccatacaaaccaccaagagagtagattccctttgattttgaaccctaatcttaatcctgaatggtcattccaactacagataaactaccagaaatcccagaaagaggaaccaggacaggagctgcagccactcctgaggagtttgaagccattgctgaggtacatctcccccaaatgaattgggtcttgtcaccaattattaggagagtagggaaactgctctgcacacctggctgtgcaaggcgattctttgggacgcccagccctgatgctccccacatcatttgcttacccactgtggccttgcaaacgtctcagtggttcatcaacctgggaagagtgagcatcatggcccaaaggcttctcaaagggttccaccagcacccatctgcaaatggctgctggccccgataagcacacatacagaaactgatagtaagcgtttaaacactttttataccaacttgatgtaacttgaagtaacgtttgtgtttggagaatttaataaaagaaacgggggaaaaaaataaatagggcttgtgttttggtacattcttgtttttttaatgtttatttagtaatagtttgtattgttttttacagaaatgttgatccataacagacaggaaagtaaataacaggaacagtaaacagggccgttagtttgagaagtgctaacctagagaaaatggttgcaaggctcaggccagcagatttccccagaggtcatggagcatggcagtagccttggtttttatttgaatgttcacctcaccacacctcaaggtgaagacatttggaggggtctgagatcttgtccttcatttgcaagcatctgccaccatcacccactggctgttttgatcagtgaaaacaaaacaggcctttattctgttttttattaaacatggggcttgatatgtactatttttattaaagtgtttcattaggtatccatcattatttatttatttgtttgtttattttttgggacggagtctcgctctgtggcccaggctggagtgcaggggcgcgatctcggctcactgcaagctccgcctcccaggttcacgccattctcctgcctcagcctcccgagtagctgggactacaggcgcccgccaccacgcccggctaattttttgtatttctagtacagacggggtttcaccgtgttagccaggatggtctcgatctcctgaccttgtgatccgcccgcctcggcctcccaaggtgctgggattacaggcgtgagccaccgtgcccggcatccatcattaatttttattccaaagtatctccacaccttaagtgccacagaggcaataggatgacagaatttattgttttcaagagcaattgctgacatttctatatttattgctagctaaaatccgacgactggagttacttggttcccatgactgagcttaagccaggaaaccctgcttccggccacaactattttcttgtcaattcccagcagagatggactcatatcagactcaacattttcccaggtaatcgtgacatggacttatcaccagttccatggcttctttattttatgttgacatgtttataaaatataaaatgacttgctctttccttcttggtaattgatctctctagcatttcaggattgtaatttctcctttttatgctctagaaaattcttgttttaatccacacatcaataggtggttattgaaaaattatcaagtaaattaggatgtggtggaactaagttgtattaggttagatagatcctaactagatttcacaagtatgttatattagcagctgaagtggtatgtacaaatgactcattttattttttaatagctttattgtgatataattaacatgcagttcacccatttgaagtgtacaatcaatgatgtatagcatatgcatagacacgtgcaaccatcaccatacctttagaacatttttatcatctcagaaagaaaccccatatcctttagctatcatccctcatcttccctatcccaaagcaaccactaatttgctttttgtcttgatagttttgactattttggacatttcatataagtaggaattatataatattggtcttttgtgtctgactttttccacttagtataatgttttcaagattcatccatgttgtaacatgtattaacactttctttctttttgtgtaaggctaatataggttgagcatctcaaatctgaaagccccaaaatttgaaatgttccaaaatccaaaactttttgagtgctgacatgatgctcaaaggaaatgctcactggaatatttcagattttggatttgggacactctaccagtaagtataatgcaaatatttaaaaaaactgaaatccaaacacttctggtctcaagcatttcagataagggatactcaaccactaccacattttgtttacccgttcattagttgacagacacttgtttccatctgctggctattttgaacaatgctgctgtaaacatttgtgtacaagattttgtgtggatatatgctttcttttgttgagtgtatgcctaagactggactttctgggtcatatgataactctgtgtttaactgtttgaagaattactaggcttttccgaaagtgctgcactattttacattcttaacagccacgtaaaggagtgctgatttctccctgcctttcccagcactctctgtcttactttttgtttatagtcatcctagtggatgtgaggtggtgtctcattgtggttttgatgtgcatttccctgatgactaatgaggaggaacatcttttcatatgtttattggccatttgtatgttttatttggaaaaatttctcttcagatctctattcacttgtcttaaatttcaacaggtttttgggggaacaggtggtgtttggttacatggataagttctttagtggtgatttctgagattttggtgcacccatcaccagagcagtgtacactgtatccaatgtgtagcctgttatccctcaccccccacccttccccacattgtatcattcttatgtctttgcatcctaatagcttagctcccacttataactgagaacatatgatgtttgcttttccattcctgaactacttcatttagaataatggtctccaactccatccaggttgctgtgaatgccattatttcattcctttttatggctgcatagtattccatggtatatgtatatataccatattttcttttttaaaatattttcaattatgggcacatagtaggtatatatatatttatggggtacatgaaatgttttaacacaggcatgcaatgaataataatcacatcatggagaatgaggtatccatccccaatccattgtgtatatataccacttttaaaatctattcctctgttaatgggcacttactttgatttcatattttggctgtgacattgtaaacagtgtcacagtaaacttggaagtgcagatatctcttcaatatattgatttactttcttttggatatatacacagtagtgagattgctggatgaatctattgttgttctatttttagttttttgaggagttttcatagttttccatagtgagtgtactaatttacattctcaccaatagtgtacatgggcttcactttctccacatcctcgctagcatccactattcccccgtctttttaaataaaagcggtattactctgctctcacgttgctataaagatactacctgagactgggtaacttacaaacaaaagaggtttaattaactcacagttctacatgactggggaggcctcaggaaacttacaatcatggcagaaagagaaggcgaagcaaggcatgtcttacatggcagcaggatcgagagagagagagagagacagagagagagagagacagagacagacagacagagagagacagagaaagggggaagagccacttttaaacatcagatctcacaagaactccctatcagaagaacagcatggggaaaaccaccccatcatccaatcacctctaagcaggtccctccctggacatgtggggattacaattagagatgaggtttgagtggggatacagaaccagaccatgtcaaaagccatttcaactgaggtggtatgacatttcattgtggttttgagttgcatttttctgatgattagagatgttgagcatttaaaaaatatacctgttgcccatttgtatgccttcttttgagaaatatctattcagaacttttgcccatttataaattattttttttgctactgagttgttagctattgagttgtccttatatattcttgttattaatcccttcttagatggatagtttgcaaatatatttttttccaactctatgggttgtcactccactttgttatttcctttgacagcagccttttagcttgatgtaatcccatttgtctgtttttcctgttgttgcctgtgcttttgaggtcttacacacaaatatttgccaagaccaatgtcctagagcatttccccaaggttttcttctagaatgttcatagttttaggtcttagatttaagtttttcatccattttgatttcattttgcataaggtgagagataggagtctagtttcattcttcggcatgcagttatctagtttccccagcaccatttactgaagagactgttccccattgcgtgttcttggtgcctttattgagaatgagttggctgtaaatgtgttgatttatatctgggttctctattgtgttgtctgtttttatgccataaccattctgatttgcttatatagcttcatagtacattttgaagtcaggtagtgtgatgccttcagctttgtttttttgctttggttattcagggtctttcatttaaattttactttttaaaaatatttctgagaagaatatcattggtattttaatagggattgaattgaatctgtaaattgctttggatagtactgtcattttaacaatattaattctttcaatctaggagcacggaacatctttccattttttctgtgtcctcttcaatatatttcaccagtgttttatagttttccttgtatagctctttcacttcgtaggataaatggattcctcagtattttatagtttttgtagctattgtatatgcgattgccttcttgttttattttgtagattattcactgttggtgtgtataaatgctactgacttttgtatgttgaatttgtatcctgaaaatctactgaattagtttatcagttctaatagtttttgggtggagtctaggtttttctaagtataagatcatattgtctatgaagaaggagaacttcacttctttcttttcaatttggatgccatttatttctcttgcataattgctccagccaggacttccaatattatgttaataaaagcggtgaaagtgggcatccttgtcttgttccggatcttagagaaaaggctttcattttttgtccattaagtatgatgttacctgtgggtttgtcatatgtggcttttgttattttgaggtagtttttttttctatacccaatttattgagggtttttttcttatcatgaagtgacgttaaattttatcaaatgctttccagcatttatcgaaatgatcatatggtttttgttcttggttcagttagtgatgtgtcatgtttattgattcatgtatgttgagacatgcttgccttcctggaatgaattccacttgatcatggtgagtgatctgtttattgtgttgttaaattcagtttgctggtattttgttgaggatttttgcatctatgtccatcagtgatattaacctgtagttttctttttttgttgttgtctttgtctggttttggtatcagggtaatactggccttgtagaatgagtttggaagtactcctgcttcaattttcttgaagagtttgagtaaaattggtattagttattccttttatgtttggtagaattcagcagggaagccattaggtcctggaattttctttaatgggagactttttaaatttcagcttttatctcatcattcattattggtttattaaggttttctatttcttcatggttcaatcttggtagattgtatgtgtccagaaatgtatccatttcttctaggttttccaatttgttggtatgtagttgttcataatagtctctaattgatctttgtaattctgtggtcacatttccttttggctgagtacagtggactttattgatggtatgtgacaggatgtggctccctaggcccctctcttttcagggggcctggcatggaaactgtgtcagggggagattctcagtatggtgggagagtgagtgtggcagggactccctagcagctgagaacctctctaatcttcttgtgctcttgctggggctggtggtccaggggctcttactctttggaggccatgtggaccatgaggcctccactaccctgttgccaaattcattgtcataccagggaataagcttgacaaagtagtcattgagggaaatgccagccccagcatcaaagctggaagagtgaatgtctgttaaagtcagaggagacaacctggcactcactatagcccaagatgcccttgagggggccctccaatgcctgcttcaccgcctttttgatggtgtcatatttgtcaagtttctccagatggcaagtcaggtccaaaatgacacagaggtggggatatggaacaccatgctagtgagcttccattcagcttggggatgacctttccaacagctttggcagtgcaagtagatgcagagatgatgttctgtagagccctgtggccatcctgccaacgtttccaagaaggggcacccatggtcttcggagtggtagtgattgcataggctgtggtcatgagtccctccatagtgccaaagttgtcatggatgaccttggccagaagggctaagtagtaggtggtgtatgaggcactactaaggatcttgaggttgttttcatacttctcatgattcacaccccacataaacataaggggcatcagcagagggggcagagatggtggctcttttggcttacccctctaagtgagcctcagccttctccatggtaatggagattctagtgggctcaacaacataatcagcaccgctgtcatttcactcgattttgggggggatcttgctcctggaagataatgatgggatttccattgatgtcagtcttctcattctgagccttgatgatactgtggaacttgccatgggtggaagcctactggaacatgtaggccaggtagttgaggtcaatgaaggcatcattgatgatgacaatatccactttgccagagctaaaagcagccttggtgaccaggtgcttaatgtggccaaatttgtttactctggccttcattttcaccttgttgcctcaggaacccagctggcactgcataaaaatatgcaggtgtctgtcaaatggaaaagagaagagagccagtctcattttttatgtatccttctctatttctgattttttggggtcttttctctttgtaattagtctagctaaaggtccatcacttttgtttctttttaaaaaaacaagttttttgttttgttgatcctctgtattattttagttgccatttatttatcctctgatctttatttttttcttctactagtaattttgggattggtttatacttgcttttctagtttattgagatgcattgttatattaatttgaagtctttctacttctttggtataggtatttattgctataaacttccctcttagtactgcctttgttgtatcccatatatttttgtatgttgtatttccattttcatttgtttcaagcatttttaaaatttccttcttaattactgacccatttgttgttcaggagcatgttgtttaatttacatgtgtttgtgtattttccaatgtgtctcttattattgatttctagttttattccattatggtcagaaaagatacttgatatgatttctacttttttgaatttgtttagacttgctttatggcccaagacatggcctattctagagaatgttccatgtgctgatgaaaagaatgcatattctgcagcagttgggtaaaatgttctgtaatgtcagttagggccattagatctagtgtgtagttcaacttcactatttctttgttgattttctgtctggacgatttgtccattactgaaagtgaggtgttgaagtcccctactattattgtattgcagtctatttatccctttagatctattaatgtttgctttatataagacttgaaagctctggtgttggacacatagatattcataattgacccatttatcattatacagtgtcttgtctttttttttttttaacagtctttgatttgtagtctattttatctgatataagtgtagctactcctgctcttttttggcctctggttgcatgagatatctttttccatcctttcactgtcagcctatttgtgtctttataggtcaagtgggtttcttgtaggcagcatatagttgggccttgtttcttagtccattaagcaacagtataccttttatttggaacattgagtccatttacattcagtattgtcatcagtaagagcttactgtcattttgttgcttgttttctgatcccctccccttcccttcccttccctcccccctcccctccccctccccctcccctcccccctcccctccccctcccctcccccctcccctcccccctcccctcccccctcccctcccctccccctcccctcccctcccctcccctcccccctcccctcccctcccccctcccctcccctcccccttcccctccccccctcccctcccctcccctcccctccctttcctttccttttctttctttctgccttagtggttaactaattttctctgatagtatgttttaattgacttttatttttagcaaatctattataggtttttgcactgtggttaccatgaggcttataaaaacatcttataacaagttattttaaagagatgtcaactcatcttagatcacaaagaaaaaaatagaaataaacaaagaaaaacaaaaaaaaactctacatttttaactttatccctcctcccacattttgacttcatgttgtctcaatttgcatgtttttatattgcctatcttttaacacctgttaaagatatcaacaaaaagattattatttttgatagatttgtcttttggacttcatactagagttatgagtgaattacacactataattacagtgttggagtattctgagttcgttaatgcacttaattttactagtgggttttataaattcaaatgttttctttttgcacattagtgttttttttttttcaaatggaagaactttagcatttcatttaagactggtggtggtgaattctctcagctcttgtttatccaggaaagattttctctctctttcatatttgaaagatagcttttctagatacaatattcttggatggcagtatttttttctttcagcactttaaaatgtcatcccacttctttttggcctgtatggttatcattgagaagtctgttgtcagatgaattgaagcttctttatgttatttgcttcttttctcttgctgcttttaggatatttttatccttgactttttttttttttcttgagacagggtctcactttgtcacccaggctggagtccagtggtgcaatcacaggtcactgcagcttcaacctcctttggctcagatgattctcccacatcagcatcccaagtagctgggaccactggtgcacaccaccatgcctggctaatttttgtatttgtttttttttttgtagaaatggggttttaccatgttgcccaggctggtctcaaaatcctgggctcaagcaatccacccaccttgacctcccaaagtgctggaattataggcatgagccatcatacccagcctgtccttgacctttaggattttttatatgccttggagtagtcttatttggatacaatccatttctttgagctttctgtaccaggatatttatgtctttatcaagttttgaaaagttttctattatttctttgaataagctttctaccccttgctcttgctcaactccctcctcaacaccaataattcttagatttgatcttttgaggtaatattttatatcttgtaagcaatctttattccttttcatttttttctcctctgtgtatttttaaatagcccattttgagctcactgattctttcctctgcttgcttcattctattcttaagagcctctaatgaattttttggttcagcaaatacgtttttccattcaaagttttctgtttgattttaaaaaattattgaaattttgttaaatttctctgataaacttctaagctgcttttgtgtgttatctttgaggtcactgagtttccttaaaactgctattttgaattattgatcacagagttcatatatcactgtcttattatgatcagtcactggttccttgctttgtccatttggggatgtcatagttctttgctgttgtttcttatgggtatacatctatgcctgtgcattgaagcattagttatttattccagtcttttctttctgggttgtttcagtttttgttgaatatatttgcttagatgtagggagtgtccaatattttagcttccctgggccacattggaagaggaagaattgtcttgggccacacataaaatgccctaacactaacgatagctgatgagccaaaaaaattttgcaaaacaatctcatactgttttaagaaagtttatggatttgtgttgggccacattcaaagccaccatgggcttcataagacccactgcccatgtgttggacaagcttagcttagagaatcattataaatttcctgttgattttatttcctgctaggtagctgcctacttttcagcactagatggcaccttaagtccaggattgcttcatttgtagtaagcaatcaaattactgcccatcagaataggggaggtcccagggagcatattctagtggtgtgggaaggttagctaggtgtttgtctctaggggacctgtggaacaaacctcctacaacatggtgttgctgaacagcaactctgatttggtgtttcctctggctgagttacagggtttgcagggctggggatgtctcaccctcagtgtgaagcctccaccttatggatcatgagaatgggtcactgtggccccaatatctcaaggtaggaccctgtcccatgagtcagggctgggtcaaataaaggagcccccgcctctcaaccacactcacccagggcttagcctcagtaacaggcatataggggcaggatgagaagccctgatgtcctgcctctcctgggaagacagccctgcaaccatgggctgcacttgtttgcagtctccactttgctgatctgggagagggtgtgcaggtgaggtcttggttcaaataccgcagactctcactgttcttactgaattttagcagatattcttgaatagatgttgctgaattttccgtatgcccttaggaccatttccagagacctgaagtgttttcccatccctcaacccccctaaattttaccagctccactgaggaacaggacagcaaagctctcctgctgtcatgccagaagtggttctctggaaccttattttagatgcaatgtttctctggttatgatgctttaaagtgagacatgaaaatggaaagatctaaacacgtttactaatattaattactcactgaaataatctattctaaaaacagtgcaagaaaatgaatgagcaaagcttacaagagagtcagaccttttccccacttgttaatttaacatacactgtggaataactactttgagctacagactgagcattggccataaaatcattttcctgacaatgtgtagggcagaaccaacagagtgtatgcttcatgaagaaagggctgtgagtccagattgtcatttttgtacacctgacacttagcacagcatggggaacacaggagaagctccataactatttgttgttagatttgacagagtccttgtccttatgaagtgaataacccagtgggagacagataagaaaaataactttggaaagaggccgaggtgggcagatcacctgaggtcaggagttcaagaccagcctggccaacatggggaaaccttgtctctactaaaaatacaaaaattagccaggtgtggtggcgggtgcctgtaatcccggctagttgggaggctgaggcagcagaatcgcctgaacccgggaggcggaggttgcagtgagccgagatcgtgccactgcattccagcctgggcaaccagagtgagactctgtctcaaaaagaaaacaaaagaaaaaaaacaaaaaactgcaaaatagtgatacatacaacaaaagtattttggtagagccataaacatttctatttgactatttctgatccaccaaaatagcaactttatatgtccaacccaatttgtacaggattcacgagttgagggagggtctaaaatagtttctgagtggaagccctgcttttctgggttgaatatgaagggtccctaagcacatgaaagctctttcctaattggtcagcattgatggcctgaagaggagagatgggcaatgcctgcatgcagatttcatgtcccagctcttactggcatctttaattgctccatgaggattccacctgggatccaggtgtaaagggaaaggaagctggggaaacctggctgatgttacagggacacactgggtgggaatgggttggtttaaatgagatgtactcagaggatgaagagtcatttctgggattccttggcagctgtgactaaaagcaagtttggatattaactctgtaaagaagaatcttattttttaaaatgtgaaatcgacttcactttcaacagacgaatatcttctatgccattaaagccaattataatatttaatgaactagaatggcagtgatattactctcataacccggctcctgctgaatgactccctctaggatattttctagggttttatgccaatgaagtttttggttttatttgttgtaaatagcaagacttccattgttttaccaaaaaattttcagatcactcattttcactaaatttgtaaaataaaaacatatagggcatgttttagtacaatattttgattaaattaattttctatattaaaaatgcttggtttccaccttctagcaattaatattcgaagaaacaaaacattcgttctactagaatcagatgctgtgagttgattttggtagctatttgctgctctgcagacctaatttcaggctgctgtggttctcagcagcaatttgattttgtgaatattatcttttgtattctgaatcacattgctaagcagggtggtgttgtaaaaataaaaacataaggttctcttgtctgagtctgtgtgggagtcagcgatgcttatttctagcacgaaacattatctgtatggtgaatttcccgaatgctgtttgaccttggagttgttcatttaatgaaaaaaacttcaatgcctactatgtgcccagacctcttctaggtagagacgatacaagagtggtacagaagtgaacaacacaggtaagtggtctggcctacaaggatttcgcattctgggtattggagactgattttagcaggaacttaaaaagataatttcaggctgtgattagagctctggagtaaataacaaagagatatgataaaatgtaacctggggagtcaggcagtggctgaatggaggagggaggagacaacttcagagcatgagagggaagacttttctgaggccatgcctttaaggtgaggaacataagtaatcttttggagagctgggaaagttgttctggtacagggtaatatcaagtgcaaaggccctggggcagtgggcttgttgtatttgagaaacagcaggtgggtgtggccaaagcctaccaagagatgacactggagaagacaggagggtcctgtagtgtatgatacacaagcagccatttttacaaacaataactaaggcacctttccttttcagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggtaagatgatattcttggagctggcttatttaggaagtctgggtaccggcattaaataccccaatatggtcagagtgatttaaaaggaaaggcacatctcaaagcacagcagtggatgagattaatcttccatgtgtaggatttgatgcctttatgacatgaaataagtcaacattaccaatttttctacctaattttggcctaagtagctgctttaaaaggaaaagtaaaatttaactaaccctatgattgtttgtgaatttactgaaacattaactttaatgaaaataacttatgtagcaatgctcagatgcataagatctgtaatttaattacagcaatgtattcatcctcatagttaaaatcatgcagtttaccattcaacaatgttattttctgtaggagttggcggggcaaagtctatggcggatggttgggaaactgcaagaaggctggaccggccaccaatattagaagtaagaagttaaaaataactatggtttaaagtttttcttaaaagtattttttggaactttttcttttaaataaacttttgcacattttagaaacctcatatgcattgttctaaatgctaattactatgatttatattttccaaatttcccactgttttcataatatcagggcagagactcagaagcccaaacatactggtcattgccagctacgccaatgcatttttggaacattcctctgtttcttcaataaagaaacaaaaggagctgcgatttaataatacaaaagttatgaataaatgtgttgggagatctggggaagaaccactagtttagcaatgtttgatatctgtgtatctcaggattacaccacttatgtgaacttgtgatggacagggcgctctagagtccatgcagctgtttaatttggccagtaactaatttgagatagagaaaccaagatgaagtgaaacaaaaaatacaatgcctttcaatttgcaaatcccaccaaaaacttggtcagaaaagtgccctccccttcctaagttagatttcatgtcacctgatgctttgagatatcaatgaacagactctccgttctcaaaactaaggtttgaacgcacatcatgtatcagtataggtttgaccaacaaaatatgtaccttaaaaggtcaaaacaaactaattagaggaactatggactggaatagacgaagattgctgcacgtataacattttgcagggatctataattgacatagaaatttagaaaaacgtatctgggacccaatgaactcacaaattggcaagagacatttaagaaatgatagcaaagaggcaatttacatgaaagtgatttacacatcaggccacaggaaacactcttctatagtaagaaataaaagaaacacgtcaacctttttcacctgttggttttcgggactggtttcttgaatgactccaagttcgtttaccattttcttctcttctgaattccagaatgatgagaatggcattctcttggttccgggttgtgaatgggcagttttccgattggcacatcctggagtaataactcgaattgaaattgacacaaaatattttgaaggtaaatgcaaagccataaagaagtaccctataattggtttgtttattctaaagactgagttctatggaagtgggactgaggacactggactttcggtgtggattccccgtttaagctgtgtaattttgagcatgctactttaacccttagaactctgtctgtctgtctatctatctatctatctatctatctatctatctatctatctatcttttatttatttttttgagatggagtcttgctgtgtcgcccagcctggagtgcagtggcgcaatctcagctcactgcaacctccacctccagggtccaagcgattctcctgcctcagcctcccgagtagctgggattacaggcatcctagacaatacccagctaattttgtatttttagtagagatgggtttttgccatgttggccaggctggtctcgaactcctgacctcaggtgattcacccgtcgcagcctcccaaagtgctgggattacaggcctgagccactgcgcccgacccttatttatttatttttgagatggagtcttgctttgtcacccaggttggagtgcagtggcatgatcttggctcactgcaacctctgcctcctgggttcaagcgattcttcctgcctctgcctcctgagtagctgggattacaggtgcccgccatcatgcctggctaatttttgtattgttagtagagacggggtttcaccatgttgaccaggctggtcttgaactcctgacctcaggtgatacgcccgtctcggcctcccaaagtggtgggattacaggtgtgagaccatgcccagccaaccctttgaactttagtaactcctctataaaattcacatttgggctggatgacccccaaagtcacacaagattccatgacactgtccggctctttaccatagaggctctgcatcccccttggaaaaagagcctgtgaaaagcaccgggatgggaggcacctttttacagagaagggtcctaagcagattgaccggggaaggggagtgaccatttcttccccaggcttcacttttaaggcagtggtttacacatttttaaaaccgtacacctctatgtgtttaaaaaatatttggacaaacaaccttgatattctgtatttactttcttatgaaatacatatgtgtattattaagacaattcaaaagaagttggtacacttctacaattgttatgtgacattttataaatactggattgagtattccacgttagccatctttgaataaatagtggcattttgtattcatgttttgggtgagtggtttttatttttatttatttatttatttaattatactttaagttttagggtacatgtgtacaacgtgcgggtttgttacatatatatacatgtgccatgttggtgtgctgcactgggtgagtggtttttaaatgtcttgggaattattgtgactttactcaattactaaccattatatcaaattcaaggccaggctcatcattaacagtagtgcctataattatttcaagaagtcttggtaattttaacttattttggaaagacggcattttatctgttttttcttttaactattattttaggttcaagggtaaatgtgcaggtttgttatataggtaaacttgtgtcatggggttttggtgtacagattattttatcacgtaggtatcaagtatggtacccgataagtatttttgcctgatctccctcctcccaccctccaccttcaattatgccccagtgtccatgtgttcccattatttagctgccacttatgtaaacatatagtatttggttttctgttcctgcgttagtttgccaagaataatgctctccagctgcatccatgttgctgcaaaggacattatctcattcctttttgtggctgcatagtattccatgttgtatatgtatcatattttctttagccagtctacaattgatggacatttaggttgattccacgtctttgctattgtgaacagtgctgcaatgaacatacatgtgcatgtctttatggcagaatgatttatattcctttgggtatatgccaaataatgggattgccgagtccaatggtaattctgtttttagttctttgaggaatcgccacaacactttccacaatggctgaactaatttacactcccaccagcagggtatatatgttcccttttctccacaaccttgtcaacaactgttattttttgattttttcataacagccattctgactgggagattgtatctcccagtggttttgatttgcatttctctaatgattagtgatgtcagccattttttcatatgcttgttggctgcatgtatgtcttcttttgaaaagcatttgtttatgtccttggccaactttttaatggggttgttttttgcttgtaaatttgtttaaattccttatagattctggatattagacctttgaaagaaccataggttgcaaatattttctcccattccgtaggttgtctgtttactctgctgatagtttattttgctgtgcagaagctctttagtttaattagatcccatttgtcattttttttgcttttgttgcaattgtttttggcattttcatcatgaaatctttgccagttcctatgtccagaatggtatttcctaagttatcttccagggtgtttatagttttgggttttacatttaagcctttaatcaatcttgagttgatttttgtatatggtgtaaggaaggggtcctgtttcaatcttctgcatatggctagcccattatcccagcaccatttattgaattgggattcatttccccattgcttgtttttttaagactgcattttagatctggttatgtggccatggtttttacttttcaatgtggctgactgagggtcaggtgaaatggcagttctggattttcttgttcatacatacttgcattttttatggtatctttaatccacagttctctgcatgaatggtttaaaataacttacttatttttgtgagggatgctttagttaaaactagataacaaacagtaaatccacttaagcagacacccaaaactgcaacaggtcatgaatctaccactgtcaaacactcaggatacctctggtacatacaatatgatgactgtaatggaaatgagggagcatggcagtatccacttatagcaataatatagtaggttatatcaaatacacaaagcttaatatacacatacatatgtatgtatatcagacaaatagaaatagcagctctaatgttctctacttgcatcctttgtgtccgtatgcaccccaggggcatgttcgcccaccctggagactaccgttttaagagatgggccacaaagggggcatgtgagccacagtctcctcttttccagggttcttgattagcagctcctcctctgttgatcctaaagagctccagtagaagttctctcttctcaaagagagtgggacctttccctcaaggtcctctaaccccactgagcccacgattcctatgatattccaaagagagaagaatctcaggaccatatactctcacctgaagatgactcagaaatccccaaatacacgtgtgtggctggtgcccagcgctagctaacataaaactcagtatttccttttgattgtcatgttaaaaaatatgtcataggaaaatattttccagcttcataataatttcagatgagccacatagcagtctgcaagtaattaaatctgcaattgaggaagcttatcaaatacattcagatttcaaagtgagaacgctatacatgcaaattgaaatgcgccagccccttcacatatggcggactgcttctgagtcctctgaaaaagaaatgtctatttcatgagacaatctgagcctcacaaaccggtttgttccttccctcacatacttcatacctttgcttttgctcaggaagagcagggacttgttttttgctgggtttttgatcttattaaaaaagcatgatatcctatacgccaaactgagtgcaaatgcgggcagaaaatcacgctgtgttttgctccaacaggcaatgctcctgacagctgtaaagtggatgggtgcatcctgacaactcaggaagaagaagccgtgatcaggcaaaagtggattctcccggcccacaagtggaaaccactgcttccagtgaccaaggttcgtgtggcatgttattcggatccagcactcagactgtgctatttccctaagattctcttttgaaggattaggatacgctccaaagtttctgctcagtttaatggtaaaacgaatgaggtttaaaacccctatctgcaaactttaagaagaaaggctctatttctctccacttttgtatttccaaattttattagaacaaaattgttaaatgttcagaatacatacgtggaaacatgtctctgcatcatgtttaactttgtagaaggggcgactagcacatttaaagctctaatggcgtgtccacctgcaggatggatgctctgagatattccacaagtgtcttctttgatttagaaagagggtcaggctagaggtgagagctgctcccatgtaaagataggaaataatctccgggagagaccaagatggtctcttccttcattttcttatcaatttgcttatgtataatcaactattagaaacaactgatgggcatttaggttgcccatcaattgtttattggggcctgcttattcatgtattatttgggcatcctatccctactagcagattttcatggaaagcccaattatcatcaattaataacttattttaaagccccttcggttaagtctaagccaaaggtttgcccgggccgtgggctcattcggccacacatgtcctgttaacagactaggacctctgcatctgcttgcttttcagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaa

SEQ ID NO: 2323 - DNA, 57528 bp, Homo sapiens
gcagccctcggcagacggccaatggcggcggtgctcggggcgctcggggcgacgcggcgcttgttggcggcgctgcgaggccagagcctagggctagcggccatggtgagtgcacagcggccgcgtgggtgggggtccggggtcggggggcggtgcgaggcccggcggcgtcggctgagggaccagcgggactggggcgaacccggcgtgggccgagccttggagctcgggcgtcgggtcaccgcgtcccgggactgaccacctgtccggtgcgccgctcagagaccggggtggccgcagcctccgccacttgcccttgactttacacttccgccgaagcctacgaacttgccaaccggaaacaaatgggaacgaattttgttcagcaactacaaaaggcagatgtgaaaagtagttgcagaacaattcggtgcccgctgccgctcgttgtgctgaggacgaacggcgctgcgggcctggctccctatggcggctccctgctcgcgcttcactccaaggggaacccacagaggttttggaggagttattaataaattgtcttttttggtgacatattgacttttctttccttttccaaggggccgtcagttttcctgctgtagaaattaatattttggagtaaatggagggaaagttttaacatgcagcaccacctagtggaaaagtggtgcgttaaactcaccatctcattttaagttgcattttaaccgcccatttcagtttgaaatgttttgttttgttttgttttttcgacacggagtctcgctgtatcgccgagcccggagtggagtggcgcgatctcggctcactgcaacctccatctcctgggttcacgctattctcctgcctcaccctcccgagtagctgcgattacaggcgcgtgccatttcgcccaggtaattttttatatttttagtagagaggggttttcgccatgttggccaggctagtctcgaactcctgacctcaggtgatctacctgcctcggcctcccaaagtgctgggattacaggcgcgagccactgcgcctggcctgaaattctttaatagaagaatttttttttttttttttttttttttttgagaaggagaatcacgccgtcacccaggctggagtgcagtggcgcgatctcggcgtattgcaagctccgcctcccgggttcacgccattttcctgcctcagcctcccgagtagctgggacaacaggcgcccgtcgccacgcccggctaatttttttgtatttttagtagaggcggggtttcaccgtgttagccaggatggtctcgatctcctgacctcgtcatccaccctcctcggcctcccaaagtgctgtaatagaagaaatttaaaatagctcgaagacggaggaagataggcactccgccgcttcttgtccacgaaggggagaacacaagttgagtgcctactgtcacctaggcgtgtcttcaggcgtactctgccccaggtgctagtgatccagtaagattagggtgttctgggaaggaatgagtcaacagacatgatttgagcgctgccccatgccaggctcaatgctaggtaccctcacattcaagatctgtaatctaagcctttcaaaaaatcttggcaggtagatattataatatccccactacagacagaaggatcccggaattcagaaaagcggagtttagtatcccacagctaaaagtaacaaagttaggccttagatctagtttactctcttcaaatcctagcctaccccccatcccctgaaaaaattaagcccaccaccaagggttctgctgtgaatgtgccctcatgggggcctttgatgttatgtagatgaagtggctccatttcccagtcctgggtgtggtccctgctgctgggcaggtgtctgttgtgggcataaagtgcataccactgatcttagcggggatgtggatggtccagcactcagagaaaacagctcagtgtgttctacagactccaggttcctgccttattacaggcagcatgtttaatggttttctttgcagctactcagtgtggacacacataattctgtttcttttccaaaattctctgagttgacaaaataagtgtttaataagaatttcagaattctttctttttttttgagacggagtctcgctctgttgcccagactggagtgcagtggtgcggtcttggcgcactgcaactttgcctcctgggttcaagcgattctcctgcctcagcctcctgagtagctgagactataggcgcgtgccaccacgcttggctaatttttgtatttttagtagagacgggtttcaccatcttggccaggctggcctcgaactcctgaccttgtgatctgctcgcctcggcctcccaaagtgctgggattacaggcatgagccaccacgcctggccaagaattttagatttcttatgatagatgtatgtgtaagtttttcagaactgtcactggaaaactgatgaatgaatctcttttgattttttttttttaattgagtcggagtttcactctgttgcccaggctggagtgcagtggcacgatctcggctcactgcaacctctatcatccgggttcaaatgattctccttcctcagcctcctgagtagcagggactacaggcgcctgccaccacgcccagctaattttttgtatttttagtagagatggggtttcaccatcttggccaggctggtcttgaactcctgccctcgtgatccacccacctcggcctcccaaagtgctgggattacaggtgtgagccaccacgcccggacttttttttttttttttaagagacagggtctcactctgttgcccaggctggaatgcagtggtgatcatagctcactgcagcctcagtcatctggtctcaagtgatcctcccacctcagcctcccaagtagctgagactatggacatggtccaccacacccggctattttttaaaatttttttgtagagacgaggtctcattgcgttgcccaggctagtcttcaactcctggcctaaaatgatcctcccacctcagcttcccaaagtgccaggattacagatgtgagccactgtgcccagccctagtaaatgtttttttttttttttttgagacagagtttcactctgttgcccaggctggatggctgggattacaggcgtgtgccaccatgcccaactaatctagtaagtggtttttaacaacaagcttttgcatatttttgtttaattaaaaagtattctctgctgggcacagtggctcacgcctgtaatcccagcactttgggaggctaaggtgggcggatccctcgaggtcaggagtttgcaactagcctagccaacatgtgaaaccctgtctctactaaaaatacaaaatgttagctgggcgtggtggcatgcacctgtaatcacagctactcaggaggctgaggcagaagagtcgcttgaacctgggaggcagaggttgcagtgagctgagatcacaccactgcactccagcctgggtgacagagcaagacttggtctcaaaaaaaaaaaaaaaaaaggtactctcattctttccttttgttagttgtggggaagaatagccgacctagcaaagaagaaaaactagaaaactgatttattagtatttttttcttcatagaaaaagttgtctaaaggtaaaatctttttcctctcttaatattagtgataaatgattttgggatttctgaagtgggagtgagttgcagcttaatggcagagaatccagggaatgcagcttagcccacagttgccctttgatgaggagccttcactaatgttcatctttctgggtgacagcctctctctcacctgagcctacagtaactctgcaagtaggtaaggcaagaagtattgcctggaatgagaaccctgctttcctgacttctagtcaagtgtccatatcttctctctggccctgatgtttaaagttatttcagttaaaaaaccaatagcatgggaagtgtgggcctgttaaccaacagaacctggctttgtgaatgtcatccccaggatgcgtagaaacaggccagacagtgcacacaagtgctttggactgggcagtactctggccaaactatggagagagtttgtctgactggtgctctgagaagagggcttcataaacccaccccactgaggccagggctttttacctgtagtccagaggatctgtggacccccagaagttagataaaatcctatgtaaatgtgcatttgtttttccccatccggggattggttttcattagatgtgacaggagatggtaattccaaatagttaaaaccatctttcattcctttgttctcaaaagacagaccaaaacaaggctggctctgtacaaaataagctgtctctatggtatgttccctctggcccccttactgctgcctcaaacgtcacagttcagcttctctggcttattagagatataacagagagtagtgaaggctactgaggtgatgtagggccatccaaagagcaatagaccaggagtttggagccttgaattttaattctggtcctgccaatagacttgccacaagtcctagaattctgcagtgtccaagatggccggtggtaatagtcaatctttgttgtatctgtaataaaccacagaagggccgggcgcagtcactcatgcctgtaattccagcactttgggaggtccaggtgggcagatcacttgagctcaggaattcaaggccagcctgagcaacatggtgaaaatccctctctaccaaaaatacaaaaaattagttgggtgtggtggtgtgcacctgtagtcccagctacttgggaggctgaggtgggaggatcatttgagcccaggaggcggaggttgcagtgagctgtgattgcaccactacgctccagcctgggcgacagagcgagaccctgtctcgaaacaaccaaccaaccaaccagagaagctgaattgtgaagtttgaggcagcagtaagggagccagaggtgacatgccatggaggcagcttattttgcacagagctagccttgctttggtctctttaagagaacaaaggaatgaaagatggttagaatttgttgcctttcagacttttctacatctctgcttaaggtaaggagccataagtttgagtttgagtaaacttgtacattttcagatatgaaatgtgttctcttcatagtcatcaggtactcacaggttgactgcagaggagaggaaccaagctatacttgaccttaaagcagcaggatggtcggaattaagtgagagagatgccatctacaaagaattctccttccacaattttaatcaggtaattgttataaattcttgctagggctgtggtctattttagtcaccttaggccataacactttctgattctgccagttgtctggtcccatgtagatctaggattcaactcttcccttctttaagaattcagtgatagagtgacatccttgttgacagttgctaccacccacctgggtggtgtttagctctgggggaagagggtggtttgtgttacttggaaaacaaattctgaaaccactattgctttggtatggtgttggttaggatatgtagtttcttttgaaatttcaaataacattaaaagagagtgtaagccttttattattgattattattttttgagacagggtcttgctctgttgcccaggctggagtacagtggtatgattgtggcttactgctgcctcgacctcctgggctcaggtgatcctcccaccttagcctcctgagtagctgggactacaggcatgtgccatgcccagctaatttttgcattgtttggagaggcagggtctggctatgttgcccagactggtctcaaattcctggcctcaagcgatcctcctgccttggcctcccaatgtgctgggaatagagatatgagccactgtgcccagcctgagctttttatacttatcagaaaggggcatgaataaaactggttgaggaagatgtacctgcttgacttattttccctgactttttctgggccgttggtaatttttctttcttcctgcagttaaatttctatctctcagtcatctcccaggctgcacccttttccctgactggcttatttttctccagcccagtagccagatcctgaaccttttcttaaaacctgacctcccccttggaagtcagctttaacaaggtaactgttccattagggacccaccctgtttagagagtcatctcccatgacttaaccttcagttattacaccactgcatttgtaaaaggtaaatgcttttgactattttgtttgttcagttagtttggtaatcctttggacagatttattgtttttatttatattgggtgtcggcatctagaagtcagagaccatgtttgcttaaataactctctattgtacccaacacagttctgggtacaaacaggcatttgataaatgcagacattgattacagtgtttgctagtttctagaagggtgtgtgaggaccagatttgcaccaaagaaaccttcggcatgttttcctagtaaatgtcattggctccactgagctgcatgcccgattctgttctctatccatctggctgccagcctctgctgtgagtctccaactcctaaggaaacctggaccaagcagactccctgtccccgctgccccacgtgctcaacagctcttgttaggggcttagcacgctgtggctggtggcagggaatcccattggtacagtaagcctgtgcataagctctaggtagcattttccaagcttattaaaattcttacatatgtacagcttgacttctttaaacctggcctaatttattgggcttgaacatgtggcttaaagtactcgaatggtgttgcctcaggccctgcctatgattcagtcctccagcaccattctgaccttgcgctcagggtgactttcagcaatggtagggaagcatactggattgattgtaacattattcactggggcatttaattaagtagactttttttttcccattcacccaacttttaggaaaaagaggcagatgacaagaaaatcagctgatgtcagggaatgtattcagagaaccaacactgagattatatccgggggtcagttttcccactaggctcctatgacttctgcgtgtaccatggcctgtaatggtaactggtgtcctgacagttgtcagtgccctccagcgaaacacaactaggaacacacctacagtcgaacaagttgagcttattgcttattgctgtgagggagagtgcacaccaaagggcaccgtggggtgagcccatataggatttgggctgtggtagtgatttggggactttactctggattagatgctgtcaggaaatgggcaactctgtcatttggtattttaataaatcgtatctatagggagagtagattaaagcagtgccaaagctgaaactgaagaagaagcaatagtcactcattagctgggagaggaggatgtttggtattttgtggcttggacaatgttcatgttttgtctgtgttcaggtattgcagagtggtcttgtttttgtcttcatccatcatggtcacagagtggccttgtctggtgttgatgttgatgttcgaaaggagagcaccaaggactggttgatagtaccaggccagcgcccaggtgtcaggagttggttttctcttgctcacaactcgtgagtagagtagtgaccctctggcgctgatgggtcctcattcatctttcatttaggacagaaaagccattgttttttattgtaacaacagcataacattaaaataggatggtgtaagtaaaaaaaatttccaatcgcaactacttttatttttctctgttctcttctggtctttctccatgggtatgtttgtttgccaagtatgccagagcatgccagttatacatgtggttacatttaaaaaaattttttaaattttatcatgaaatatttattaattcaacaaagatttattaagcattttctgtgtgctaggtgctactctaagctcatacagctcccatcccagtgggaaaataaacaataaacagatgaataggaaatataatttcagctagtgatgagtaccctgaagaataaagtagggaattggagtggagggggacagaggcactcttggaggtagagtggtctggaaagtcctctctggggaggggatctctgaggcctgaataatgtgaaggagctcagcacatggtgatccaagggaagagctttccagctggagaacagcaagcacagagtttccaaagcagaatgaccttggcatgattgagccagaagcagaaggccagtgtggagtggagcaggcgaggagacgaggggaagggtcagagcatgggggccttcttggcgtggtgaggagtttggattttattctgtgaaggaaagctaatggaggatttcaggcagagaagtgtcatcctgtggctgtgttctaaaaaatcaccctggctgttctgctcagaataggcggtaggaaggtcagagtggaagcaggcagactctgtagaacactgttgcagatgtctagaccggggatgatgggggtcttatggaggtatcagtggggatggagagaaatgtagggttccacatattttgaaagtagaataatcaagacttgctgaatgattggatgtgtgataggggagggtcaaggatggcaccaaggttttggttcaagctatagtgtaaagggtagtgccactggagccatttactgagctgtggaagatggggtgcaaggtggggggcaggggtatggaggtgagaatcctgttttcacatgtcaggtttgaggtacttattagtcatccaaatggagttattgggttaggaggtgggtgtaagaggctggagttcaggctgagacagcagtttgtgagttgtcagaggggatcactgtgagagcatggtccagttaggcaggagaggacaggatcagatgggcagtggaggcacagcgatgatatgtccattgtggtttagatgccaataggccgttacattcatcctgggaaaaagagggccattctctcctgattgcttttgttttttagtgagatcatcaattgagagcaagtaggggtggaagggaagagtgttggagacctggggagataagagaaggagtggaatagtcattttggagactaagatagtgaaaaaacttgagaaacgtggctggttgctaagcagttctcagtgtcactacagatttggggtcaaacatttaaagtgaacattttgtatgttttttttcctgctgtgttccgctgctgtgcacaagctggagtagatgcagagttgggcttaacaaggactgaacttttgctaaatgaatgcaatggaggaacagagggacaagggaaaaaagggagggacagaaacgctggcccttggagtctcggcagggtagggaagtacagttgtgatggggaggtgatagtgatgagctgagagtgtcatttgacatcatctatttttttttttttcagatggagtttcactcttgtcacccagtctggagtacaatggtgcgatcttggctcactgcaacctccacctcccagattcaagtgattcttctgcctcagcctccagagtagctgggattacaggcgcccgccatcatgcccagctaattttttgtatttatagtagagatggggttttgccatgttggccaggctggtcttgaattcctgacctcaggtgatctgcccgcctcggcctaccaaagtgttgggattacaggcatgagccactgcacccagttgacatcatctttttgaagggaaattgagcaatgcctatcaacttttaaaactcacataccagagccgggcgcggtggctcacatctgtaatcccagcactttgggaagctgaggtaggtggatcacgaagtcaggagttcgagaccagcctgaccaacctggtgaaaccctgtctctaccaaaaatacaaaaattaaccaggcgtggtggcgtgcgcctgtaatcccagctactcaggaggctgagggaggagaatcgcttgaacctgggaggcggaggttgcagtgagccgagatcacaccatttcactccagcctgggtgacaaagcgagactgtgtctcaaaaaaagaaaaaaaaggacatatccattgtcctaacctagaaatttatcttctaaatattgttctgcatgtatgcaaataggatgtatggggatgtctattaaagcctgatgggcctctaattttttttttttttttttttttttttttgagacagggtctaattctgttgcccaggctggagtgcagtggtgtggtcatgactcactgcagccttgaactccctgggctcaggcgatcatcccacctcagcctcctgagtagctggtactacaggtgtgtgccaccatgcctggctaatttttgaatttttttttgcagaaagggggtttctccatgttgcccaggctggtcttgaactcctgggctcaagtgatcctcctgcctcagcctctcaaagtattggggttataggcatgagccgctgcaccaggcctctaattttttattgtgagcagccatttccatgagcatatgcacaccatggtgagaacatatctcccttgctgcaaccctgccctcagtggggtttaagggaggcctgttgtgctccatatactcatagcaatggcagcacctctcctggcctgagctctacagactggacaaagccacagtcagaactaaagacaccctctccctgaaagagtgtgacccacacttggtggtgtcatattggaaaaaaatttgggggccaggcacgatggctcacgcctgtaatcccagaactctgggaggccgagttgagtgggttgcttgagccaaggagtttgaggctagcctgggcaacacaaggagactccatctctacaaaaataaaaattagccaagagtggtggcatgcacctgtggtctcagttacatgggagggaggctagggttggagaatcatttgaacccaggaggtagaggctgcagtgagctgtgattgcactaccacactccaggctgagcgaaagtgtgagactatctcaaaaaaaaaatctttgctgaatatagggttaaaaaattcattttgtttgtattgctcaataggttatgagcatttttcagttctttagtctttttatttttaatacaattttcaggagtatgattttacttggttgggtgtcacagttaaatgatttgctaatgtagtttgtgtacagtggtatcacaagtttgctttagtcttcatttcttttgctgctatgaaaaatgaactattttggaaatatttcagtgaccgtggatgaaaaacctatttcttgaagctttgagttattccaggtttactataagaataaatagcccccaaaacacatttgaacttcttttctctcagagttttattctaaggtatggttagttccaaataatccaaattcattggatagctcagatggatacaaatacttggagattataagtacggagttttcaagggattctcctagcataggtggatgaagtagccataggtgtcagttgctgttagcctcctgtttccacccttggtggtggtacatgggctctgcagtgcgtcaatggacagtatgttggtgacagacagtgactctgtgagcagacagagcatggcagtggtgggactcgaggcagggagtttccacactaggagtgcttggacccagacagggtgggattggcatttgtaaaggaactttgcttttttgttgttcctgtagacagaaggtgggagaggtctgcaagtgacatataaacttaggtgtttggtaactgcaggatgtctgtgttgaaagaacaaaatgtcaggtagaaatgtgggtgtgagagtcccataaagacagattttgttatgcattgacatgtatgggatgaactggaagcttacaaaatccgaggagattttaagtttaaaagtaggtgcagaaggtgaggctttggaacctaggaaatagctactacaggtgccagcaggtggagccctccagggcaggagcccagccgggccaggcggcaacacccctttctgccccccagaaggctgtccctgttctttcacttctgaatacctggggctacccttgttcagcatggaaataagctcaggatcaggaacaggtaagcggcagtggctgggcgcttgggtgaatgataaattttgtgtgtaggacatgaggagtttccaatggtgattcaggaggaagggaccaagctttgtgagaatcagcggtggttctctgcggaggagctcctgggccctgtctgtgctttcttcggtgggcctgcccagcagggcattcagtcatattggatggaatcatatgagctggttgatattcagggcaaagtccaagctttattggttttgtatcttgttcatcaccctcaccttttggttgctgtgctgctgccactgaagctttctggagctgcagcgggagggaggaggagttctctgggtgcccaggctgggttggtggtgctctgcacatcctagcagcagtagcaccatatgtgactttggggttcgtaaaatgtttcttttcctgtgtccacagagactcctgtgtagagcagttcaaagttacttttgctgccttactttataaaaatgttttattgaggaatttgataataggcttatggtgaacattttgaaacacttagtgaagtcaaaggcttgatgataccagaagaaagacaactgctgatgaaagtcttaacaatcctccacagaatattggtggaagtctcgatagctctcattgtgaatgaattagtttgggtttgattgttctttgttgtgcacatcaaagttatgagtgagtaatgcatctgtgcactctttaaagaggatattctacctgtggaggatagggaagcactcccaaagaggatgcctgtggcctgggcatcatataggttagaaaatgtcattttgtgctgggcatggtggctcacacctgtaatcccagcactttgggaggccgaagcaggcgggtcaccagaggtcaggagttcgacaccagcctggccaaaatggcgaaaccccttctctactaaaaatacaaaaatcagctgggcgtggtagaaggtgcctgtaataccagctacttgggaggctgaggcaggagaatggcttgaacccgggaggcggaggttgcagtgagcagagatcacggcactgcactccagcctgggcgacagagtactccatctcaaaaaataaaataaaataaaaattaaaaaatgtcgttttgatttgaaagtataagctagtgtttgtgtgtctggcaccaggtaaagtgaaaactcgtatggctgtcacacacactgttgcatttaacatgtgctcatgattggctttgtaaccacagcagactagaaacctgagaaagtgttcatagttttcattggaatagaatagagacactcatattttagcaaactttacctaaagtgtgagaagctagtaaaaatatctgtgtagtgttcatgttggtgttccctttggagttcttcctgagcaggaccacgctgatgctcccaggaggtggctagaatgtcagtgttggcgtccaccagggtagggaaataagagcctgaaatgttatcatttggagctttgttgctgctgattgtgtcgtacagtaggtctagacctggcgtgtatttgtaaaagcgcatgcaacagatagatgaggagaaatgtaaaacaggtgtcaacaatgcaaatatgacaccacactgcagtgtgaaaacaccatggtccttacaccaccctttaataaaaatggacttttaactgcataatttgctcttagtcatgtagtaaatcttctgtttacagaacttagcctgagtattttgttaaagtcaagcagccaagaagtataatttcctcaacagtctttgtcttgcccttttacagatggagtaaaatcaggtgtgtaaaaaataaaaaagcagtttgagctgacgtgaaaggtatttcagatttatgctttgcagatgatattggtatgattaatgcattcattgcttttttttattgcttttcacagataatgtacatgatgcatggaaaatgttgtgggtttaaatctgtgccaggtttagactgtgaatatcaacagatgttatcatataagtaccataattattataaaataaaaaatttgtcatgaaatgcagtgacataaatttcatttatgtaaattgctttcattagtataaaaccttagtgtagctgttagggtctgtgaagcactttagatgagattaacttggtataaagtggtcacaaatgggttgctttaaatttaactgacaagaaaataacacccaaaacttaggaaattgctgaggcatttgcctgcattgctggtaccgcttaaataggttgactgtgaattaataacaatagactgctggctcaataattgcagaaaataattgaaaggagaccttaaataataacttaaaagtattttggtcttgctcatttctgttctgtttctgtttttcgttagtatgcctgcccaccgcttcagtactgccattatcaatagctttcgggtttgcactgcagttttgtccatagttgtggtgctttagggccatgacacagaacttgcatttagatgtgtcagaatacaaatattgggtgcctgatggagcagctgtagtggctgagcagtgctgcactcacattcctgtggctgggtagcggccagttgctttctgccctcaggagggattcggtccagcggtgtgggcaggtggctgaggttcttcttcctggctttgagctctccatgttttgctctttttcttacatccttttaaacaaaacaaagcagtaatattctctcccctgtgttgcagagaattactattatgttgcgcttttgatctaggttagagtggggcattctgactcatttactgaatttcgcagaaagacactaaacaagattgagatcatggaattacttgtggtcatactgggtcatgtcacagttaccagatgcaagactcacatccctggttcccacagcaacatttttagatcctactgtgacatagaaaggttgtttttttgattttgttgttttaggcgagatcttgttttccaaggactacttgctggattagttttctcccttaaatgggttttaccatacttcccagaggaagggaatattcgccagctgaaacaaacaaagctgtacttgtttgggagtagcccaggtatcactgttgagcaatcaaaggtcatttaattgtatcattaaaatcaatcctatcaaaacagcaaatgctgctaatgactctgtttgcttgtgtgctctctgccaacagggcaggatggaggcttttttttttttttgagacggagtctcgctctgtcggctaggctggagtgcaatggtgtgatcttggctcactgcaacctccacctcctaggttcaagcgattctcccacctcagcctctcaagtagctgggattagaggcacctgccaccaagcctggctaattttttgtatttttagtagagatggtgtttcaccaacatggccaacatggccaggctgtacttgaactcctgagctcaagtgatccgcccgccttggcctcccaaagtgttgggaatacaggcgttgagcccagctgctgaggctttttgctatatcatacatcaaactgacttcaagtgccctgtcctcgccatcgcagccctgtcggtggacatgcaccaggtgggtggagcagccccaggctggctgggccaggagtcacatggtgtggttctgtcaggattcgtgaacccagcagagctgttgggcttatatccactgaggggctagtgctggtctggatccaagaggtggaaggaggaagatgcaacagaaggacctggtttcgtttctgcccagaagatctcctagttttgctggggaggtggcacatctgaattgtacaaggtgattgatttttttcagcttaccatgttagtcaggtactagaatgtgaagtgctgtgctaataagccacaggaggtgcacttcagggtggctgctgcctggagaaggggagttttgagttggttcttgaagatctggtatgtggttgtaagggaaggcactaagggaggggttagcaggtgacataggtctaggacagggagtaagaggacatactttgtctgcagtgtgttgggaaataagggccctaaaatgggttcagtgagctgggccacagagtacaggggggttcctgtggcgtactctcctggggtagctttcccaccagtttagggtgtctgaaagcaaactcttgtctctctaactgtccttcaaatggcttgttcctctcagtagccacaccagcatcctctcaagcacctagacctgaaacggaagaattatcctggtgatttgttaccaagaactggtcagtcgtcctgtagtgcctttcacaggactgtgctgctggcctggatacagctgccttccctctagagttctggtaggagcttcctggccacatgttacctttaggctcttcctgcttccactggcctgcgtgccactttgtcatgaccaagttggtctctgctcagataatctcactgccttccaattatattttatagggcatgcttcatcttctcagaggttttcaaagctgcccacagcccagccctaagcctacctcgcattactctgcaagaagcctctttgctcagagattagaactgcaatgttcatgagaggtcacctactcatccctttcactgaagaagtggggaaaacaaggctcagacagggtgagtaccttgaccaaggccacaaaaattagtgtccatgcaggaattggaaccaaggcccttttcatctcagttcagtggtttttttgtttttgttttgttttgtttttagagatggggtcttgttcggtcacccaggttgcagcctggaactcctgggctcaagcgatcctcctgcctcagtctcttgtgtagctgggattacaggtgtgagccaccacacccagctcctcagttcagttcttttcttcctttattcaaactgttcttctcctttccatgccccatctcacactatcctgccccttctgttcacatcccacctatttctagaaagtttttcttgatttttatgcacttaacaataaacagttatcaaacacttactgtaggctagacactatgccagacactggggtatcagttaacaaagccgatactgtccttatcctcacagagcatacagtatagtgggggagggagaatgtaaacaaagaaaaaagttaatgtatcattacaagttatgctaagtgccaggaaggaaaatctttttttttttttttttgagacggagtctcgctctgtcacccaggctggagtgcagtggcgtgatctgggctcactgcaagctccgcctcctgggttcacgctattctcctgcctcagcctcccgagtagctgggattacaggtgcccgccaccacgcccagctaattttttgtatttatttatttatttttttagtagacacggggtttcaccgtgttagccaggatggtctcgatctcctgacctcgtgatccacccacctccgcctcccaaagtgctgggattacaggcgtgagccacctgcccggccctaggaaggaaaatcttaacagcaaatggttagtgaacacttaaactatgggtcatggcactatgggaaggactttacatgtattcattcatttaatcttcacagaactctgtgaaatagatttcccaaattttacagaggaggaaactgagacttgctaagtgacttgcccaaggtctcacagctagtaagtgtggagtcaggattggattccaggcaatccatactgttagtggctcagatactgcctctgcatcagaaaggagtgctgtgagagagaataatgggaagacctaattctctttgaggagcatggttagggaaggcctaaccatggtgagaatagtgttaacgtcattagggtgagaagaaagagaaataagccgaggatgtctttgattgtgtagtaggggtggaaggtgattttgtcggaatgggaggtgattcctagggggttgtttgatcctgtttcgtgtaggaatagaaggtggagcgctgctagggctgtgataatgaagggcaagataaagtgaaaggtaaagaaccgtgtgagggtgggactatctactgagtagcctcctcagattcattggaccagatctgttccgatgtatgggacggcggatagcaggtttgtaattactgtggcccctcagaaggatatttggcctcatgggaggacatagcccatgaaggctgttgctatagttgtaagtaggaggatgatgccaatgtttcaggtttctaggtaaagaaatgagccgtaatataggcctcggccgatgtgtaggaagaggcagatgaagaatattgaggcgccattggcgtgaaggtagcggatgattcagccataatttacgtctcgggtgatatgggcgatcgatgagaaggcggttgaagcgtctggtgagtagtgtatggctaggaatagtcctgtggtgatttggaggattaggcaggcaccaagaagtgagccgaagtttcatcatgcggagatattggatggggtggggaggtcgataaatgagcggttaattaattttatcaaggggttaattttgcgtattggggtcattagtgttcttgtagttgaaatacaatgatggtttttcatatcattggtcgtggttgtagcccgtgcaagaataatgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaatagattatgtgattaggagtagggttaggatgagtgggaagaagaaagagaggaaataaagtttgattatgcctttttgggttgaggtgatgatggaggcggagatttggtgttgtgagattgttttaggtagtagcttttctagtcaggccaggtctaggaggagtaggggtaggttttggcttgtaagaaggcctagataagggactgtgcggtgtatgatactagggtaaaatccgagtatattagagaagtaaaatgtatacagtggggattttattttgagtttgttggttaggtagttgagatctagggctgttagaagtcctagggaagtgacgcctagggctgtgagttttaagtaaagtgggattgtcatttggggggtggatgtggggagaatgctgttggtgatgagaaaccctgcaaataggcttccgattgttaggcgtttaatggggtttagtagggtggggttgttttcgttaatgttagtgagggctgggaagcgaggctgacctgttagggtgagaagaattattcgagtgctataggcgcttgtcagggaggtggcgatgagagtaatagacagggctcaggcgtttgtgtatgatatgtttgcggtttcgatgatgtggtctttggagtagaaacctgtgaggaagggtattcctgccaatgctaggttgccaatggtgagggaggttgaagtaagaggtatggttttgagtagtcctcctatttttcgaatatcttgttcattgttgaggttgtggatgatggatccggagcatataaatagtatggctttgaagaaggcgtgggtacagatgtgcaggaatgctaggtgtggttggttgatgccgattgtgactattataagtcctagttggcttgaagtggagaaggccacgatttttttgatgtcattttgtgtaagggcgcagactgctgcgaacagagtggtgatagcgcctaggcatagtgtgagagtttggattagtgggttattctctgctagggggtggaagcggatgagtaggaagactcctgctacaactatagtgcttgagtggagtagggctgagacaggggtggggccttctatggctgaggggagtcaggggtgaaggcctaattgagctgatttgcctgctgctgctaggaggaagcctagtagtggggtgaggcttggattagcacttaggagggttatttgttgtgggtctcatgagttggagtgtaggagaaatcatgctagggcaaggatgaaaccgatgtcgccgatacggttgtataggattgcttgaatagctgctgtgttggcatctgctcgggcgtatcatcaactaatgagtaaaaaggatataattcctacgccttctcagccgatgaatagctggaataggttgttagcagtgactaggattagtatggtgattaggaagatgagtaggtatttgaagaattgattaatgtttgggtctgagcttatatatcatagtgagaattctatgatggatcacgtaacgaacagtgctacagggataaatattatggagaaataatctagtttgaagcttagggagagttgggttgtttgggttgttgcccagtgtcagtttgagataatgacttcttggtctaggtatatgaatattgttgtggggaagagactaataacaagggtggatgcgataatggattttacttaatggggatatgagttttttttattagggttaatgagggtggtaaggatagggggaattaaggaagttagggctagggtgggtatagtagcgtacatggttattacttttatttggagttgcaccaaaatttttggggcctaagaccaacggatggctgttatcctttaaaagttgagaaagccatgttgttagacatggggatatgagttagcagttcttatgcgctttctcggtaaataaggggtcgtgagcctctgttgtcagattcacaatctgatgttttggttaaactatatttacaggaggaaaacccggtaatgatatcggggttgagggataggaggaggataggggataggtgtatgaacatgagagtgttttctcgtgtgaatgagggttttatgttgttaatgtggtggctgagcgagcctcattgtgttgtggtaaatatgtagagggagtatagggctgtgattagtatgttgagtcctgtaagtaggagagtgatatttgatcaggagaatgtggttactagcacagagagttctcctagtaggttaatagtggggggtaaggcgagattagtgaggcttgctagaagtcatcaaaaggctattagtgggagtagggtttgaagtccttgagagagaattatgatgcgactgtgggtacgttcgtagtttgagtttgctaggcagaatagtaatgaggatgtaagtccgtgggcgactatgagaatgactgcgccggtgaagcttcagggggtttggatgaggatggctgttactacgagggctatgtggctgattgaagagtatgcaatgagcgattttaggtctgtttgtcgcaggcagatggagcttgttataattatgcctcacagggatagtacaaggaaggggtaggctatatgttttgtcagggggttgagaatgagtgtgaggcgtattataccatagccgcctaattttaagagtactgcagcaagtactattgacccagcgatgggggcttcgacatgggctttagggagccataggtggagaccgtaaagaggtatttttactataaaagctattgtgtacgctagccatattaagttattggctcaggagtttgatagttcttgggcagtaagagtgagtaatagaatattcagtgagcctagggtgttgtgggtgtagattagtgcgatgagtagggggagggagcctactagggtgtagaataggaagtatgtacctgcgttcaggcgttctggttggttgcctcatcgggtgatgatagccagggtggggataagtgtggtttcgaagaagatataaaatatgattagttctatggctgtgaatgtcataattaaggagatttgtagggagattagtatagagaggtagagtttttttcgtgatagtggttcattggataagtggcgttggcttgccatgattgtgaggggcaggagtcaggtagttagtattaggaggggggtcgttagggggtcggaggagaaggataaggagcagctaaataggttgttgttgatttggttgaaaaatagtagggggatggtgctaataattaggctgtgagtggttgtgttgattcaaattatgtgttttttggagagtcatgtcagtggtagtaatataattgttgggacaattagttttagcattggagtaggcttaggttatgtacgtagtctaggccatacgtgttggagattgagactagtagggctaggcctactgctgccttgcaggcagcaaagactagtatggcgataggtacaatattggctaagagggagtgggtgttgagggttatgagagtggctataatgaatagtgatagtattattccttctaggcatagtagggaggatatcaggtgtgagcgatatactagtattcctagaagtgagatggtaaattctagtataatatttatgtaaatgagaggcatttggtaaatatgattatcataatttaatgagtcgaaatcattcgttttgtttgaactatataccaattcggctcagtctaaccctttttataatcattcgtaggccagacttagggctaggatgatgattaataagagggacgatgtgactattagtggtaagttagttgtttgtagggctcatggcaagggtaaaaggagtgaagggtattaagaatgacttccaggctgggcgcggtggctcacgcctgtaatcctagcactttgggaggccaagacaggcagatcacgagatcaggagattgagaccatcctggctaacgtggtgaaaccccgtctctactaaaaatacaaaaaaattagccaggcgtggtggcgggcgcctgtagtcccagctacttgggaggctgaggcaggagaatggtgtaaacccgggaggcagagcttgcagtaagccaagatcgtgccactccagcctaggcaacatgactcccagatttcgggcctggaggaaaggaggaaataggtggctggaagtgatatttactgagctggggaagtgtgggagaggaatgggtttgggatgcagggatcaagatttctggtttggacactgtttaaggagtgctgtgagacatccaaatgtcaacttccagaaaatttatgtctgaattagaaagccagaggtgaggtctgggttggagataattggagaatcataggtatttatggaaaaaagccaaggtaatagatgagatgactcaagaagaaattatagtgtgagaagagaggatggctcaggacttggtccatttaggggtgagttagaagaggaggagttggcaaagacaagaaagatttgttagataaatggaaaaaggctgttggctcttgcctgtaatcccagcattttgggaggccaaggcgggagaattgcttgaggccaggagtttgaggctgcagtgagctatgattgtgctactgcactgcaacctgggtaatagagcgagaccttgtctcaaaaaaaaaaaaaaaaaagggaagaaaatcaggtcaatgtcatgtcacagaatccaaaagaagatggtgtttcaaaaggagggaagtatgaattctgctgagacaccaagtaagatgagtaccaggggatgcccattggaggaagcagcatggaggacatcagtgaccgtagcaaagttggtttcggtgggtggggcacaggacagcctggagaggaggtggagatcttatgctttatacagacctggtagtctcagacattagtctgttgtcttttctttccatttagaattcattcctagacttatacttgtttgtggtgttctttcagacttattttttaaattaaaaacattgtttttagagatggggtcttcctctgtcatctagccttgagtacagtggtgtgatcatagctcactgcagtctccaactcctgggctcaagtgatccgcctgcctcagcctcccaagtagcttggactacaggcacatgccaccatgcctggctaatttttaaaacattttttgtagagacaaggtctcgctatgttgcctaagttggtcttgaaatcctgacctcaacagtcctcccaccccaccctctcaaagtattgggattacaggcatgagccatcgttcccagcccagccttgttttgatattaattaagcatcttagagctttgatatagggcctatcaatattagagctagaaaggatggggcaactgaagcccaggggtaatgtagtttgcccagggtgacaacgaactagtggcaaagttaggacaagactaaatgcaacttagattatgaacagggtcatgtaactgtttactcatgtctctctccagctaaggtataagcagcttgaggacagagacttggattgtacctgtgtacatctcccatagtacctagcccagggttacctagttgtattttgaatgcatgagggcccatgattaggttccccatgggtgatcctagtcagtgcacttagtcccaggggaacatagtgtttcatctttttgttccctgtaggatacatacaaccctttctcaccagggacttttcctctccctcatctccttactcctagatatcgatgattcctaatggtgaccagcttatctggctgctaagttgctgtgtctgagagatgagagagggtgctctgcattgccacagggtgcttcccagaacagcagcattgattgtgcctttgttctgcatgcagtactgagacatcagagaagaaaatggctgctcatggtgtctctagtcagttgtctccaaccatgagagagactaagactggcattcagtattttagcaccacggtttcagccacccacaactacagccacaatcggatgagaatattgatgtcctgagggccagtggcagatactcgaccaaataccacactgggaggctgccacaggcctgttcgctggctatccattaggcattcatttctgtttcaagacaattctttaatctcaaattctttctttccctttccttttctgtgaccactggtccagcgttcttggctgatttttctttttctttttgttttttgagacagagtcttgctctgttgcccacgctggaatgcagtggcatgatcgtggctcactgcaaccttcacctcccaggttcacgccattctcccacctcagcctaccgagtagctgggactacaggcacccaccaccatgcccggctaatttttttttatttttagtaaagacagggtttcaccgtgttagccaggatggtctcgatctcctgacctcgtaatctgcctgccttggcctcccagcactttggccaccgcgccggccttctttttcttttttttgaatcataacttggtggtgtgctataaagaaaagctaaaatatattggcagtaatttgaggaattaattttagaaatttggatataaaaatgttgctttaaggtcattctgtacacaggtaactcttaatattgcatcatttacctgaaatgcagccaaatcagttttctttgtgacagattagagggttacaaagtattttatgaactaatgagtgtttgagtgtctattgggtatagtagctcattgttaggtgacctatgaactaacataggttgtttcattgaagcttcccagaagcctcctaaggttaggtgttcgtattcccattttgctaatggtggaaaagtcagggaagttaaagagcttgctcaaacttccagaggaagtgggcagtgggaccatcattccaaggccagatatcccaccctaaggtgactgctcttctcttaacacaagtctgtattttgaagaattgtagaataacaaaggatatggattgcagttttgtttaggaatgtcttagagctttgaatgggcaactctgctattcagaattgaatctgttctgtttaggaagaaatgtttattttggagtgcttaaaggaggcgtatgttatttgcatgttttgaagaaaaagattgccagctactgaaaggaatttgacttgtaaattgctacatggttccctatgccctaccctgaaagcattagtttataatactggattgatcaatgatcagttctaagtctgttacagattggaggtgagcatctatctagaggggaaagtcacttccagataggtctgcagagagcagctgaaaactttatttggagaagtggaactctgcatacagaagataaacatcgaagccactaaccgtatagctgtggatacagatgcatagaagagagggccattttaattctgagtttctttaaacaatttttttttgtttctttttattattttttaagagatggggtctctgttgcttagattggagtgcagcgacgtgatcgtagcttactgtagcctcaaattactgggctcaagcgatcctcctacctccgcctcctgagtagctgggactatagatgcatgccacattgcctggctaatttttttttttatttgagttgtagtcttgctctgtcacccaggctggaatgcagtggtgcgatctcagctcactgcaacctccgtctcctgggttcaagcaattctcctgcttcagcctctcaagtagctgggattacagggatgcgccaccacgctcagctaatttttgtatttttagtagcaacatggattcaccatgttggccaggctggtcttgaactcctgacctcaagtgatcccccctgccttctcaggcagggattatagatgtgagccaccatgcccacccctggcaaattttttaattttacttttttttgtggagatgggatctcactatgttgcccaggctggtcttgaattcctggcctcaagcgatcctcccatcttggcctcccaaagtgctgtgattacaggcgagagtcaccacacctggccaattcggagtttcttaaactatgattctgttatgtaagcttgtgggtgagtctcttccatttttctatgtgtttaaaactgtgagctttaaatagaagggtttaacatttataggtcactcatactccacagagatccacatccaccaggcctctcattctaataggaatgataccctcctgttaacatttgagtggcatgttcagctggtaaataaatttttttttatgattgcataatatgttttataatttggaaaacagaaaagtataaagaagaaaaatatacctgtaatctttctgctcacttaaaaacgctgtgaatgtgcatttgtgtgaatgtttatgtatgtatatatatttgggatcatattatagatatttttggtcagttgcttctttcatttcatgtatagtgaatattttcacatcagtaaaatattttacctcatgattttttgttttgttttttgagacagggtctcactgtgtcacctatgcaggattcagtagtgccatcttggctcactgcagcctctatcttctgggctcagatgatcctcctacctcagcctcctgagtagctgggactacaggcatgcgccaccacacccggctaatttttgtattttttgtagagactgggttttgccatattgcgcaggctggtcttgaactcctgggttcaagcagtccacccacctcagcctcccaaagttctgggactgtaggcatgagccactgcagctggcttaccacacgattttgaatggtgggagatatataaattattccattgaacaaaaaagccatatttaatttagccaatccctttctacggtaaccatcctcacagaagaggctttgtgagcccaccttttctaaatgctccgtattaatgctgtcagttggacacaaaagtgtcagggagctgtactgggtagttcttgctaaatatactcaggatctccatgcccattgagatcaggaatagatccagtcacctgttaaaaaagtaaatagaaatcatcacctagatagaattgatccattgaagctaaaaaatcaagcccttcaagttacttgagacagccagaaggaaaatgttatgttatagggctttgtagccaccattctcacagcttagtgcaatggtgtaggaaatattttcacagaaatatttctcttttagagagttttttcggataaagaaggcttgtttaattcaggaagagttatttcataggaaattaaatctttgtaaatcctctatcacatttccacacttgctagttctgtggcaaatgatggctttcgagtggttcaggaagggtttcctgaaagcaaacaattccatgttttatacatatttgtgtttttatttttgaattggataagtaagggacatgtactttcccctttgtatttgtctctgggtgatattgctggttctcaaactcagaatggtaattaattacttataatgattttaaaaaaaaaaatttcacttggtgaaaatgttttcttgggcccgatgaatgaccccaaagaacttttacaacacaaccagtaatgttgggcaggtgctggagagtggctgctgcttagagatcagtaattgttacatcatggtttggtatgctccgtggtgtctaatcaggtcgtgtgcttgggaaccatgaaataattctcttttcaagtcttagtgcatcattttttctgacattgatcaaagattggaaaactagtattatatttgtagccacggtattcataactgtcttacattcttaatctttcggctttttggttgaaatacatctatgcctcttaaatattgaaggcataatatcctttaacctacaactgcagagttaaaatgaattttatgtgaaatatttagttgtggaccacatcttcagctttttatatgccacagtggtcttgtttttttcccttccattgtctgatagtgaggtcattttcagtcctctgagaaattctattcccagccagatgcggctcatatattaaaagtagcacctgtggctaatatcacagcagcttaccataaatttacatggtaactaggattatatctgtcaagactgttaaaaaacatctagatttaatttgatttccagtattgtagaagctatccaacattttgcttcataactatattttaaaagttaaaaatcactccattgttaagttttatagcactcctagtgcccattaagttgatttgttcaatggaggtcagagtaaagcaacttggctacattaagatcggaaaccaacccatttgtgacaaatttagtcctttcgtgtgaatcttctcaatgtttctgcactgattggattcaggtgtagcttatgtcagtagcatttaacctcaaaagaatgagcaatctgattgggttgttgtaaattatgaagcattttgcttttgctggtttaaatgtaactgttgactctgctgcccgtgcctgactgcgccactgcatctgcctaaacaggagtggtttgggtttgaagacatcttagaaaattgggtacatgccctcatccctttccctcctttatgtgaccttcctaaactcctttattccccattatcctttgagtcatctcccacatgttacgatttgcacacctgcagttataaaattattttggggtgtcattatatcatgttgttcaccaactttccagcatttatgaatgcaataatgattcactgtaaatcaaaataatttacaagttacagagaatctgctcctacaaataagaattgaatgatgaatttctttggtgtcctctcatttgacaaagaaactgataacatatttctttgtatttgtaaaatttagctagcagtccagaatggaattaaaagtataagttcaactttctggaaattttgtgttttaaaacatgttaaaaaatataaaccagttaagaaataagcaaagtctgtttcctcattaatagttgcaattggcttggcagtcatcttgctcctgaatgagacagttgtcatgttaagtgttggcgccgaggctagggcagcgtgcgtagccctgagtggaaatgcctgctttaagctggaactcagtgtggaggttctttctgctctgttgatctttctggagggaagttgtaagcttctttggcctgggtctcactaaggaagtggaacggcagccaagaattattatgctgaaaatgttgtggtgatagaaaaaagatgattagaagtgaggctaaaattataatttaatatgttaccaagtgtaattagtcacttaacagtataagaaaataccattaataactgatgtggaaccttgtaaaatatttcttggcgaattttaatgtcttttttgtgtacttaggatcagttgagccccgtgggtaacttgggtgccctgtttgtgaccctggcttgctgtgcaggttccccttggacatctgtggagaggaagagtaagaaggagatggctgtgcccagccccggcctctcacacagccttctggattgttttacctctgctccttcactccttaatagctctctgtggttaacctttctgtcctcctcagtcgcactggacgctccttgaggaacgggagctgtgaccagggccagagcccaggaaggtgctgggtacagagcagcagattggtaactgtttatatcacatgctttcaggaacagactgttgggaagattctgggatttccagacatgttaaaggtttcagatcctgtgtggaaagcagaaacgtaagaaactgataacttgttttgctgaccatgatcctttttctcttcaggtcatccattgcagtatgattttgtttctaaaggtatcagttaatgttctgaaggggacaggattcatgacatgctggtgataaggctgcttgccaggtagctacctttaagatccccgaatttagcctaaaagggcccaggagctgcatctgtccagtggccaaagacagaaccttagaaggttgattttgagaatagaagacctgcttgttttcagggagaagcattatttctctcttcaactcagagatgagttaaatcctaaaatgatcattgaagtgcacattgccagattttgtcactcattagtgccctattaccttaggtataggaaaaatggctataatttaaaaccaaatgagccaattttatagcactaaataggtataaactacttctgtgtgcattgacttaaaaggcaatgtttagcttggttctttcataattaacattccatgttgaaaaataaaaactggtattgactttatttttatttagaatttcgttttaagctatgtaaaatagtattgcatatttgttttttcagatttcagattataatacataagtaaagcatttatttcttctaatgaaatccttatttagcaaattttggctattataataatatggttactattggatgaacagatatatccattttacatgaaaatatttttttcattccatctacagatatttctttttaaaatacatgcaacttttcccttactaaaaaagatgaattttatttgagaaatcagttactttggtattctgagactaggttataaatctaatattgcagtgttttaggactataattaagaataggttctgctggtaaatgttggaaagaggcaaagaagaaagttacaatacattgcctatttaccaattaaccattacctgccaaaagcacatcagactcacacagcggacatccgctaatccagtggttagctgttccgggctctaatgcacactgttttacacgttaacggttttgaagttccaggccaaagctgacctttcacatgtgctccgttcacagtaggaatctccactcactgcttcctgtcagaatggattatggtgacacagcccagggcccactttggctgcaattaagtttttgatcagaattatttcgttcacaaacaatcacatttgttaaaatgttacatctgccctgagaaccactggcagactctcagtttatcagtctgatgcaagcgtaagtcttcatttgtttttcataaaatggcaaaccatcttatacatgttatttaattttatttttttcttttgttggtttctgcctttcatttcattgggcttggaaggaaactgtgtcttgaaattagtctgaagccgcttgaagactttgggaatttgaatggaattgcttttggtgcagaacaaaattatccagttgggagccaagactcaaatattatttccaaaaattgttagtggtggttctgtttctcacacgaggaaacgttttagccttgtgagtgtggggcttgaagctctgcttcttggtctgcagtgcctgtagctgccatgcctacgatgtcgctgccttttggtatttatcataaggcatgtctccagatccgtcattgttgccatcgactttggtgccagaagtgaaaccagtcctgcttcagtagacttgcctctcatgcctctttgcctcccttttagaagtcattttctcactaaggaacagcagcagagacactgaaggaaccttttctctgaatgaccattttttgtttataaaatgatgtgggtattgatggaacttctgaattttatagctgattttcaccatatgacgagggtgtcctctcacccttttgtgaccttcctattctggagaagagtctgtgtgcttgggagctttatgtgttgggtggggtactttgggaacacaggattagagtttggattagagtttgacttagaatggaaattaacctttgacttaattgtgtgtgagagtggagaagggggaggggatagagttaggaggctgtgaagttaggaatgcttgaatgctgtctgagaggtttagaaattttaattactttaaaaaatatatacttagaatactgttaaaggaatttttaccaggttttaaaatattgcattaaaactcaaactatttcccatttgttttgacgtaaccaaactcatttattactaactcataaagttacaaggggcaaaagaaaggtgttgtacaaaaaaccattttagccataattttttaagcttttaaataaagcagggcctagctgcacatctaaaatccaaagactttacttaaatgggataatgtaagtactggttatattaatatagccttcatattgtcagatttgtgagcacgcataaatctgttttcttaaatgtattattataattgttttttactcttttaaaaatcatgtttggaatatacctgactatacttactatttaaaggaaatatatttaaagaaaatattgaatagtatattttgaaagaaaaccccaacatgtaaccttccaaaaatagacattcctaaggtactgtcatcattcagtaccgtcctgtcttcttaaaaagtggtacacagacagaaggtgcagaatttgtatcttattacaagctcatgttaatgtagtcattttttattttcaggttttgatgttttgttgtttttttttttttgagattctgaagtttttagaagtttgtatttataactttttaagcccatgtaatgcatatggggcatctgctgggccataggaggaatcttcacttttggagggtgtttttagggaaatcggaagcagtcaggagaaagaatggtgcatagtgcccctgtctgttcaaaaaaaccagaggctcctaaaatcctgtgtagcatctaccatgtacagacaacctccattcttaaaactttaaatgcatctaaggaagggacagccttctgcctgcaatgagcaacagcttcacatgagacacccaagaaggttcaaaaatactctttctggaaaggctgatacagacatctgtgacttggggtctgcctcacagtatatgaaactgaaagatagattggacacttaactaccttaaagttttactagagcttgtaaagacacttccgaggtcccaaagaggtcctttatgccagacagagccctctagattctttcccaaccaccatgaaaaaccagccctctcttcctaaacaatgtaattgctggcataaggagacccccactctgtaataagaaatttttttttttttttaaatcaccaggaacatggcacttttttccttatgttggccatcaggtcacacagcgggaagaacacctatcattggtccacccacttcttcccattatgggaaggctgaggctgagagggagaagtaactctcccaggcgaaagagctagacctgcacccaggtacaccttcctttctctatctgtggacttctggtgtcacaggactatttgagtaattttccattatactctgcatggcccagagagatttaaagttaaagcagagtaccacttttgtaaataaaatgaaatcaaactctaacaattgtaaggcatgattttccaagcctccggggtttagggcaagtaactgctgccgtccctgccggctccaaccctgttggtctcctgaggcctggttctctgggttgtacatttcttttagaaccaccccagtttatttctgaccttgtgcccacatcccatagtcatggtgcagcatatatatttttttttttaataaccctggatgtgcaggtggtcatatttcctaaggtttcaataaagaatgtatctcagaacaccagggtaggaatggctcttaagtttgcactgggtgcttgaggtaagattaggcagacccagagggtagtggagactttgaccttatcatgaaactctttaaatatcataattttgaaaacataagatatgaggtatttcagagcagtactctattctctaggcactaaagatagaagtgaatgaagctcttttttcctgacttctcagcctcctcacaatcccttggtgagtggccctcttttggacaagtgcaggggctgagtgtggaggttgagtgtcatgtccacagacacatgtgacaggaagaagtattttgagcataagaacttggttcctggccgggcatggtggttcacgcctgtaatcccagcactttggaaggccgaggaaggtggatcatgaggtcgagaccatcctggccaacacggtgaaatcccgtctctactaaaagtacaaaaattagcgtggtggcgcatgcctgtaatcccagctactccggaggctgaggcaggagaatcgcttgaaccagggagttggaggttgcagtgagccaagatcacgccactgcactcgagcctgggcaatagagcgagagtccatctcaaggaaaaaaaaaaaaaaaaaaaaaagaacttggttcctgagaagtctactttgaggatctttccacagcacacactgcctgcaccttggaggatttgatgatgatatccttgccatttcagttttggtaggtagattatttgttctgacaggtttaattgtcattgttttggcacactagactgttaatacctgaattaattggttgctttaataggtgttcagctaaaagaggacttcatcatattatctaatgtttccactgggagttgaaaaaagggattttaaaaaactttttcatttattccataaatccccaagtatagaattgctcttctaattttgcccctgaaactgcaatgtatgttgatagagagttcaaagatctttatattcagaaggcctggcttttaaaagatatatttggtatacatgtctctcttctacatgaaaccataaaatggtttctaaaagagacagttactcgctgtatgtgagactgtgaagcttctaaaaataagtaaagaaaaccatggtgccacatggagaatgagtcggatgttttaatagtatttagtgattcaggatacacaattaaatgaatattataacagttttggaaaaaagggcacagggaaaaaaactacgtaataattttttctttttctaaaacctgttatactttatctcttgtaattaaatttaaaaaataagattatgggggctgggtgtggtggctcacgcctgtaatcccagcactttgggaggccggggcgggtggatcacgaggtcaggagattgagaccatcctggctaacacggtgaaagcccgtctctactaaaaaagtaccaaaaaaaaaaaaaagttagccgggcgtggtggcgggtgcctgtagtcccagctacttgggggggctgaggcaggagaatggcgtgaacccgggaggcggagcttgcagtgagccaagatcatgccactgcactccagcctgggcaatagagcaaggctctgtctcaaaaaaaaaaaaaaaaaaaagattgtaggaaacttatttttgctaaaatttacttttaagtaaaagaaaaaaaaaatggaaaaagtataatctgacatcagggatttgtacctaaagatgcacacatggaggctttggagctggacataggggacttgaatttgcatcccagcctcactttttatgaggtgcgtgactttgggcaagtgatttaacccctcagagcctcagttctcttctctgtaaaataggaatgataaacctgttcacagggctgcagtaagtacctggtccagagtagttattttataaatgctcattatattttcccctcctcttcttcatcctagaactgaatgatgagaatcagtggtcagagtaatgactctgagatacactcagatccatagtcagcaagaatcaagttatgttcagaaggtactacttgatcagaaaagaggctattcaggtattgccattgagatgatgaaaataaaaaagtaatttatgattaataccaaaatagaaggtaatcagagatatcctgttccttgtgtatactagatgataatattattagttttaaatttgaacattactgtgtatgtgagggcactgtgctgtgtgattggttcatatcatctcatcttacctagatgggaaatgcagcccagccaagtcatacagcctgcttaaggtctgggttgagagcccaggttttggattcctggtctgatgctctttccatcatattgcattgtttctgataaagtaaatgtatttttaaaatgtcttattcctttgcaaatcaaatacataaataaagtaactatcatttattaatttccttattgatggacatttagagtctttctcatggttttagtacggtcagttctgtaacaagcatcctatgtctccttgtgcataagtgtaagagtttccatacagcataaatctagaaatggaattgctgggataacttctggtacatggattaataaaaatgaaaaaccaggattatgagaaggtctgggcttgatgacattcacattatagcccagggacaggctgtttgtcatcagaaaaccccttccattcatgaggccatagaaatccatggtgaccgaagcacttgtgacttcggagcagtgtgatctgattttgaagtggttttgaaaactggggacggtatacataaggtgcaaagatcacggaaacatgaattagcaagtggggcctcagtctaggttacgagtgctttaggacaaaaaataatcacttttaaggaaaagtcactgttgatagcactcagaatgccaccagtattgcagatttgtaatctattactttaaacttttacaaatgctcatggtgtaaagttcagacccaagttactgaatgtctgttgcctgaaaaggatacttcaaaattatattttccctttaatttcctgaatcaaaaggctccaggttgtgacagaaatgtcactacttgctgtctccattcctgtacagagacccacaagagactgaaaaatggtgttggtcaagttgtcttgggttctgtgccttctgggaccggtaggaatgcagtgtggactgcagtggagctggggttggggagcaaatgcctggtctgctagtactgtctcatccacttgtgttttagtaatctcattgctttcagtggagggatcctattttacactgatctttatgagcaaagataattatatatatttgcctgggtaagcaaattaataaacttgtaacaaagtgtatcagaccatttctttggcaagacctactagaacagtttgtgaagcagagctgcttccaatggagcatgaaaagctttgaaaattctcagcaacagcagaaagcaacatttgaaaccacccttaaaaaattgttttcctcttccccaaccaagtttataaaaatttggtcagacaggcgttttgttttgatttaaaatattttcagtgaattgttatctgccgaatgcacatgtgttcctgcactttttctttcatgattgaaactttaaacccttcccttaagttcccctaaaaacctccctgtgcctagtaaggttttgcatgtgtgaggagggtgaaggtatttggaccttggagaaactttgcaatttgaaatctgcctatgcagttgtacaccagaaatgaacatggtcaatgccatattgtgctctttgtctttttcttctaccaagattcctcacccctaggagacgttggttaatataggcatttcggtttggttaatctgatcatgagtgcccgtgagcatggcatgaggcatgattgaagcagttataaaaatttggctcagagttaagccctataatttgttttaaagaattacctcttcagtgacattaaaaaaaaaaacacaacaacccaaaaacaacaaccaaaagactgtggtttataacaccacacctggtccagattgtactggatgaatccatatttgctttgccataaatgattttgagggtggaattcttggactgttttctatcttataaacccttgacattgtactggtacctgtatgctcacaaacctcctgacatgggaaagaccggctcagcctcccactgaaatgtaggttggctgcatttattctgcatgttcctagaatgaggaaatgatatgacaataaacagaaatgcccttgctgaagagagaagggaagctggtgtttatctggtcaggtggtttagattagctgtgatgcagctttgtattatgttactttaaatcattgtgtcccaacaggacataaattatgaagattgttacagtatgtttcatcctatgtaagatcaacaaattggaataattttttataggaaaatcacagtgcttttggcaaggctattgaagcctttaatttgacttgagtatgtctcaaatattattgcttaatatataaagtatgatttgcataaggtatgaaataataaacttgtaaaaacaaaagggaagaatttccctgtagcagttgcatcaaatggcagtgcactcctcctccagcagtgtgctttttttgccctgatggtttagagccagttgcatgactttcctctgatgggattgcaaatgagctgagcagtctttgcagagatggagctttgctgtgtgctgcgtgcctgtcaaccctacctgcacagagaaggtgattgctccgtggcagaacagaatgggagcctgctctgaggaggagaaaacaaatgatcttgtttatatacactcaggaaaacaaaccatttttctttctttcaggatattgtgaattacttatataaaaaaagccaacctctccagaaacttcctagatcaacagctgaagttaagataatttatatagaaatgcggaaaaatttgacttaagaatttattattttaaatgttttctctcttcattgctattttctgaattactagcataatttgtgaatttttgacacagagacttaaaatttttcatttatattcaagattcagctaagtttggctacacagaacaaattttctagattttaaaaaagtggcataaaattactttatgtatgattccagcaaattggaaccgcttcagtgtcccaaagaagcacattttctgcgcaaagcactgtgcatttttgtgagacctcctcacacccagtagtgatgttaagaagtaacagagcctcagatttacagagtagtagaggcaagagaggtttaggatttgctgaaggccatagaatgagacatagctaggattagcatttttcaggatataaggataccacccaccagactttgtctttgataccaaaaatagggtttaagtgctaagcttactttcctttctttgtggctataagccctggtatttttctttaacaaataattaaaattattattaaataaataaatatacttaaataagattgtttaaaacaaaaacaaaaaatccctactttccatctataagggtaggaatgtttctctccttaagcctacccttataggttgggtaggcttaaggagagaaaaataacaggttaaggataaatcctgaatatatttgtggtttccttcagctcgatgtctgaagattctcacaggttcagggactattccaagtttgcaacctgtgtgtggattttgaaacaaatacagacaacttatgagacggtttctttgctgggcttcttgcttgacacagttttctgaaacatggctctggcaggcttttttcttccatggacacattgctgccgtttatcactgaagttcctctgtggagttaccaggagctaatatttggatgatgtacttttcttgcagaaaatattagcaaatgttgcagaaactgtgctttaaaaacttttaaaaggggaatggattcccagtttaaaaataagcaaaagaaaggataaacatgatttcattgatggtgtgcaactgctttagaacatcagatattttgtgatgtgaaatgggatgatactctattttacaaaatgtgtactgcttatagaaaatgtatttactgtaccactaagccaaacttaggtgttgctttgtttccttaaaatattttttgagtcgctgtggctgccccacagatgatgggggagtaggcattctttctgcccagagcacttgttctcttcctccacccttttggttgttattgtagcatcttgactttcagcttaacacatcccaacttaagcagaagcccttttgccttctctctctttaaaactagatccatagaaattatttttattacagtaatagggcaagatagttttatgtcatatataaactggaattatgtagtgttagtagtagttatgtctcctgaaaggaaccagttgattataaagaagaaaagttagggagtagactgtcattttgcatgctattaaaaaaaaaaattttttttttttttgagatggagttttgctcttgttgcccaggctggagtgccatagtgcgataatggctcattgcaatccctgcctcctgggttcaagcgattatcctgcctcagcctcccgagtagctgggattacaggcatgtgccaccacacttggctaattttgtgtttttagtagagacggggtttactccatgttggtcaggctggtctcaaacccctgacctcaggtaatctgcctgccttggtctcccaaagtgctggggttacagccatcgcgcccggcctcaattttttttttttttttttttttgagacggagtctcgctctgtcacccaggctggagtgcagtggcgcagtcttggctcactgcaagctcctgggttcatgccattctcctgcctcagcctcccgagtaggtggcactacaggtgcccactaccacgcctggctaattttttgtatttttagtagagacagggtttcaccatgttagccaggattgtcttgatctcctgaccttatgatccacccgcctcggcctcccaaagtgctgagattacagatgtgagccaccgcgctcggccccctgacctcaatttttaaaaatatatttgggcaggtactttgtgtatcttagtggttcggaagcacaaagttgaagcctatgaagtcgttttttttttatataaagtagaatttcttataattttataatgatgacagtaccaaggagcttaaatacaatttttaaaaggattgctaaaacaaaactaactaaactttggtaatctttgcaatacctctcacctcataagactctgaaagccaacaaataaggattatcagcagattagggaagaaaacctccaacaggacttttctgaggcagctgattggcaataatgaacagccccagtgaattgcaaagcatcacaagttattttgacaccagggaactctggtaaggggcttctcttggggtggttttaaaaccagtgcttctgtttgctttaggagaaaagaatgggtagaaaactggtgaaatgtgctaattcaaaactgaaagattgtgagaaatttaagaaagagctaatcagactgggcaattggtctgcccaatagtagctgatgaagatatggcgaaatgaatttaaacttaggtgcagaggaatttggaaaccggtagtgtctcttcagggaaaagatactcatagctagtgatcaccttggccagaatgtctttttggtatacatcagctgtgtgaactctatctagttagagaactttcactaaaaatgaaacagaaatgaagggccttttggtaaaatcgtgtgtagagtttttttttgtggatgtaaaccctgccacctggagaatagtggatttatattaatatactcctatctaagaggagttttcctagcctgggaattcagtagaaatttactgatgtattgaaagtcctaattctgcaaaagaaagttgttttgcaccttgcttttcatttaacagtatatgttgaagatggtaccatgtcattagctaaagagttgccatattttttcaattggctgtgtaggctattatggcaattgccaagaatagtgacttgaagcttttttttttttttttaaaaggctctaaaatgctacagtatgaaaacagcttttgaaagcagtgtttagaagtgagcatgctatctcacaggtgttgacctgttcagtgacatttaaaaaatgtacttattaccatgagctaagggggactcatttcgtctggggcctggaagagcaggcagctttttcagtagcttgtggatgttgtcttcagtgcctggagaagccagttttaatttcatagttggatattcttggcctgagttattggaaatgttgagctctgtggcggatcaagtagatggcaagtagactagtggcttaggattggtgggagttgtgtctgcccccagacacacaagggactgcacagggaatggtcctcaagcaggcctttagccccacttcctcagggagacatgagtcacctgcttggctgagatgctcgctgacagattgccagttccgcaaggaaatcttcccgtgccgacacccactcagagaaacagtgctaaagatgtttctggttttctgagccttgtaaaggtgaatttctttggccttcaaattggtcttctgctaggtttggaaaggaattcttcctttccaggccacagacactataatatcaaagtgttattgatgatgataataatcactagcattaactgagttcttaatagagtgccaggcatactgtaaagtatattacatgaattagctccttttacgtatggggaaactgaaactcgtttcaaaagttaagtaacttttctgaggtcatatagctagtgaatagcagagctaggaactgaacttagttgaccagtgtgctaaaaatatgtctgacagtccagagaaaaaaagcatggattaaatacatctttggttggatctgttcctcacagtttagttgagaatattcttgtgttgcctacaattaaaatctgacgtttcctttgcagcggctagaacagttaacagtgttccacgtgaaagtcttggtgagacatgtaatcatgttctgtggcaaagaatgcctttacttggtgcactagacagtgtttatgtgattgataagtcaccaacaccaggggaaggtcctgtcctgtgacatgtgcgtgcttggcaatgatcttgccttgcattttgcttaataattttcattatttttaattaaagttgaagaagtgcagactctagctgaaattaaggtaggttgtgttgccggaatctggtaattactttaattgatcacaagatagtttccttgatcaccaattagagtaaattgctgatcatgtttcaagacgtgaagaaatgcccaaactgatttatgtaatagtgttttcatttgtaatcagacataaatatcatttccttccatagcaattgtgttttataaaagaagggttataggcctacaaacataatggtgattcataaacaatagatgtctaattcattgaattagtaaaggaagtatttagaggcttaatggagattgtactggggaaattactttggagtagctggtgctcattttcttagtgggagatatgttcttttttagtgcataattaaaatagtctataatcaaaatataaaaggcagctgatttaaagaatgtatatcaaagagacttgctctgagtaacgaaagatttgtattgtaagtatgtgctagaagtcttagaactttaataaatcatacatgttatttgactgaagctgtattttaaattcagggtgctgttaaacatttcacagattgatgcacgatttttgtcttggttttgtgcatctgatagtctttcatagtttcatggaataaaatgaaacaaaaggaactttaagaaaaattaaagttcccaaagaatacttgatttggggttcatggaaaaatctttaattgctgatggtttggagatttccaaatgacaaacttcattggcccaatttactgtgattgtattgcttacattccttaaaatggtagagtaacttaaaaagtcatacttcatcatacattcattgacttgttcataaaatgtttgtaatttgcaatagaggaaagactgaaactattatcagccattatacgttatttgttggccatatgtttgtttgaaatggctgtggctcaacagaacatggctcatagacaaactatgctgtaaattggcactaaaaacccacctaaacaggtaggcatatgttaagaagttaacatgagccaaaatattttaatgtgaaccaggttatgtacattaaaggattccagctccctttacagtgggaacttcatttgcatgttgttcatttttttcccaaactaatttttaaaaaatagatcaggtatacacatggtacgaattcaaaaggtaccaaagaatgtaggaagtcttcctgtttgtgattctcaaccatccagttcccactctccactctcctcatctttcaccattgctcccatcattcttgtatatccttccagagatattaatgcatacacaagcatataatttcttttctttcctttttatatgcttcatgaactattgttatgcatatattttttttcatttagtaatgtatcttagaggtacttccatgtcagaggataaatggtttccttgttctgcttaatggctgcatagtattccagtgtgtaaatgtaccataatctttctaatcagttccctgttgatggagattttgctgtttcaagtctatagctattacaggcagtgctgcaattacctttcttgtaatttatgagtatgtctgcagcacaaattcctagaagtattgtttggtctaaaggcatggacattttcagttttgacagataatgtcagattgccttccatgatgatgatatcaacttatattcaccagcagcatgtgagaataccttttcttctatatcctcaccaacagaatattagcaaatattttgatctttttcaagctaataggtttaacttagtttttaatttgtatttaccatgattgagattgagcagtttttatgtttcagaaccatttgaatttcttttctgttatctattatgtcctttgctcatttaaaaaatggtggttggtctcattaatatgtaggagctttttatatgctaaggaagtatatactgcaaatataatttgttgtttatcttttgcttttgtttgttggattttattaccatacagaaaaaattttttttgcctgtcttcttcctgcagtacagaaaaaaatttttcgtgtagtaagatttatctatttcttagtagtagttttttaaagttttcaggaaatagaatttataaatttcttgttaagttactcttagattgtttttcggtgccattttaaatgatatcttttcttcggtatattttctaattggttattgtttgtatgagaagctgttgactttttttttttttttgtcttattcttgactttaatgggaattctagcatttccctataaagaatgatgctaagaaaaatgatgctgcctttggactgagaatatattctatcgtattaaggaaggatgcatctattcctatctatcagcattccagagaatgttttcagtactatttctactttttggaattgattgagattttctttgtggactaatatatgtttaatttctgtgaatatttgatgagcgctttaaaagtgttattctcagtttttagagtttaaagtatagcaattagctctacctttaaaattatgtttgtttgtttaatctgtcatgggttaagagatgtaagttaggctaagtgcagtggcgcatgcctgtaatcctgccacttacaggtttagaggctgaggtgggaagattacttgaggccaggagttcaagaccaggctgggcaacataacaagaccccatttctacaaaaatttaaaaaaattagccaggcataatggcacttgcctgtagtcctagctacttgggaggctgagataggatggatcccgtgagcccaggagttcaaggttgcagtaagctatattcgtgccactgcattccaacctgggagatagagcgagaccctgtctcttaaaaaaaaaaaaaaaagttaattaaagtctccaactataaatgtttctatttattcctatatttcctacatgggcttattcaatgccatgttattatttgtagtgtagatatttgtaattatttaatcttcattggtggatgcaaatttataaatgcaaattacccgcttcaggacttttaatgttttgccctaaattagcctgttcaatataatttattaacaagtttttttttttgcatttgcttatgtgcttttatttttaatgattgaattttgctttgtgatccagcgtgaaagttttctctttattttgattggttggatttatgttctttacatttattgattgcacagatgagtttagtcttataaaacatggcagaaccaaaatacttttttcttccttattttaaattatgatatggactgtgttttctttgtttcattttaattatgtttttctttacttaactgggaatgtttatatttttattttgattcttgtggatactattataactatatataggtatataacttgatagtaccttatggataatatagtatatcgtatatatatataatacctatatatagtattatatacatatatatgtactattatacctatgtatggtatctacaagatcctataaaattatatacctataattttacatagaaaatatagtcttctatttctggctgggcattgtggctcacacctgtaatcgcggcactttggaaggccgaggcgggcggatcacttgaggtcaggagttcaagaccagctgggccaacatggcgaaatcctgtctctactaaaaatacaaaaacaaaaattagccgggtgtggtggcacgtgcctatagtcctagctacttgggaggctgaggcaggagaattgcttgaacctgggaggcggaggttgcagtgagctgagattgtgccactgcactccagcctgggcgacagagtgagactccatcttaataacaacaacaaaaaaagaaaatatagtcttctatttctttatatagcatttatggtcccccctcaaagcaatattgaaataatattttctcctactttttgttcactgtttaattttagtttatattatttttcagtcctagtgcttatgtttaattaattaattaatcagatacagagtcttgctctgtcacccaggttggcgtgcagtggagtatgatcatagctcactgcagcctcagattcctgggctcgacggatcccccaacctcaacctcctgagtagctaggactacaggtgcatgccaccatgcccagctaatttttaaaattttttttgtagagatagggtctcactatgtttcccaagctggtcttgagcttctagcctcaagcagttcttcaaccttggattcccaaagcgctgggattacaggcatgaaccattgtgcccagccttagtacttaagttttacacatttaagtatacttatgtctctaacttgatctttcatctttcaaagattttgtttacttttatataccttcttcatcttgtcctttctcttttaaactcctttaatagtttataacatttgcattccattctgtaactgtaattcccacagttgttttaaatgtattcctagaactgaatgaatatattgcttactgctaatacctttggtatagtttctccattcatctcttagttacttatagttcatcctttaatagtttcctcaagaaggatgagtgataattattccctgacttattgtatttctaaaatgtctgtcttttgcatttatttttgaaaagtagcttagctgggtataaaattcctggttttcaactttcatttcttaaagtttttgtaggtattgcccctctgacttctaatgttgaatgttggtatgtgaatgtttgaagtcagcagaatctttttttttttttgagacagggttttgctctgtcacccaggctggagtgcagtggtgcgatcttggctcactgcaacctctgcctcctgggttccagtgattctcctgcctcagcctcctgagtagctgggagtacaggtgcgcactgccacatccagctaatttttgtatttttagtagagatggggtttctccatgttggccaggctggtctctaactcctgacctcaagtgatgcgcctgcctcggcttcccaaagtgctgggattacaggtgtgagccactgtgtctggccagattcttttcatccttattgatgaattgatctttttgattagatgccaaaaggattttttaatcttccgagtttaactttgctacagtatatatatatatatatgattgaaatattacaatttatagatttaaaccctttatttttggaaaacttattttttttttaaatttttatccccaagtgttctgagtcatagaaagttttcttaaattacactctaattttgggggtttcgtatttttgttcagttaaatagcaacaatggtttttttttttttttttgagatggagtcttgctctgtcgtcaggctggagtgcagtggtgcgatcttggctcactgcaacctctgcctcctgggttcaagtgattctcctgcctcaacctcccgagtagctgggactacaggcacacgccaccatgcccagccaatttttgtatttttagtagaaatggggtttcaccatgttggccaggatggtctcgatctcttgacctcaggtgatctgcctgcctctgcctccaaaagtgctgggataacaggcatgagccaccacgcccagccaacaatgatctttatgttagatctcctttgtttgtccttacatttattcttttctagttcttctaaactcttgttgatttctatttcattttgcccattttctggatcctgtcctcttgggtctcttactgggttgttagtggtgtctattctgcttctggctgtttctagctttcctgtcttttagttagctcaaagcctttgagctggaatcccataagcaagtaactaagactgtaaaaagaaatctttgaaagaaggagcagatgcttttcaccatctgctaagtcagctgtttggcattgtatcttcttcattgtattccagataatcaaactttcgtttgagttttgccttttttctctcttattcagtcatctaaattccttggagtagttctttgagtgtatattttgaaagaagtttttaatttgtggatttaaaaatacatattttggggattggttggttctgttatatggaagaaggattatggaattgtctttttgcttccagagcagattattattttccccggggaagaattaagaataaatcctgtgtaaatggtttatcaggctttgtagtattttattaaatgcaaatattatgtgacagttgaagggaaatatgcaaagctgagaaaaatacaaatttgaggggttttgatgtgtcataaaagttttttaattgtatgtagatatggtagatgttttttctttgatcagtatgcctcttaggctgtggctgtgtttcctttcaagccttatatctgtgatggaatagattttgctactatactgatggcatgccagtggtcaaagatttgaggaccacttctgtgttccgatcatccacttgatccacttggctaatgggaaatggcaaggaattgtaggcatcactttagacattttagaatgacatggttcaaagaaattgtggccacagggtgtaagaacttgggcagtgactgtgcactcataatttcttgccattaagctgctttccccagtcagtgtgcatcaggatgttaccccacaatgtattatctgttcgtttgctctacatgtgcgagtctctatttatgacaactggaaaaaggaaagagccattcttctggaagacagcaactagaatcttagattctcaagcccatggagagcttttcaccactcattgtgttttgtaaggtttaccttgtgtagtttggtcagaagcagtagtgacagcagtatgtgccattaccgatctcttattctgtaccaagtgctgtgctaagtacctttatataccttatctcattgtttattagaatgtaatcacatgacttttaaaattattgtctccattttactgataagaaaactgagagggccaggcatggtggctcacgcctatattcccagcactttgggaggctgagacaggtggatcatgaggtcaggagttcaagaccagcctggccaagatagtgaaaccctgtctctgctaaaactacaaaaattagccaggcgtggtggcaggtgcctgtaatcccagctgctcaggatgctgaggagaatcgcttcaatccgggatgcaaaggctgccgtgagccaagataatcccactgcactccagcctgggcagcagagtgagactctgtctcaaaaagaaaaaagaaaactgagactgatagttaaattgcatgataattaagtgatagaatcaggatttgaatccaggactccctggctcaaaaggccatgcccttaacaattgcattgctgtctatcagtgatgttgattagcattgtacatcttctaatgctaaacaagaataaggcattataggcagagtagaaattctccttatacgtagtttaatgtgggttaactctatgtttgaataattagaacagactttcatggctgggcatggtggcatgcacctgtagtcccagctccttgggaggctgaggcaggaggatcccttgagtgatcccttgagctcaggaggttgaggctacagtgatctatgattgtgcctgtgaacagcccctgcattccaccagcctgggcaacatagtgagaccctgtctctataaaaataaaaaacaggcttttgtcccttcccttcacataatctagacaatcagattatgagatgagaagggctgggaaagtgaatattgtttttccacagataattccatacatggtcaaatggattttgcttgaactttctcccttttcctatagggaaaaccttcaggcctcaaatgtcaacatggaaacttttatcccaaataaaattggctccgagagaggtaccatagtgaatgatatagaattgtttaaaatggcatcttctgtatttctcactgttaactaggaaatacacacttaggtcatttggtgatcccaaaaacatggcttgactaacatcatattggtttttctggataggggtaatgaagttaaatatttgtttacgtgggtgtaatgggtattgccctgtgaatgccactctaactttgtaattcatgtgccattaccctaagagtcttaccaagtatttgtgcattctggaacaatagagacagactctcctattgtttgcagttaccttcataaaaaattgaaaacaaacaaaaaaatgagttttttccttcttctgaagacaagtttaccttctgcttaacaaaattgtttccactccccgtgtggtataaagacagagccccgtcagtccacacttagtcgtgtgactggtttgcagccctctgctcatttcctggcttgccttctgccctgaggtgggtgcactgtcaccttgaaatggcagtgcagggcagtagcaggaagaacccaagcaggcaagctgggcttctgtttcactctaggtgccaatagtctttgatttgttcctgtcctgcctgggaggtgagatgaagaagttgttcatttctgctggtgcttttgcttaagacaccctcaggagacctttttccatagtcttgtgggttgccttagttagcaacccaatcactaaaaacaaaaggaacagagctgcaagaaaagtggctcctaatatttggagccaggtagtgagacccagagcactgggttgaagggaaattattcccgtgctattttgtagagtcttgtcctgaggacaattaaatagtccagacgggtcactaggtgagaccaatttcctggtttgtttactcgagcctgatagtttttcaccatccagcagtaggtcacagtcctgctgcactgtgaccccagaggcctgcagagagcagtcctttcatagttgatttccacaggcttccctaaggatccttgcctgcctttatgtggttggattgctctgttgtgtctctcaggcttagggtagaggacaatgtcagtaattactcttgacttcatcttatgcaggcatttggctttatgtcccgagttgccctacaagcagagaagatgaatcatcacccagaatggttcaatgtatacaacaaggtaactaaactgccttatttgggaatcaccttaattatggagtttaagaaacttctttcttccttgtcatcttgtgcagctaaatgtcattgtacttaagaaagtcttatcctttctctcagaatccctgtgtattattgcaaattagtaacacattttcaggtctgctcctaagaacagtgaataagctctttattttcatgcttgtctttctactgaagctaatatgagaaagttgggccaaatgaggctcctgaattaaaccggagtatcagccatgcagatacgtttcaaaacttaaggtaaattattgaaagaaatggtagcaaatcagatagatatggcctcatttatctcgttgaaatatttttactcaagaactgtgctttgaaaactattaaattttgtatcctgcgtaggaaatgaccttatttaagacaaaggacagactaaaaagttttgagggaacacagtgagaagaaccttgttcctcccaaagtgtccttgcctttatggtcatgccatttgaaatgtcttatcatctagatttctatgaagtcttctctgtgaaaatctttgaaaaaagagaatttcacaatactcacgtgacttaatagaataactcagagcaccttggtaccaggctaaacttttctttgctatttgcttctctttgctcgtaattttgcttttactttataatcagttcatcaagaaacagcattccatcctttactcccatttccctaatttagaaatgtgctttttttttttttttttttttttttgagttggagtctggctctgttgcccaggctggagtgcagtgctgcgatctcagctcactgcagcctccacctcccgggttcaagcgattctgctgcctcagcctcccgagtagctgggatcacaggcgtgcagggtaacttttatatttttagtagatacggggtttcaccatgttggccagggtggtctcaaactcctgaactcaggtgatccggcctcccaaagtgctgagattacaggtgtgagccaccatgcccagccaaaatgtgctttttaaacgttgctgctaagatattacatttgatagcttggtttttctcagtggcctgaaaatagttgatgtaattaaagtaacgagagttcaattggaacctcagtctctctttttatttaaagaaacaagatttgagattctggcagctgcattgcctcttcatggaagagaactttttatttcaaggtggctgttgagccaggcctaatgtagactatgcccctggagttcgctgggttttggaaatgttttgcttattcataatgtagtattttctaaatcatttaatccccctaattctcaaatatgaatgttgaataatagactgatttctgaactgccaaaggaaaataaccatgatttgctgctcagagttttaaaaactgcttttctttttcttaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaacctgaggtatttttcatgctatctaatcatatacctaagataaaccaacccagttacttatattaataatattcagaaagagaagtggcttttttttttttttgagacggagtcttgctctgtcaccaggctggagtgcagtggcgggatctcggctcactgcaacctctgcctcccaggttcaaatgattctcctgccacagcctcccgagtagctgggactataggcacgtgccactgcgcctagctaatttttgtatttttagtagagatggggtttcattatgttggccaggatggtctcgatctactgacctcgtgatccacctgcctccacctccgaaagtgttgggatcacaggcatgagccaccgcgcttggccagaagtggcattcttaaattcaagaaattgggatggggagtattcacacattttataacccagaaattcaagcaattctggtgactacaaatgcattgttttggagaatagttgtaaggtggaaaaagaattaggaactcgacagatagtgagttttaactttaaataacaattcttcttttgttttgttttgtttgagacggggtctcgctctgctgcccaggctggagtgcagtggcaggatcacggtttattgcagccttaacctcctgggctcaagcagttctccctcctcagcctccagagtagctgggactataggcaagtgccaccacgcctgactaatttttaaattttttgtagagatggggtctcccatcttgcccaggctggccttgaactcttgggctcaagcaagcctcccacctctgcctcccaaagtccaaggattacaggtgtgagccattgcccccagccagtataacagtttgtgtgtgtgtgtgtgtgtgtgtgtgtgtgtgtgtttgacacggggtctcattctgttgcccaggcagtagtgtagtggtgcgaccatggctcactgtagtcttgacttctcaggctcaagtgatcctctcacctcagcctcctgagtagcagcggttacaggcatgcatcaccacacctggcttatttttaaaacttttttgtggagacagggtcttactatgttgccatggctggtctagaacttctgggctcgagtaatcctcctgccttggcctctcaaaatgttgggattacaggtgtgagccactgtgtcataacaattattttaaaatttttatttatttatttttaataattatacaagatggagtctcactatgttgcccaggctggtcttgaatgcctgggctcaaatgatcttcctgccttgaccccccaaagtgctgggattacaggcgtgagccactgcgcctggcctataacaattcttatgaagctaaagttgatttggattttagctgccgttactacttatataattaattagattaaacaagtcacaaaaattgga

SEQ ID NO: 2324 - DNA, 1126124 bp, Homo sapiens
tgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgagcttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgcagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaacaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagactccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattattcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttattataatatataatttttacagttattttttgttatgctttatatacattgaagtatatgtcttagctatataattttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactgccatttaaaaaataatgacatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgtttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggtggctcacgcctgtaatcccagcactttgggaggctgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaagaactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccgcctccatgattcaaatacctcccacctggtccctcccttgacacatggggattatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaacgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacataatgtgtgcatgtgtctttacagcagcatgatttataatcctttgggtatatacccagtaatgggatcgctgggtcaaatggtatttctagttcaagatctttgaggaattgccacactgtctttcataatggctgaactagtttacagtcccaccagcagtgtaaaagtgttcctatttctccacatcctctccagcacctgttgtttcctgactttttaatgatcgccattctaactggtgtgagatggtatctcattgtggtttgatttgcatttctctgatggccagtgtgatgagcattttttcatgtgtctgttggctgcataaatgtcttcttttgagaagtgtctgttcatatccttcacccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttctttttgcttaggattgtcttggctatgtaggctcttttttggatccatatgaactttaaagtagttttttccagttctgtgaagaatgtcattggtagcttgatggcgatggcattgaatctatacacttcatgctaaaaactctcaaaaattcgttattgatgggacttatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaacaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataaatttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatatcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctacttagggactgtaatttgaaaagaggctgtgcgtggtggctcacgcctgtaatcccggctctttgggaagccgacgcaggcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaagaaaagaaaagacgatttattggttaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattgattgtcatttactctaaactttgggaagaagacacattaattgttatttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaaaaatttctgggagaaactatgaaataattattattgagtagatatttaaactgaaaattacagattatgtttttatttttatcaagggtcatatgtatcgaatatttacatgacactatacagaaagcactttttagtattacatattatgagataaatttttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtattttccattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctatgagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatacaatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcgtatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattgctgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtgtatatatatatatatatatatatttttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatccttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactgatttcatcttgatagtctgggccaatcaccccagccaagactgtaactcccttcttagcctgttgacttaaaggtaggaggagcccaaagtgtccaagtggcaatcttaactttcagtttaatggaatcattgttgtgtctcttgatggcagcgttcctccctctggaactaagacctctaggccagcaggatcaatgttgtgggaacaggaagcaagaattttgctggtggatcactaggggtgatggtgagtggtgccacttccacttccaccccttggttcctggaaccatgaatcctggctatgggagaaacagtaccatatattgaatgctgattcagagcatacacaccttctggagaactttgcctcagcctagtaaagtattgtcacctagttcgtgttgtaattgtgacttcaaaaggcaattctacggttttatcaatccagctgcttcaggatgatggggaaacatggtaagaccagtagattccaggagcatgagccccatgctgcacttctttagccataaagtgagtgctttggtcagaggcaatgctgtgtggaacaacatgatggtggataaggcattccgtgagtccacagatgatgtcttggcagaagcattgcttttaggataggcaaacccatatccagagtaagtgtctattccagtaaggacaaacctctgccctttccatgatggaagaggtccagtataatcaatctgccatcaggtagctggctgatcaccccaaggaatggtgccatattgagggctcagtgttggtctctgctgctggcaaattgggcactcagcagtagccataaccaggtcagccatggtcagtggaagtccatgttcctgggcccatgcgtaacctccatccctgccaccatggccactttattcatgggcccattggtgatgacaggggtggctggggaaagaggctgagtggtgtccacagaacggggcatcctttccacttgattattaaaatcctcctcagctgaggtcatcagttggtgagcactcacacggaatacaaatgtcttcacagtttttgaccactcagaggtgtccatccacgtacctctttcctgaatttccttgtcaccaattttccaatcgtgcttcttttaagtccctgaccatccagccaaaccattggctgcagccgtaagtcagcatataatcacacatctgaccatttctccttccatgcaaagtgcacaaccagttgcactgctctaagttctgcccactgggaagatttcccttcatcactgtctttcagggatgtcctagaaaggggctgtggtgctgtagctgtcaactttcggatggtgcctgcatattgtgcagatccatctatgaatcaggccctagtcttctcttcctctgtcacctgatcataggtaactccccatgatgccatcagtgcaagctgggagacagaaggcagggtgacaggaatggagaccatggacatttgagccacttcctcatgtaacttacttgtgccttcgggacctgcttgagcccgatcacacatacaccactttcatatgatgaaggactgctgctatgcatgacccagtttatggctagatgtgtcagaaagcatccagttcacgacaggcagttcaggttgcatggtgacttgatgacccatagtcaaacattcagtttccacgaagcccagtaacaggccaagagctgtctctcaaaaggagagtagttatctgcagaagatggcagggccttgctccataatccaagaggcctccgctgtgattcacctatggaggcagcattggatctgctgggttatatggccccagtggtagagcagcttgcacagcagcctggacctgtttcagagcgttctcctgttctggacctcactcaaaactggcagcccttcgggtcactcgataaatgggccagagttacctaccccaatgaagaatgtggttgcctgcaaaatcaaaataggcccactaggcattgtgcctctttcctggttgtaagattttactaattgactaatatatctatttcaagaatacaatcagaagccagggaaacaatgaaggaatgggtccataaatccactgggcttaccgtaaaatagacttataccacaacactgttgatcagaaggctatgataagcccctaatttagctgttagatggtgttttggggtctctaggaaagggcatttattcagagccaatttctaattatatctgaaaggtatgaagcaaaagagtactccatgtaaatgactgctgttcctttagggaaggcttggaggaagacttacaatcagatttctgtagtgaacccaacatgatacaatgaacacatattttgtccagtgaaaataaaaaaacactgacccttctaaaatggtccaacataataagtatgccagtaggtggctggcaggtttttcatggtacggtgccataacaacggttccatgttggtttgtgctgttggtaagctggacattcagcactggatggtagctgaataaactttgcttaggagaagcctttgttaatgattccatacgtagtcttcatctttaacacaaggctacatgatcctattgagcatacagagggagagccaaggaaaatagccagtattcacaagataaggcatgtgatccacccgattattgaaaacctgttttgcagtggattttttaaaataagtatacccatgggacaccaatatttccacacttttgcctattgtgagagatgtagccactaaccatttccttagatcttatctcagaatttccaaccttattcttttataaacccctaaccagtcagccagactgatagccactgccaataaataggtatagatgtatccgctgtaccatttatgtttttaggcaacataggtgatcagatatactgccaagatttctgttcacctgaaggcttttcattcatcactgtctttcagcgctcccattggaagacttgtaatccagtgactgtccacttatagctgaatttgggtggcacattgtacaaacctgtatggaaatcaggctagttttttttttttaatccattctctgatagctggtcatggtgagtatctcacaaagccgtaggtatagttgagggacatgtgacattgaaacaagagtggaagtttggaagtttacctgctcatgcaacttacttgtgcttttctgatgttctctagcacaatttaaattataattcttccttttttaagatgaattgcttttacatgtccagactcatgtctttgaggacctcctggtttatgatgagcaattcagtttacttagttgcttggtgttataagtcctcagtatctgtcagagctcatgaacatagtaggagctaacccttaatagagaatatgtaaaagtagttatcaacaaggtgaacatgccttttctccagaagtctggaggtcagtactgtggccctctgttggggcttgttataggcttcctatagtatcttcattttctacagatagtttgagcaccattgggtctgctgggccataaggcccaaggagaattgtcttatatcctggacatgttgtaaactttttggggtccaaacatcatttatactatgttctttattcagcatggaggacaaaagatacagtaactttgccttttatttagaagcattatcttaccatgttccaggcttcagaatttctttggtgtttgtttcttctctggcacaagcatattgctaagacatctagggtacttgccacttcctgctcatcagatccatttagggggattttagcaatatagtggaatataaagatggtcaaggttactttagtttgacagagaataggggagtttatatggccccgaggcaaaggagtagaaagttttctgctgcctttgtcatgtaaaggcaatttggattaactaccatcacagatgggaggagagaataaaacattcaccaaatcagtagcctcataacaagtagtagagggtatttttatctgcttcagtaaagataacacatatggcacagcccatatgttccagatctttacatgattctctcaatcttgtaccccattattttctgattgaattcttgagcaatgtttggacagtaagattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccacatctacatcctttgtttaaatctgtgccattttccaccaccctccccaatatgcagtattattttttatgaacttgacagggaaaggagcagttttcaagtctcctacttggcatttcccaccatagtatcatatatcccacaggtcaagaattaatgtggaagttctgcaaaataccaagtatgttctttcaacttgtttggaatctgttaaatgaccatcagatgggttcatggattccatcttactgtgagccagacctgggcaagctatatttattacttagtccctatatgcctcagcctcaaatctaagatggtggagggtgagagttataaaactatgagtccctgagtatcaacgccatgctagaccctgtgtcaacagtttcacaatgtctgggtctttctttttctgtagtgtattgttacctaagcctctggggaaggaatggaggaatcattgtatgtacttgctatggtgtaggaggatcctttttcatagggactgaacttctttcgtcaggaagttctgtgtgtgaaaactggctaagatctggaaaccaggcaagagatagtgactttttacaaggttgctgctctcagtatcctgatcatccatcctgtttcttctggtcgtacagattgaacattaccactgttggcttcccatctttcagccctttaaagattctatgttctattgactatcttcctagcgttctatggttcaggatatcctgatagcccttaccaccttgctgttcttttccataattgtgcccatcttgcttttgacatttacgtgcttctggctggcctctgctttctcaggagtctataatctaaattgctttcagggagtgtagttctctaataacatactctctactatcatcttagagaaccacaactgagcttctcaatgatgttgctgctcctctcaccttactgctttcctagtggacgtattctctggtcatccggtggacatggttatctcatgggatttttggccttttatggtgtatccactctcacaggctcacttctctgagtatttagatcctcctttgttgtggaatgtagcattggcttttctagttcacttagtttggtaatcactttttcccctaagcttcaaagagccatcctagcttcacataaataccagtttcctttctagggtgttaagttctgtgttatagaagagtactctcatattgataaactctgccttgtccaactttatattctacctctcttacctcaatgacctcaggacccaattcttcatgtactgtcgtggaacccataggtacatgttggctagttcctgcagttccttggaagtagttcttttcatctttataacagagtcattacttacctgaataggttttatttttatttaaatgaattttggtctgttggccagtaaggagggtggggaatatattgtaagaatggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgcaaaacaaacttagattaaatatatatatattttggttggatttaggagggcatctagcagagattttgagaggtctcctgaaactatccctaacctcctattgcagtttccccattttcctttaattctcactcccatccttctaaatctggtctccatgggctacattcacaaccttgcaggctgtctttcaatagttcattctatgtttcatggattgataactttccctaaaacatgcctctataagctcgtctaatcttccttagacaattgtatatctttacttctcaagccagttgggtatctagcttgttgatattccatgataattcttatatatcttttataacattataaatcacattttacttatatattttacaaagttggttacattttaaagtcaattcttatggtttaaactattttctcttgaattaggggaacaatttttgtgaacattagggaagccattttcttctgaaagttttttagccaatcagtggattactaaaatagtcagtggattagtctttgtaaagataactaaatattacaacataatttcattttacctgtggaatatattttatcctaaaggaaataagagccattatgcaattaattggatggtttttgcaatctcataagtcaaaattaagagaaaaaagttactgctttattgagactaagaatgatgattatacatgtgaaactttcagtgtgtcaacatattattttaaggaacagcagaatggaagagtgccatacagatttgaatagttttaaaaggtaatatttatacatagaatttccttttttgttgtagaagggaaaaaaaggatcaaatggtatccactgtagtccaaattcattactttaatgactccttgtagagttaaattggagctagattataatatttgtaatatattaaaaatctacctttcaccttgtattttgacctatatattcaatgacagtgcaggaaaggtgaaaaagcactattattaaaagtattttaagaaaatagaaaggaaattagaaaagataaggggctgctaacttgtttcttccatcctttttttgcccaaattcttagtcttttttgggttggaatgaaatgcatgctctttttttttttttttttttttttttttttgagacagagtctcgctctgtcgcccaggctggagtgcagtgtggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccattttggccgggatggtctcgatctcctgacctcgtgatccgcccgcctcggcctcccaaagtgctgggattacaggcgtgagccaccgcgcccggccatgcatgctcttttaaaagaaaattcttccctagtgaaaaaatatttagattgttttgtttctatctgtaaacatatttatatccctaataccccttctgggtttctgctggaaatggtgttttaaaatattataaagatctagtaagaaaacatagaagggaggattatgggaaggtggcagagtgggaagcaccagggatgcctcctcatctagataacaatggcactagcaaaatctgtctgatataatgatttggaaagtctagagtctgttgaagtctttcaatgtccacaggaaggattggacagtaaattatagttaagttgggtcaatttcaactcttagtatatcagcacctaccttcagccaccctagctctgtggcaggcagctgcacacaaattccaggagtaccttgcaggagcctgggtgggcaaaaagcatcctgtcctgcaaatatcagggatctgtgctcttatctctaactactgctttttatcatagaggtgcagacaaagagggttatagcaattgttgttttatcttactccattattcacccttgtctccctctctagctgaagtgatttccagggacttaaagggccaagtctccttttcccaccttcgtttttctcattccccactttggggagccaaacattaaagtctatgacattcagaagcaactgcatatatggggaaaattagaaagtgaccacacaagcctggggataggtggaggctcagaaaagtcctgagaaaacagtaaggttactgatccttgaccagagacagtccataacaataaatttttttaaaaaataaataaacacaaacaatagtaaaaaacccagcaaaccctggggaaggaggagaatctgatttccagactccaaattacaacacaaaatcatttgtatttctatacactaacaataaacaatcagaacaggaaattatcaaagcatttttatttaaagtagtgtcaaaagaataaagtacttaggaatttgtcaaagagatgaaagacttgtacaatgaaagctaaaaaacattgctgagggaaattaaagaagacataaataaatgtaaacatatcctatgttcacaatttctatcaaaatcccaaagaccttttttttgcaaaaacataaaaacccatcctaagtttcgtatagtctcaagggacactgattagcccaaacaatcttgcaaaagaagaacaaacttggaagactcatactttcttatttctaaactactgcaaagctacagtaatcaaaacagtatggtactggcataaagacagacatatagaccaatggaatagactaaacagcccagaaataaaccctcacatatatgatcaaatgattttgacaatagtaccaagaccaatcaatggggaaagacagtctttttaccaaattgtgctgggaatactgggtatctacatgcaaaataataaagttggacccttactaataccatatacaaaaattaactcaaaataatcaaagacctaaatataagacacaaaactataaaactctcagaagaaaatataggacaaaagtatcatggcattgattttaacaatgatttcttagatatgacacaaaaggcacaggcaacaatagaaaaactggactttataaacattttaaaatttggggcatcgaaagactgtcatcagagtaaaaaggcaaccaatagaatgggagaaaatatctgtaatcatatatctggcaaggaattaatatacagaatatatagagaattcctaaaactcaacaacaacaaaaagtccaatccaaaaaaggactttaataacacatttctagattgaagatatataaatggtaaagtacatgaaaagatgcttaacatcattaatcattaaggaaatacaaatcaaaactgcagtagggtatcacttcagactaataagggtggtttccattaaaaacaaaaagaaagctggtgaggacataagttaattggaaccattgttcactattggcagaatgtaaagtggtatagtcactatgggaaaacagtatgacagttcctcaaaaaataaaaaatagaattaccatatgatctcacagtttgcacttctgcctatatacacaaaagaattgaaagcagcatgttaaaaagatattttacacccatgttcatagcagtgttactcacagtagctgaaacatggagacaattcagtgttcattggcagctgaaggaataagcaaaatgtggtatatacatacaatggaatattattcagccttaaaaaggaaggaatttctagcaaattccacaacattgatgaagcttgaggacattatgctaagtgaaataaaccaataacagaaagacaaatactatatgattccgtgtatatgaggtactttgagtggtgaaaattataaatacagaagtagaatgatgtttgttagggctgggggagagggaatgaggagttactgtttaatgagtatagagtttcagttttacaatgaaaagaattctaggagatgggtgaggataattgttgcagaaagttatataaatgcatttaagaccattgaactgtatcctaaaattggttttatgttatgccattaataacttatgatgcatttttattacaataaaaacattattaaagaaagatcatttccatatggctaggaacagaaggcatgttaggaaggatacataaacattgcagtatgtacaacaaatatgttaaaacattttatatcttaattcaaatgtcaaaggttaaaagaaaaaataacttatgttttgggaaatattcacatcaacttcatatttaaagaagattttaaaaacgtttaaagcagcaatttaaaagcctacagtaaaattattagattatttgctcaggcagcagctggtttagcaacatttattcagagcttattataagaaaaatatcttttgctgaagtttttaaaaaatagcttctaattgccattaataacttatgatgcattattttttaatcatttaattttatgtttattaatcaataatacatgttatatacaaatggcttttcaaagcttggtttatactaccaatatagctattaaaataacagctttctcataaggtatgaatgagttttcaaaagctatagctgagttttcatttttgcccatttattttaattccttttgatctttagaaattatatggccaggcgcggtgactcatgcctgtaatcccagcactttgggaggccaaggtgggtggatcacgaaatcaggagttcaagaccagcctgaccaatatggtgaaaccccgtctctactaaaaatacaaaaattagctgggcatggtggcacgtgcctgtaattccagctacttgggaggctgaggcaggagaataacttgaacccaggaggtggaggttgcagtgagctgagatggcgccactgcactccaacctgggcgatggagcgagactccgtttcaaaaaaataaataaataaatgatacataatattttgttaagggaaaaaaatattttagcttataacttatccttgtgtaaattaactatcataatcaattttttgtttaccttagcatctgttagcaaattgtattatgtactttggcaaatattcttttagagtatgaattagtttgaagcctaatatgtattttagatccaggtctaccacttattacctgtacaaacatgggcacattacctaatttctatgtttccatctctataaactgggaagaataccatgtttatcaaagggttttttgttagtattcaatgaaataatatatgtaagatatctaacactgtgcttataacaggatttagactcaagtaattttgtttcgatagaaaaggttatttactaagggaagataaaagatctctaatttttaatactatttttctcttttaagtgtgacataagttacactgaatatgtctgctaaagacttccagattcattactttttaactactttagccattttattatgcaatggcatgaacaatttaccagtagttttccctgattgtgagtatagtttccctgtttcagattatatacaaatagaaacatggagattagagaattacggtggctaattctgatgttccaatgtttgcatgtcccctgttacatatttaaaagtgcttctgtgctcataaaacctgtacacaactctcagtttctttagggctattctatattttgatttctttaatgaaaaaatggaatgttatttaatatctttatcataacacctgccagttattatataaaataggtggtaatttaaacgtaaccatatgcaaatgtgaaaaggagagaaaggtttcctctactctgatacaatggtatatgccattgtgttgtgttatgtcaccctggcatgataatggcacacttcaactaatccacttaagtgctgatactttgcatttattgtagagtttagttgcatttagtacagtattcttgaatgtttctttgcagctattattattactttttgcctaaagtgtcattgcataatgcagagtgactctggcatcaaccaaggatctgggtgctattttgcaggatttgtaaatattacaccaaaatgttaaataattttatttatcacacatggagtttctaaaaaagaatttagttttacattttttcagtttgaaaatatggaagttggtaagaaatctataaccatatgcaaatgggaattttaatactaataatatgaaaatagtgttgaggctgggcacggtggctcacacctgtaatcccagcactttgggaggccgaggtgggtggatcacaaggtcaggagttcaagaatagcctggccaacatgatgaaaccctgtctctactaaaaatacaaaaacattagccaggcgtggtggcgggtgcctgtaatctcagctactcgggaggctgaagcagagaattgcttgaacccgggaggcagaggctgcagtgagccgagattgcactactgcactccatcctgggtgatggagcgagactctgtctcttaaaaaaaaaaaaacagtgttgaatatcttcagcagttgaaataattcatttaaacatctctgaggaaatatatttaccaaaatatttatttataatatcatgccatgttaaatagataagaattaagccaacatatttataattctgtgctaagtagaaaatcaaataaacagaaatacttacattattacactaaatatattctgcttacataaagagaagcaaatgtgaatcagaataaaagtaattaagagatactaattattcttaggttttaaactctgctccctatttttggattatgcatgtatagccctggatcatttgaaaatgcataactgagactgcagtaaaaaaaaaatgctgaggatttacaacattttgaaaactttggtcattataaatacttacattagctatatttcaactgttgatttatgaaaaataagaatttgtagattaaatatagcataatgaaaaaataatattcaattaatgttttagttaaaatatatcacatatatttgaatataatatataaattaaaatatatttttaaaatgaaaattacaaaatacatatgtagtcttcaacttgcttttttgattcgatttttgtttctaagagtctttagtgttgctgtaggtggctctaggtcatttcacaatatttacttttttgtattattgttacaatgttcagttggtttccaatgtcttggaaataaacagtgctgccaagaatattcttgtatgtctccaagtgcattagtggaagattttctgtaggacacaaacctaggggtggaattggggatgagggttttatgaaatagtgtcatttttttttcaaaccagttgaatatatttataaacccacacagagagctcctactactctatatctttctctgtattcattattgccagggttttttatttttcccaagcaaatgaaatatgtcgcctcactaggtcttaatttctatttttctgattactaattaaattgaacgtgttctttttcatatgttagcttctgtgaaataacagttcatatcttttgcaatttttttccattagattgttggcccttgaagtatacttgaaatgtataattgacattaattttgtgatcaattctattaatgcggatatcttgctccacatggtgacttatattttctgtttctttattattttttcagtgaatataagttcttcattataatgtagtaaaactaatcagtactttcttttatgatagcacttactgtcatttgattaagaaacccttttttatctcaagatcagagtactatgttcatatcttttttagcatttttcttgtttattttttcctttaccaaccaattcagacataaaaacagatattatctttcataaacccaatataattatctaaatcaagaaattaacattgataaaatacttttattttaatctatagaaattatttaaattttactgtgttgtactgtctctgtaatttcttaaaactaatatttttactttgagatagctttagattcacatacatatgtaagatataaatcagagagatcccatacagtctttacccagtttcccctaacggttacatcttggaaaactataatatagtatcaagattaggatgttgacattgatataatcaaggtatggaatagttctgcctgccagaggatccctggtgttgcccttttatagccacactgatttccctttagctctgtccatgcctaaccccaggaaaccactaatcttttcttcatttctgtaatttttttaattttaagattgttatttaaatggaattatataatatttaacttttgggggttgactgttacacttggcataattccactgagtcatccaagatgttgtgtggatcagtagctgatcatgttattaaattgctgagtagttgttgattctctttaaaatatttgggagaattcaccagtgaaaccatatggacttgggattttttggatgggagctttttaattattaatacaaatttaatttctttaatgcctatatgactattcagattatctcactttacttgagttttggtagtctgtggttttttaggaattgttccatttcatccaagttgttaaatttatgggcataaagttgtttatagtgttctcttattattcttttaataactgcaagatctatagtgataccactgttttattcttgatatttgtgatttgtttcttctcccatttatttttgtcagtcttgctatatagcaatttatcagttttatggactttttttcaaacaaccagcttttttgtaaacttttgtattaatttcctattttcaatttcattgatttttgcttttatctttatttcctgtcttcttctagctttgggtttattatgttcttccttttagacttttttgaggtaacaacttaaattattgatttgactttttaatcttgtaatgtaagaatatagtgctataaattttcctctcagcattgtttttgctgaatcccacatattttgttatattgtatttttgtttttattcagttttgaatatactttacttccatcaagtcttcctctttgacgtatagattatttagaagtgtgctgtttaatttccaggtgtttagagattttccggtttgatttctagtttgattccattatggttagagatcacattgccttttgttgctagattgggagtcagggctggctcaccttcttctgttgggtggtgaatgataaaatgccctatcattatgctcttcctccagtcctggaatctctgatcattttacctccctgtttccacctttcagagttccccttagattgtctcttgcatcatttccagggtttatagtttagttaccagggaagaatgggggacagttgagtctacaccactttggctggatagaacatcacttcaattttgctttacaattttaaatatttaatttccttgaaattgatttttcatgtagagtatagtaggaatccagtttcactttgttttattcagataattgctgtttcaacacaattatatggttcttcagtggtctgaagtatcagctctaactgttatttaactagtttccatgcatacatgagtttgcttctggactttcttttatgtttcactggtgagtttgtttattcctgtggcagtagcatacctctagattattttagtttttaacatatttggatatatcctaaggtaattatcttcaccttactattattcttcttcagaagtgttttagctagtcttatacctttatttatccctataaatttaatagtaggcttgctaaattcctaaaaaaattctcataacatttattgaaatattttatatttttatacattaatatggagattctagcatcttttcgatattgaatctttcaatgcgtgaatgaacatagtttatctccccacatatttggacattctttaacatctttcaataacaattttataattttccccatgcagatcttgtacatgtttttgttaaatataattctaagtaccttatagttttgctcttgtatatgatatctttttaaataaataagcttgttcctttgttggctttgaggcctccttcaacagaaatcaagagaaagcttatgagctcagtgcgagaacagccctctgtctaactccatgcctccatcagcagcagtggacagggaactctcaaacttggaataagaccgtacctctgcaggacactattggcaggagacaagagaacaacagtgcacaccagcacatcgactaagactgcccatcttcaggacatttgtcagcaggagccaaatgggaaattctgagcaacaggtgttcctggcttgttctcctccaatcctccctttcgtcaacacccataccctttatctgtgttctttacagtcttcataaaaggagtccaggacttccagttaatcatttatcccagaactctaatcctccgtaaggatcctttttttttgacccaatatttccctcttctgactccccaaaccctttctttgtactctattgaattcaaggtcagtcaacaaaaaagtcctttatattttaatattttactatgagtgttcccttcaccttctgtgctaatgaaaatctagattttccttcatgatagtttcccctgcatccattgaggttctggtaaatgttttaacaatcaactctttggaagaagaaaacaaaagccttgatttgtatagtgttttccagtttctgtgctgttaaacactcacaccatagccatttaagctatcttctcacttcactgaataaggagcctgggacttgatgtccacactcagctctcctaagccagtatgagagagcaacaacacatcacatcttacagtacctttaagggtaactgttctctctactccactcaaatgtagcataggtcctgaaagtcagataagtgtcccctttgcttctcattgctgctttcagtttgttctccctccttcatgaacatacccttccgtgaatctcatgtcatcagatttgcccactcattgtacctttttgttatgggcacctcttctcacctcatctttttgtcaattaaaaaaattaatccccgtgatattgtcactttcttaaaagtgattcctccataatgcttcatgattgaaatgttgatatggatgatccttctaactctctgaagtttcagttccttgacagcctctcctccagtgatccacttaactcactttcatagtcatttcctaggccttgttattgcaagtaactgctataatttttcattgcctctattgtttgctccctaccccccgaatctctgcatactgaggtgtttcaaggctcagttcttgaccctctgttggttgtcttcactccctaggtgatctcatccagtcttatggctttaaattctgcctatatattaattatcccttaatttacatcttcaactgagatctcttctctgaactctagtttcatatatccaactgcttactgaacacctccagttaaatgtcatttcttcatttcaattatctccccttccatgttctccttcttaattaatggaaactccacactttagttacttagccaaaaaactctagagtcatccctgagacgtctctctctctcacatctcacatctgataagaaaaagaaattattttggctctatctttgaaaaaatatctacattttcattttttcttaccactagcacttttgctctctgtttttttttttttgccaccgtctgtagtttgtattattgcaaaagcctcctaactgatctctgcttttgtctttacttttcttcagtctcttttgaacacagcagccacagtcatcttcttaaaacataagtctgtccatgacatttctctgctgaaaattttccagtaacctcccatcttactgagttacaggtaaggtcattataacctctgaggccctacattacctagatcccttttacctctctgacattatctcctgctaccctcccatcttttgctcaattgcaggcacactagcctcctacaaattctacttatttatagaacactgtaggtatgccccaccttgaggctcttgcacttgagtttttatcttctgtctgtgttattttccttcagataattcagatggctcatctctcactttatttaaagctttactcaaatgttcccttttcagagagacttttcatagccatccaatctaaattttaatgctgcctctaattcactggcacttctttggcctctatcctactttaatttttctttttgcctatcttacatatctctcatatgctatgttgtacttattaactcattgtatcacttcccactagaatgtaagtcccatgaaagcaggaatatttattaattgtattcactgctatattctcagtgccagaaaaatgcctggcaaatagtaattatcccataaatatgtaaatttgaaggaatgcataaattaaaaaatgtgttttgttagttgctattgtatagatatgcattgattactacaagttgatcagaaatagagtgtttctgctaaaccccctgtttctataatttgtctataggctttttgggaattttctttgtaagtagtatcatctgtgaaaaataatagttgtgactttcatttttcaattctaaaaatttttatttgtatttcttatatttgtgctttgtctaggtcctccagaaagttaaatagaagtggttaaatagtggtggttatactatttgtgattttaaaggtgatgcatctgatgtttcaacacaaggaatgatatttattgtctttggtggttattctttatcaagttgaaaaaatttgttttcctttgatatttaaagtttgtgttttaccatgagtatattaatttttttgaccataagtgattggtaattttatcatgtttaagttttaagattttattttatcatgaataagtattgtattttctgcttctgagactgttttctccattaatattttaatgtggtaaatgttgccatggattttaaaatgtaaacattctctttcattcctggaataaaactaatgtattcatcatgtgttatttgagttacataacactggacctagttaatcattttttcataggatgcttacttctagtttatgaataaaattgatctttaattttcctgttcagtcactgtctttttataattttagtatcattgaataagttgtggaatagttcctttcttctattctttgaaagatttttataccctggaagacctattccttaaatgtatggtagaagtcttctgtaaaactaattggaactgttatatatttataggaagattttatactgtggattcagatttctttgtaatgtaatagaagttatttcttccttaatcaatttttataaattctgaagtaatatgcttacatgaatatgaccatttcatctgagttttaaatttactggcttaaaatatttatcatattttttattatcttttaaatctcaaatggatccataattatattctctttaatttgtgaattctatttcttgccctcccttccaacagttttcccctcccttcccatctcacatcattcttcctgtaaatatataaattttgttggtacttttaaagatccaagctttggattttataatcattatgtttagcttttttcttgtataactttgtagtttcattgttatgatcttcttctgcctatagtctttgagtttatgctttgtttctttttccagcttcttaagttgatacataactcattaatggttggcttttctactattttaagtacttaatactattaattttccccaaatactgtttcaactgcatcccacagatgtttatatgtagcattttaatttttgtttagttttaagtattttaaggtttccattatggtttgttctttgtcctgtggcttatgtagaggacattttcaaatttacatatgcatgggttttgggttatttttttatttgggttattatgtatttgtagttgaaataaatcatggtcagaatgcatggtttgtatgaaaccaattcttgaaatttcttgggagttgctatggcagagatttctagttttctaccaaaaaatgttttctttattcctgtagttttcatgatatagctgggcatatagttaggtacctgtatttttcagtatcctgtacacctagatgttaccatgaaactaaatgttgccagtggaatttgcacttaatagttgtgtgtttgtggaattacctttcagaaatatttactccctcccatcattttaaagaaaggattctacttccctgatttttttagtctttgtttttttcttttttttgagacagggtgtcactctgtcacccaggctagagctcagtggcatgatcgcggctcacagtagcctcgacctcccagggctcagctgatcctcccacctcagccttccaagtagctgggactacaggcctgcaccaccacacctggctaatttttatatttttttgtcaagatagagttttgtcatgttgctcaggctggtcacaaactcctggactcaagagatctgtctgtcttggcctcccaaagtgctgagattacaggtgtgagccactgcacccagctgtttcctgattattgatgtagagcttggccttggccatgtaacttattttggtcaatgataatttgagaaacctgactctacagaagcttgatatatgcttgcacatttaggtttgctctgtctgccatgggcatgaaaagaatgcggccatttcccttgataatatatgttcttcagaaacattagataatgtcataatgcattattacttggatatttcacaatgtattttatgttcccatgtctactcattttgtttatttccgttgttttgctgtttcaaataattctatgaggcaattcttatacattaaattctgttcatatcttattgtttctttggtataaaactcaagaactggtgatcttggattaaaggatataaacaagtgtttgttctattcttcatttttacagtgaaatacaaaaaatctcctttaaaaagctactccttgcatttcatgttagtatttgcctggtacatcttttttcatccctttattttcaacatttctgtaatatgtttagttgatgtttctaggaattagtatatagtgggcagtctctttcatttatctggtgattttgtccacttatatttatttaagtgttttccacttattttgattattcatgtttttggacgtgtttctaccatcttattttttgctttatgttaatttatctttttatgcttgcatttatctttccttgctttataatacattgatttgttttcactatgtatttttctctttcagtgtttgctctgaaaaaatttagcatgcacatgtaatacaatctaaaattaattacttggataatagaaaaacttcaaacgttttaaataagatcaaaacacttcctatttacatatatttttgtctggtcatatattttttaatataatgaaacattattatttaagaaaggtaatttataaagacaatgcttatttcaatttatctacaaatttactaattttatttttctaactggttttaggatctcatattatctttttttgcccaagtttcgtcataataggtataattttttaaaaatttatttcatggactgtattatgtttcctgtatttaggtggcatgtcttttatcatttctcagaattcacactcatgattgcagtaaatatttcctttcctccattaataaaaattcattcctttcagagatgcaattagatatgttatactatctaattctatctgccatattatttaaactctcttttacattgtttatattcttatctccttatgctcaattcccaaaaatttatttatagttttttttaaattttattattattatactttaagttttagggtacatgtgcacaacgtgcaggtttgttacatatgtatacatgtgccatgttggtgtgctgcacccattaacttgtcatttagcattaggtatatctcctaatgctatccctcccccctccccacaccccacaacagtccctggagtgtgatgttctccttcctgtgtccatgtgttctcattgttcaattcccacttatgagtgagaacatgcggtgtttggttttctgtccttgcgatagtttacagagaatgatggtttccagtttcatccatgtccctacagaggacatgaactcatcattttttatggctgcatagtattccatggtgtatatgtcccacattttcttaatccagtctatcgttgttggacatttaggttggttccaagtctttgctattgtgaatagtgccgcaataaacataatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcatttttcatgtgttttttggctgcataaatgtcttcttttgagaagtgtctgttcatatccttcgcccactttttgatggggttgtttgtttttttcttgtaaatttgtttgagttcattgtagattctggatactagccctttgtcagatgagtaggttgcaaaaattttctcccattctgtcggttgcctgttcactctgatggtagtttcttttgttgtgcagaaaatgttatccagcatataaacagaaccaaagacaaaaaccacctgattatctcaatagatgcagaaaaggcctttgacaaaattcagcaaccttcatgctaaaaactctcaataaattaggtattgatgggtcgtatctcaaaataataagagctatctatgacaaacccacagccaatatcatactgaatgggcaaaaactggaagcattccctttgaaaatgggcacaagacagggatgccccctctcatcattcctattcaacatagtgttggaagttctggccagggcaatcaggcaggagaaggaaataaagcgtattcaattaggaaaagaggaagtcaaattgtccctgtttgcagatgacatgattgtatatctagaaaacctcgtcgtctcagcccaaaatctcctcaagctgataagcaacttcagcaaagtctcaggatacaaaatcaatgtacaaaaatcacaagcattcttatacaccaataagagacaaacagagagccaaatcatgagtgaactcccattcacagttgcttcaaagagaataaaatacctaggaatccaacttacaagggatgtgaaggacctcttcaaggagaactaaaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagtacacatggaaccaaacaagagcccgcattgccaagtcaatcctaagccaaaagaacaaagctggaggcatcactctacctgacttcaaactatactacaagcctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttcctcacaccttataaaaaaattaattcaagatggattaaagacttaaatgttagacctaaaaccataaaaaccctagaagaaaacctaggcaataccattcaggacataggcatgggcaaagacttcatgtctaaaacaccaaaagcaatggcaacaaaagccaaaattgacaagtgggatctaattaaatttatttattcttaattgtccagttctctttctatatgttaaatctttttacaaatgctttgtatttttctaatgagtaattgtatgttttacttctaaaggtcatatttgattctttaaaatttttttttaattattggtagctcctttttacttgaacttatttgtgtgtatactttttgtttaaccatttctaggattatgcttccaaagcttatggctgacctaaagcttactctccaaattgcagttctggttttggcatttggcaacataccccaacagtaagcatgtgcttatggttgctagctcctatacagttattttactttattttgtccataagctagtaatcgtaaacacatgctttactttttcactactgtcgagtgtaacaatgcaacaagatgaacctaaggtttacttaagtgccagttgtttttgtagtgggagaatccttcaaagtatgtagtcttacatattgctggaattaaacatcctacagttaattttagctattaagatttccattttttatgttttttggaagaatataagtaaatgattgtcctaatttaatccatggaggaaaattataacaatttttaaaattttatactatcatggatacataatagttacacatatatatggggtacatgtgatattttgatataaacatacaatgtgtaatgatcaaatctgggtaaatgacatatccatcacctcaaacatttatcattcctttctgttgggaacattccaaatattcttttctggttattttgaaatatacaataaattatcacaaactatagttgccctatggtgctctcaaacactagaacttattccttctatataactgtatttttgtacacattaaccaacctctctgccttttctctcccaccttcttttcccagtctctggtaaccaccattctattcattacctccatgaggccaacttttttagctctaatatatgagtgagaataagcgatatttgtccttttgtgcctggtttgtttcacttaatgtaatgtcctccaattccatccctgttgctgctaataacaggatttcattcttatttaagttctttattcagaattaaagtattttatagtcaatggataaatccaactcttgattagtttatatgttctagggaggataagagaaagcaaaataagggttttcaaagttctttaatctggttagcacaaaggctacaggagttgaagtatgccaaaaaagaggtttacatttggataataagaagaggcataaagtaaaataaaattatagtcaaaagtgaggttgccttaggttcagcatctttaagctgatagtggcaaaggcaatggtcaattactgtaaatgtcattttctcacccttttcaatagtttcctgttttccagaattttgtttttttgatgtatcatgaattggatagtggagctttgtagtagaagaaatggcttattaactatgtgcagttactttattcattcatttctttactcatcagaaatttgcatacagtttgggaggcagtgggtaggaatgggagataccaaggaagatggaaaagccctgcttttcaggatttcacacgccagatcaaatggatttcataatcaaaacaaaaattatttcacttgattctaaattgctaactttggaatagttgtgtatatatactaattgagagccaaggtgatgtcattattttatttaaccatacattaagttgtaatttttatttatgtgatttatgaaataatgttatgaaccaaaataagtcaaagcattgtattttaattaatcaaatattaacaattttaattccctctattaggataaaggatgttaccatattatacagaaaaaagttcagtttagaaataagacctaagcggtgtgctcaccattgttccatctgtatgggcgcacccttctatgtagaagtaacttgccttgctgagaattaaaaagaaaattttatatgcgagtgcaatttcttttgtggcaccaaaactttatatataacaatttggggtctctcccgggattacattctcctccaggacggtctctcctctctcgtgaggaggcgcacccagccctagtgtggtggcctcaggggtgagaaatcaagacccaccccagtgcaaggaataacccgagctctcagcgacgcggatttaaaaaaaaaaaaaaaaaaaaagggaaaagaaactggccagcaacctagcttaaaggactctcacatactgcggcgaccactctgtgcacagaccaaggaaggagaagccgcgggagcgggtagagtaccttggtggtcaaattctggagggctaaatgtgtgtgtgcgtgaatgatcacaaacaaccctgcttgcagtgttgttcgtgtggatggtgacaagtcctactgctggacagtgtgagtgggtcctctttgcagttctaccttggcggagcggccagagaggacagcacaagtgggaagtgtgcaaaggaccttcagagggggaaagggagaaataggtcaatcttccaggacaggcaagacaccccctggtttgaggggttgagccttccagggcaagcaaggcaagacgccccctggtttgagggcttgagccttccaggacaggcaaggtgagacaccccctggtttacggggttgagccttccgggacaggcaaggtgagacatccctagtgttgaggggttgagccttccgctaatttcaagggttgaacttgacacaacccccccgttcaacccctttcctttcttctcgggagaagaaagagtagttgcactcccgcaggtccctaccctaggagagagagagacaggagagagagagagagagagagagagagagagagagagagagagacagacagacaggagagagagagggggagagagacagagaggagagagacagaagagagagagagagacagaggaaagagagacaggagagagagagacaggagagaggcagagagagacaggagagaggcagagagagacagagaggaagagagacaggagaggcagagagagagagaggagagaggcagagagagagagacaggagagaggcagagagagagacaggagagaggagagaggcagagagagagagacaggagagaggcagagagagagacaggagagagaggagagaggcagagagagacaggagagaggcagagagagagacaggagagagagaggagagaggcagagagagacaggagagaggcagagagagacaggagagaggcagagagagacaggcagagagagggagaggcaggagagagagaaagagaaaaatagaagtagtaaaaaaacaaaaacaaagaaaaaaaaacaaaaaaaccagtgtaccctattcctttaaaagctagggtaaatttaaaacctataattgataattgaaggtcttctccgtgaccctgcaacactccaataccaccttgttgtaagtgtaaacaagggcatagccagaaagcactgaggccactgacaacctgtagccttcctataaaaaatccttaacctagtaatctgcggatggccaaatgcattcaatctgtagcagcaactgctttgctaacagaagaaagtagaaaaataacttttagaggaaacctcattctgagcacaactcaccagtttagttcaggactatcctaagtcaaaaaaagcaaaaaggtagcttactaactcaaaaatcttaaagtatggggctattctgttagaaaaagatgatttaacattaaccactgaaaatccccctaacccagcaggtttcctaacaggggatttaaatcttaattaccgtacaaaggtccgaccagacccaggaggaattcccttcaggacaggaccatagatgtttcttcccgggtgaatgagggaaaaagacacaatggttattcagtaattgatagggaaactcttgtagaagcagagttaggaaaattgcctaataattggtctgctcaaacatgcaagctgtttgcactcagccaagccttaaacagaaccaggaaggaaccatctataccaattctaagttaatttggactaaacaaggtcttattaatagtaaagaataattaaaatcccaaacttagaaggttttcaagaaacgtagcttgctaaaagttagcagtgtaacacgtattatcctaacttttaatcttgtggccttagacagtctagtccacagacatgaaggaagttcgctttgaaaaagaatggttatcttcaagagggaaaaaaaaaagtggggtgggagaatttacataaaaaggaatgttccatggtaaattattgtcctgaaataaattaactgttttttttttttaaaggggatgtttgtgacaagtcagaaagttgaggcatgtcgaaaaaatatctctgaaagttgtgggaaaaaaaggttataaaagggaatttatgcaagaaatgttgtataatttaaaagtaactaggcctcctgaatgtaaaactatttattctataaacagtttatgtgcaaggtgtgtaagaaaagtaaaatatacttttggtaaaaagattgtagggaggcataagaatgtggatttttacctacattaacaggttaaaaaatatatattttgttttaaaggtttaagcaagttgtaaaacgttaattgtaaagaaaattgtgtgtgtaaacatactcgctaaagttaaagaggtatcatccagtttttctgtgaactggacagtaaaagcataacaggtttttcttaacgcactaacctgctctttaacaaaaattataaaaggttaaaaagagtctataaaatcttaccttagggccagacattaaaaattgaataaatatatctacaaagttttattaaaactaagtttaacattaataacacactaatataaaggtgaaatttagctcatcgggtataaaaatcatacaagaagcattatcaaatataaaatggtatttggctttctttggtctaaaaactaataaaaataggtgctaaaggaaatttctcagtaagaaggcaccaaggactataaagtcctctgcagatgtccccacacttaaaaggtcaatttcttagaaattatatacttggtttatcttccactttccttttcctcaaaactaaaagtcttttagcacaggtaccatccctagaatttccggtaaacgggaaccagcctgaagatcacgttcttatctagggtggaaagaaagaaaactttagcgatcctgggaaggaccctaccttgtgctgctaaccaccgagactgctgttcgtacagcaaaaaggggatggaatcatcacacccgagtcaagaatgtgccaccccctccagagtcgtgggccatagtcccaggggaaaaccctaccgaactaaagctaagaaaaatttaactctctttcatctattctattactctttattctttcctctatctgttgctgaccatctagttattaacataagcaagtcaattttgcctcaaactactgcatttaatgcttgcgttgttataccctgaaggaacttaccaggtcaaagacagttttctatttcagaaaaggaaaagtacctgtgtccctcctgactcttctcagactgggcattagtaaattgggaccatttaatccaaggagatttcgataaagacctaaatgtcaaccaggagtcttgcccccgatgtagagcttttatgctgtagttggtccaacgttctgtggcccactgaagagcaaagatggactgcaaagatggactacaaaaaccaactggtttttgtaatttcctaaaaccctacattcattttactagagaatcatagaagttaaagacttaaactttggcaattaagacaggataccaagatgcaaatgcctagttggaatggatcaaatattccgtccacacattaaacaaaagcaattgttacacttgtgcgcacggcaagccagaggcccagattgtcccctttccactaaggtggtcctccagtcgaccaggcatgggctgcatggtagctcttttccaggattctacaccctggagtaataagtcgtaccaagctctctctctctgctatatcctgaagtccggcaccctgcgggtcagcccccgagggccatccagcttccgtctcccaacagtaagttaactttgtgtctctcatgacagggaggaaacctagtgttccttagagacctgaagggatgcagtgagcttaaaaattttcaagagcttatcaatcagttagcccttgttcatccccaagcagatgtgtggtggtattgtggtggacctttactggacactctgccaaataactggagtggcacttgcgctttagtccaattggctatccctttcaccctggcatttcaacaaccagaggaaggaaaaataagacattgtaaagcaagagaagccccttataggtctttcgactctcaagtctatttaaacgcaactggagtcccacagggaatatcagatcagtttaaagcctaaaatcaaatagctgcagaatttgagtcaatattttggtgggcgaccattaataaaaatgtagattggataaactatatctactacaaccaacagcgatttattaactacactaaagatgctgttaaaggaatagctgagcaattagggccactagccagatggcttaggaaaatagaatagccttagacatgatattagcagaaagaggagtttgcgtcatgattaaaactcaatgttgtatcttcatcccaaacaacactgcccccaatagaagtataacaaaggcattgcaaggtctgactgctctatcaaatgagttagccggtaactcaggggtaaatgacccctttacaagatggctaaaacagtagttcagtaaatggaaaggaataatagcctcgattcttatttccctcgcagccgtaataggtgtacttattcttgtcaagtgctgtgtcataccatacatccgtaagtagatgcagaggctcataaaaacggcacttactaaaacctcccttaactatcctccaccttatccagagaaacttcttttgaaaaatcaagcaaaacagctaagccatgttaaaaaaaaaagaaaaaaaggtttgaaaagaaaactataaagaatacaaggggaaggattgttagatatgggttctaaatttcttttcaaagaattaatatgtcagtatgttcaattctttgccttttacttgtaaacttcctcgtgaagcaacctttttcgtttccctgactcatctgattacctactccaccctgactcattctgatcacctactccaccctaactcattccgatcacctgctccaccctaacacattctgatcacctgctccaccctaactcattccaattacctgctatctgctctgccctgactcccaacaaagcactcaccctgtcattctctttaaattagccaatcggaattagtttaacctgtgtggtctaaccctagccaataggggaacaacacagcagcaggggccacatgtgtcagggataagaaccccttcccctcccttgtccaagtgtgtgctcaccattgttccatctgtaagtgcgcacctttctatatagaagtaacttgccttgctgagaattgaaaagaaaattaaaaaaaataataattagacatgggcattgttactctaaagagcacctcgtttaacttttatgaatcaaagttttatcctatgttggtcctcaataaatcctatcatacttcccatattaatttctgtaagttaattagagtgacatcttgtgccactctcagtgttttgtttgtttatttttttttgtttgtttggcttttcacttctcactagtttcctaccctccagaatttcccatttttggagaagcgctaaaggcttagttctaggactgattctatgtcacaggggcaatgaagaaaataaatgaaaccagcatggcataaaatatagaagagtaagaggagaatataatgataagagatagatcctaggagtagaggcaaataatagtgtcataaaggaaagatttaaaaaatgaaaattaaaaatatgaattgtctcatccaaaatgggttagaaaattaatttaaaacattattattaaattgataattttaaaatctgcaatgttagatttatagcactggatctacatactatgtataatgtgaggatctttataatatcaggtagtcttgagttatattgggtaatgctgttaattagtatgttgatactataaatggtgttttatagttggtactataaatgatactataaatgagactataaatggttttactgaagcataaatgaataggataattgcattaccattcttgttgcattttctgaatgtatgttttctagagaaaatgctatgctatttcatagaagttcatgtgtgtcataaaaactaatcctaagtgttcattcatttctaatagtatccataagattaagtattatttaaatttttttgaagtatcaggttgctgaaatattagtctgaggataacaaaatccagtaatagtttttcttcctacaaaggtcatagttttatatgtgtgcatatgtgtctatgtgtgtgtatatctacaaattaattaaaattgttgagcatctcatcatgtgctagacattgtataggttatactttacatatgtttccaatttaaaactgtcatatgaaatttaagaactttcttataactattgagaggactacatatattattcaaatattatttatattttaaatatgtttttaaaagatattacgagccaagcacttgtagcacagactagtgcataattaaggtttctgatagatttggtgaattaacaaaaaattgttaagttggtagtgagctaaaaagatggcagggtaaattaacaaaaatggaaatacgtgatactccatatctcatcccttggaattatggatctgactacatcatcattatgtctggccatgacagcacaaaccaacaatttaacttcttttcgatctaatagtgtttggtacatgccataatcatattgttagttttttgggatatttcacagtgcaaacaaagttatgacagattgatcagaagccctgggtctggtaaaatagaatagccctggtctgtttttatccaggtgtcactaatcttcatgtttaactttgtacctgaaaatataaaataatagctaattgtgctttcccatttcatttatgtttcttcaaagaaccacaggatttttatgtttaataattcattttaaccactcttttccaatgtagacagtaggaaacactaaatgcaaaaatatgtgcagtaggtagtctccaaacatagacccctcaattaactacacctcctgctattcagttcctagtgtagttcctgctacagtgggtctgagctaatggatctatgagctttcttttagcattaattacttggaaacaattttcagtttcttaaaaattcagtttatttaagcatgttaatctgaaaatttctttattattttaagattagttccttaattaattagacattttttactgtagaatatttataaatctctgttctttattaaaaaacctgaaaattttaaattttagtttaatttatagcttgaatctagatttcaatttgtttattcttattttagattatgacttttgagttttcaaattctcattttcaaacaggaaaatgaatataaaaatgtagtgttgagggactgtttttccctctaagtctggactgtcacatgattaatgtaacataaaagtgattttatatcacaaaagtgataaattcccattcttgtgacatactgctaatgcaaaactttaatcactgtgccttcaataggaagccaaaatagtctgacttaaatttaatgtaaaataagtaataaccgctgataaactatttgacctagagtcttataaatgataaatgaggacttaaagctctaatttgtcccttcttaatggactatatatgtatataagtaactgatgtcattgcttcattcttggtagaatgtgctgtctgttctttgtgacatagtcacatggatggcagcaggcaaagagagaatgaggaagatgccaaaatggaaacccatgataaaaccatcccatgtcatgagacttattcactaccagaagaacaatatgggaaaaccgcccccatgattcaattatctcccaccaggtccctcccacaacacgtgggaattacgggagtacaattcaagatgagatttgactgggaacacagagccaaaccatatcaggcagccaagctaaagcttgatgggtaggcaggaggaagctaggtaagagaacaaggagaggctgtgccagcacatgcaaagatctagaggtcagccccaagcttttcagaggggccagggaagcatgcaaggagcatgcagtgttgacagctgacctgggccaggccatggagttcctttgaagccatgcttaggaatttaggtcattatctgaaggtacttcctcaaattccaactctctgaagcggcttagaaactttgtgcctggaaatatcattttttcagcacatgaaaaaacaattgaagtggaacaaaactggactcaatgatgccaagttgggaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctatataacacttgatgttttaggcagcattacttgacttgttttttctttttttgttacaccacagcacttgggtaaaatatttatatgattcactgagataaatgaacaaggcatttcattgaggagaccagccattgggctctggcagtcgtaggtctttcctggctatcccggggtgggggctaaagaggagcgttttgtattcttatatgagatggtcagttggatccagccacaagaggagacagaagagaggatcaggaaaacaaagttcattatactcatgatcttaaagacagggggcacagtaaaccatgctaactgggaaaaacaccaatgtggtcaggaggcaaaacataggagcaagggaaaaggattaggccagagcctttactgaggtttccacaggaagggcaaggcaggacagacttaacagtttagaattggctagtttgaataatttcagcaggctctaagctgtaagtgtggctgctggttgcctggtacctaactctgggatgattaaagcagaggcacattgactcgtggggtgtatgggcctgttaaaggaggtaaagctctggattggttagtttgcttatcaaaggcatgatcttggctagactttcctgtctttaagaattggctagcctcaggaggtcagaggtcaagcatcatactatatagaaaagtacagacacacacacacacacaatacaaggaacaatattttgggtatagccataacctatttgaggcaaataaactggaaaactttgctttagggggatacatgaatgttatcagggcttttgcaaatgccaggacttctgacaactgtttagtgtttttgctttcacagcttcacaatatcttatatagagaaaatggtgtcatacttctaagaaattacttttgtacaacatgcagggaactagacctgtttttctcctttttcactatagagtactcagtggcacatggatttatgtaaatattaaatggctataacttgctttgttaaaaactgttatagaactattcctgctgatttcagtgtaaattaattttggtaaaccttaacagtttctctttgtaacttaaattttttaaatagaaaatactatattcacatggcaaaacattcagaaagtatattaaggcataacgaagaaactaaaaatctataatcctacattctgaaatggtaattatgcataatttagaaacttacctttttacttatctataaaaatatatttttatatgagtaaatgtatatgtaatcatgtcaatcaaaaatattttcctcctatttttcctccttttataaacaaagatcaaatttagaaatttattgtgtttcaattttttttttttttgagacagttttgctcttgttgcccaggttggagtgtgcagtggcacgatctcggctcgctgcaacatctgcttcccaggttcaagcaattctcctgcctcagccttccaagtagtggaaattacaggcatgctccatcacacccagctaattttgtatttttagtagacacgatgtttcaccatattggtcaggctggtcttgaactcctgaccttaggtgatccacctgcctcagcctcccaaagtgctgggattacaggcatgagccatgtgcccggcctacagcatatatactattaaacatgtatacacatatatgcatacatggtatttatagatatacatggatatttatatccatctacacacacacacatatatatatatgcacacatgtacacttctacccacaaacatacacacattactataacaagagcatccttctctgttaccaggatctggagctcctaaaggatgttcccaggtcattctaggagatttccagggcatggtctggaggatttccaggaagaggtttcacttataccttctatcatattttacattctcatttatactaaaaattttggtttgataatatgtttgattcaaagagctgtttgttattctctaattttttcatgacttcctatttttctctactggatcttgatgaatgcagtatattcttcaagggtaataattagatttattttgtatggtcttttgatcctggcactactcttttatgtggaatcttgcttttgttttttaaaatgtgttttattgtctcctgtaatgcttcaggattactgtaaaaggcttctggttattgattttatgtttacttttatgaatggctcaatgtaaaatctgagttgaatccctacatagattacatggatatgtcctctggaaagctttgtatagatgagtggataggcagctgatcattgctctgggtcttttaaaagccagaattctgggagcattgcttaggggcaccatcaactatacaaattactgattgatttatttcttactcttacccagtatttgatcaatttctttagaaaggaaccattttctcccaaggtctaaaagcctgtttcctaatgctgctatgctacaggagtagtatggtaggaatagagagagtgatgaggactgggaataaaaggggtaaactgtcctgtgtagatcaatgaatcctctactcttagctcctcttctcactgctgtgagaagcttacctgtttttttcctagtgctattttctgtgtggatatgcagatcaagtgagttgtctctgaacaataactccttcctgaaaattctagtctatggttcccccttgtattctcagtcaatatttttcaataactttcatttctcaggaccttatgttgttttctttgtatttgtacacattttaatttttctttacattaaatattttagccgttgccctttccacgctcctcattatgctgccttttttactccctaatatgctcatacagaaggtcatcttagtagcactaactgtggtcaaatgaataagggatgaagaagaaattatttatagaaaaggatcacatgctgagatttgtagtactcgtgtagcacttaacaccaggcaatacatatatgacatgaatgtctggcaggcattcaagatataatgatgtccaataacattgaaaaagaacacctttttaaaaaattaagattgtttttctcttgaaaataattttgcattaaaagcatgtgctacttttttttctttgaaaagaattcacattacatgtgtgctacttattgatatatggactacattgtggtttgccatattagattataggttttgaaccaaaagtatgatttaaaaggacatgttaaaaataaataatgaagagagtttaataatgtaagagatccgtatgaacaagtagtgctaagtatgtatctcacttcagctcctgcagtgggactttcacatgcaaatagatgcattatgggtaccagttatatgtagttatctcccttttcctcaagtagatgaacgtatgacaggttgcatttacaataatccctatggataatatttttttctaagtatatacaagatatttttttatacctttattttatcaaacattaagcaataactaaagcaataaacattggtttacaattttcatttatactgtatctcagttgcaatgttgcctagcatgtgacatatcttccactgacatttgtaatgcatgtcaaaataaaaatgatgtttattgctttcttggaacttactcttcacggagaataaaccctggataaatgatgcatttgatctgatgatgaaatataagaacagtgatatgtattgtttggaataatccatcaaaagacactgtcagtgtatccctaaagagtgtgcttatactttatatgttgcatttttcttcagaaactgactgatagtacctgtttttgagatgacaaaaagagaacagaagaaaatgggttgctacatgaagcaaaagttagtgcattattactcacaagtagtgttattgtaaactggaaggcacatatacacactttcactctgaaagtcaaaggccaagaaaatattttagaatttgcacagcagtgaaggacgtgaatatgtatggaaacatgcaagttgccttaatactcttgaaggaattaaataattgtcttaaggccatatattgtttaaccatggtttattctgtgttatgtaaaattcttatagttcttttaataacctaataccactatggagtttctagaagcaatacatatttgctatagaatggcttatgggttagttttagtaactttttgttagttttttaaattctttttaaaaaattaatcactcttttgcattccaaaaaaagaaagcaatacccatcatgcatgttcacatatacacatacagaatcactagtctgcttgtttggtatgtggatgggaaaaacagaaattatactgatggcagcagtggcccatctggagtggctgctgtgaagacaatggctgcagcaggggaggtgtggccagggctgcaggagagtcacagctggggctgcatcctcccagagccagcaggcctgaaacaggcgggagccttgcctcctaccaagtggtggagcaggagccccatgctctgggcacagctgcagccacccagctgcagctctggacctgggcatccatatactctcggggtcccaggaagccaccctgcccccacaggcttggaagtgcctgttcccactgtctggcctttccctgctcctggcacccactttggggcagagcaaagttgtggctgagcccaggtgctgttgcaacccagccaggtgtgcgtgtgcttggggtggtgccgactcaccagtcccccgccatttggccccctccagacattgggcaccaacaaacacaagagagaggccaaaggggtactgagggtggctcagctcaggtctgcaggtgccccttggcatgaacagcctgggtgctgtggatgacatgtagatggtggcaggaggcagacaggctcctgggcagaaaaatgtgggtccctggtgaagccccaccttcaagccaggcatggcctaaagcctgggggccaggctcccaattcccagtggagtccacaactgggagtgaggacttgtggtgatttttctgggcccacctatggccacccaaggaccaatcagcacgtatttcccctcttctgagcccataaaagccccagatggacccagccagactcacacagacattaaaactaccagctgtgggaaggagctacccaatttgggtctcctcaactcattcagacaacctgcctgcagataggagctacccactccagatctctgctgagagctggacactcatcaggacgacctgcccgcagaaaggagctacccactctgggtctcctctctgtggagggctggaaacgcattgggctgacgtgcctgcagaaatgagctacccactttgggtctcctgagagctgttctctgttctgtcacccagtaaagttcctctctgccttgcccatccacctaccagtttttcatgtacctcattcttcctggatgtggaatgaactcgggacccactaactggtaggggactaaaagagctgtaacccaaacagggctgaaatgaccccctgcttgccactttgcaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctaccaggccgagtgggcagaatgagcccagcaggcccaagcaaaacttgggcaaaggtaccaccagccacagaggtttctggctggaaaagtgacaccctagggatcctgtgacagtatcagagttccttccccttactctccttccctcccaccctctgtacacacaagaatgcaattctctaatttctgacccaagatggatgattcttgtaggctgtgtaatttactcctttgctgacatggaattaatggttcctctagatgaaggattagccctgttgctaccatttttcccatctttgtgtaacctgagaactagcatttgacatccaagccttagcctcaagatacagatataactcaactaacagcatccttagtctatgatgacagcttagacttctaagtacttttctcttccctgccctagcagggatttccatgacagcaaggctgtcttctctagtcttcctttccttaggctgttacttcaaacactagaagcttgtcttttattgacttattttctcacaagtcagacagaagtgtaagggtttggctactgttgatataaacttttatctcatttagggagatgaatcattcttctctctggattgtgttaaccaggaccaaatgatctcttattttatgatagattttgatccagtacattcttgctatctaaaacctgaatgttcatctacccttaacttctattttttcatcaagggtagaatataatatgaagaaggaaattcctattcctagactgaaacttgcttcactttctttgtgtgtagctcctaacattagatataaacaaatatgtaattaagaaatatttttaaatagggttaggttaccttaaaattaatgatacaggatagcagtgtgttgaaaattagaccctggagagagggatggtgcctgtactcagatgctaggttggtcacatactagctgtgtggccttattcagttacatagattctctgtgccttagtgtcttcatttgtaaaagggggataaaaattaaatctgctgcctttggttgttgtgaatcttactgtttcagacaattctgtttcaactattagctgttattaatcatgatgacaatactaacactattaacgaaagacagtttgtatatgtcatttcattttggttctttcaacaatgctgaaataagatatgttattctcattttttaggtaaaaatactaaagcccaggaagttttattaatttttgccaggtcattcagtccgtctgtgtctaaactaagctcaaatttaagattctccctcaaaagccttttttctcgtctgcaatagatagtctccctttatttactgacttttgttataatgaggatcctgggtgaaaactagtattatcagagatatcttatttttacagagcatttcagcagagtacatttcctacattcatagttggctgtacaggttattgaactttatgatatgatgcaggaactcaaagagcactttccatgacaaacttaatttcctcatatacttattctagtgatacagagagaaaggaagatgaaggaagggattctttcagggggaaataagtgtagtcaggatgttatagtgaacactttgatcctcaaagggtcagcatgagaaagaaagttgtgagaaggaatcaaatgttaggcagatatatgaggagggaaattttcaaagacactcagttccttcataaagtagtttagtcaaaataattgttattagaaggattagaagattaaatgactttaaaaaatgagttaatttatgtgcaagaatatgtctttttaccattatagagatttgaatatatatttaatcacatttattttttaaacccgactttatgaactaatatgaaaagatggacacattgttcttttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccattaagatctggctgttgttctgtttcatactgctgggaactcatgctagagatgctatagtccttacattttttaaagatacccttttacaatttgagctttgagaatccagaattttaggggtctttttcaggagtcttgttcttctcctaggctctgggcttaggaataaaacctctactgagctgggaacccagccactgagttatattcatttctttgccatggcctttggggagaccttatagtttggagagcctttgaaaagaagcaagatttgttgtattcactgtcaggagtgtgtctagtgtttttgtcaggaataagggatatactcaaagtaagagtatatatgaatgtgtggcaatatagccaggcacggtggctcatgcctgtaatcccagcactttaggaggctgaggtgggcggatcacgaggtcaggagattgagaccatcctggctaacatggtgaaacctcgtctctactaaaaatacaaaaaattagccaggcatggtggtgggcgcctgtagtcccagctactcgggaggctgaggcagaatggtgtgaacctgggaagcagagcttgcagtgagccaagatcacaccactgcactccaatctgggtgagagagtgagactccgtctccaaaaaaagaatgtgtggcaatactacattagtgcatataaatgtgtaggctgggtatggtggctcatgcctgtaatcccagcactttgggaggctgaggtgggtggattgcctgaggtcaggagtttgagatcagtatagccaacaaagtgaaaccccatctctactaaaaatacaaaaaaattaactgggtgtggtggcatgtgcctgtaatcccagctactcaagaggctgaggcaggggaattgcttgaaccaggaaggtagaggttgcagtgagccgagatggcgccactgcattccagcctgggtgacagagcaagactccatctcaaaaaaaaaaaaaaaaaaaggtgtgcaaattgttgcaggaaaagtcgtgtatttccatttctactatactatcagcattatatgaatattctattaacattttatgagatttctcagtatactaaatcatgccttttaacaattaaaaattttatttcacatgctgacatgacattttactgtgttaaaagtggtggcattcatgctccaataatagaaaacagggctccatggagtaatagctgatactaagcttgggccaggaaacatacaggttgagcctggagcatgttgtagtgccaggaagcattttctcattccatattcttaccaatatgtgttatcatatttgccaataggataggtgaaaaatatttgctattattattttaactagtatttcttcaattattaattaaacatttaaatatatttattggccactggcagttttcattttatgaaatgtctgcacaatattctgtacttattttcagcctatatgatttataaatgatctttattgaagaaggacactaattcttgtcttgtacattgcaaatatttttggcagttttctattattttaaatttgtttatgataatgttaaccatagaaactttttatttagccaaatttaccactcttcttactttttggatttttttgtatttttataagaaaacgattctcatttgagattattgaaatgagcacccaaattttcttctagtacttttatagttttatattttatatttatatctctaatttatctggaatttattattgcatatttggtgtgagcttgcaatctaatgattcttttttcctatggctaataaatggttcatttttcaacaatccaagtagattttagaaaatctacaacctacacagaccaaaaatattcttgatatttgtattatgtattatcactgctaactagtttttataatgatgatgttttaattcttatttttgcttctctggctagaaggtagatactataaccttctcttctcctatactaccatcatctctttaaaacctcattaactgttcttaaaagggtgaactgttctctaaaagcataaatctggtgtgtgtgtgtgtgtgtgtgtgtgtgtgtgtatgtttatatttaaaaggatgaactttttcaaaagattattctgatacatacacacacacacacacacacacacacacacacacacacacacacacagggctacactctataggatcctttatttgatattttgctccatgaataaataaccaaagtttttttcttatgtgaatggagttaactattaaatttcaaattatttttctttccttttaagattataggtttatttcgccttttgcctaaaaacaaaactagtgaaaattaaagtataaaaataaatacagtttacattaatggacattccattcaaagtaaaaataatgataataatacatcaaaagctcacagcattgtctggcacctgtatgagaaaaagttgtgaacataaaataatatgcaaaatacataggcttttacttttaaattatatcacactcaagttgctcatccttaatctaaagctaactttaactttctccaaaacatactatttgttttagataatttgcattagtatacccaaaacttttagcatctttcttactggacagacgcacagtgatatgagtaagctgaatccttagttttttgtttatcacatttagaagataatttcatatactttgcctgtaaatttaaaaattagtaactgggatttttttgactggcttctaatttgatacaccttgcctgtaaattttaaaatggtaacttggactgttttgactggcttctaattttctggttcactcattctatatgcaatacatctcaataagaaagtcgagtttacatgcagggtaaattatcattttctgtctataggtggatgtgaaagttaaattttaggtggaacagaaaaatcagagaaaatgatctttatctacatattctcatcctgaaagcaaagacagcaaggaccaagttgctattcttcagaaagagttgatatattaaattataaggatattttccatcatatctcaagtctggttgtcaaaactgagcatcttatctgctttataatgactttttaagaaagattgtttttctggaaagtggctatcagtaaaatattcagtgtagatttaattttctttgatggatatataattaatctaaaaattagtacattgtatttcctaattgtgatattgagggaaatagtactaaatagagaatctagccctggtctcttatgtagttaaacacatcatcaacagctaatatagaagatggcagagtagagggttttctagagtgcctcaccaactctgaagaagcaaaatagtgtgtagaattcacaatgtgaaactttatccaagaaggcacacaggaattcaacataaagtgaataagaactttagatattggggaagagaaggtaagtgggcagcctgtgtggtggtgtctgactgagagctgtgagtgaagtcccaatataggagagggagaaaaagtactcctctgcaatccacatttccactggggagccgtacaatccaggctgtgagagaataccttgcccttcccaagccctgaatctaaattggagagaggctaaaacactatgagaagggacatcactaggaagcaccccaagcattttccagtacttgggacctgatagaaaaatgtgattctcaatcctagctcatacaaagccaggtgggattctgtgatctagcagcagtggcagacttgggcattaaaggagcttggacaggggattgtaatgctgggtttggggcaacagaggggctcccacagccaaaactgagagatgagtgtggcatttgctccagctgtgggcattttaatagggctctctcccttcgtgggtggagcagaaggagatttgccagagaggcatggttttgtcccggtttcaagttatacagctcagtgtgactttgcagactaaaggtatactgcacatgactttactgagtgtctcaacttgctccctttattgggttggggagtgaaccctgccaggtctaaagaatgagaggagaaggctgggcatggtggctcatgcctgtaatcccagcactttgggaggctgaggtgggcaggtcacgaggtcagtagtttgagaccagcctggccaacatagtgaagccctgtctctactaaaaatacaaaaaaattagctgagcatggtggcaggctcctgtaatcccagctactcaggaggctaaggcaggagaattgcttgaacctgggaggcaggggttgcagtgagccaagatcacaacactgtatgccagcctgggtgacagtgtgagactccatctcaaaaaaaaaaaaaaagagtaaggagagaggtgggtcctatattcgtttgcctagattaaggactgggctgcctctgccttcctgtgccaacttgatacagcaataattgctctgtctcaggaataattgcttctccctcaggaatatctccaaggtgcctgcccgttgctcctgaattcccaccagagatggtgcttttacacaccattgcagggcctgagtgcagaatttccctgttgccctttccagttccacccaacttgacccccaccaccttcccacaatgctggaccacaggacccagatcattaagttgctccctggcctagctaattgcctgggacaatggattacttttctgattgaaaaagatcaagtataaaccctattgctatcaccacagagagatcttacctgcaagcaagaactattggcctgaagttcggcctacacaatccaatacaaaatttactggcagaagtgcatagcatttggaaacaagataagtttcacataacatttgctaccaccatcttccatgacacctcagcttctcaggaggacatgagtctgctcacccacctggtacaccactactacaaccaacatttgagaaagctaccaccctaaggctatttataaccaaggaaattccacagattctttgccgttgaacacacctagaagcaaagccaaatggctctactcagtatacatcatagacacattctcaagaaaaaaataaaagtcctgcccccaagaaaataaattcaaaaataagaagtgactgtttctccaaatgcaaataaattagtgtaataacataggaatatgaaaaagtaatgtgtaatgatacacataaagaaacacagtaattctctagcgacatgtcctaactaaaaagaaatactcaatattccagataaagagttcaaaatattgatttttaaagaagatcaatgagttgcaagagaaatctgaaaaccaatacaaagaaatcggagaatcaattcaggatataaatgagaaatttaccaaggagacagatatcttaaaaacaaacacacagaacttctggaaatgaaaagttcattgaaaggattacaaaatacaatggaaagtttcaacaatagatgagaccaaaaagaaaagagcattttggaacgtgaagacaggtcttttgaattaatcgagtcagacaaaagtgaaaaagaagaaaaagaaatgaagaaggcctttgagaagtacaggattacttctcaggttagcaagcttttctaacctgtggcccatgggctgcatgcggcccaggacagctttgaatgtggcccaacacaaattcgtaaactttctgaaaacattatgagattttttttcaattttttaaaactcatcagctattgttattgttaatgtattttatttatagctcctgacaattattcttcttccaatgtggcccagggaagccaaaagattggacacctctgacataaagtgactgaacttacatatcattggtattcacaagagagaagaaaaagcaaaaagtttagaaaacctatttaaggaagtaattgatgaaaacttcactaggctagcaatatatttagaaatctagatacaagaggaccaacaaacaccagaaaatatgcagcaagatggacttccaaactacatatactcattggaatgtctaaagtcaacacaaaggaaaaaaattctaaaatcagcaagagaaaagcatctagacacctataaaggaaactctatcagaccaagagcaactttccagcagaaaccttataaatcaaaaaagattggatcctattttcaaagtgcttaaagaaaaaactgccaaccccaaattttatatcttgccagaataagcttcataaatgaaaaagaaatagtttttctcagacaagcaaacactgaggaatttatcaccagctctactagaaatgctcaaatgagttctaaacatgggaaagaaaggttgatatttgccatcattaaaacacattaaaggataagattatcaggttttataacacaattacccaaaggaagaagagaaagaaatcaaatggtagcataacaggactccaccaaaccagaaagacaaacggaggggaaaaaaaagaatctacaaaacaactagataacaattaatattttgacagtcagaaaacctcacatacaaataataaccttgaatgtaaatggattaaattctccacttaaaagatatagattggcagaattgatattaataaaaccccaaaaccaactacatgctgcttactggtaaaaaaaaaagatattccatgcaaacagagagcagaggcaagcaggagtagctatacttatatcagataacacatacattaaatcagaaactgtaaaaaaaaagaaaaagtcattatataatgataaagggattaattcaataagagtatatatcagtcctaaatatatatgcaccaaacaccagaggacacagattcataaaacaaatattactagacctaaagaaagagatagcaacacaataagtgcaggatttcaacaccctacggacacactataaagattatagagacagaaaaacaacaaagaaacactggacttcaatgaaactttagaccaaatggacctaacatacatttatagaacattttactcaacaacctcaaaatatacatttttctcatcagcgcatgcagcattctccaagatagaccatatgttaggccacaaaacaagtctcaacaaattaaaaaaaatagtaactttatcaagtgtcttctctaactatagtaaaatgaaactagaagttaataccaagcagaactcttgaaactatagaaatacatagcaatttaaaaacatgctgctaaatgatctttgagtcaatgataaaattaaattaataatttttttgaaatgaaggaatatgaaaacacaacatatcaaaacctttgggatacagcaaaagcagtgctcagaggcaagttgatagggttaaatggctgcattaaaagaagaaagatcacaaaataacaacctcacatcacatttgaaggaactagaaaatcaagatcaaaccaaatccaaaggtggcagaagaaaggacaaagatcagatcagaaccaaatgcaattgagaccaagttaaaaaataacagaagatcaacaaaatggaaaatttgttttttgaaaagataaacaaaattgataaaccactagctagattaaccaagaaaagaagtgagaagatccaaataaatgtaatcagaaatgaaaacgaagacattacaactgttaccacagaaataaaaaagatcaccggagacaaccatgaacaaccacatgttcatgaattagaaaatctagagtaaatggctaaattcctgggaacatacaaatttccaagattgaactaggaataaataaaaatcctaaacagaccaataatgagtaatgagattgaatcagtaataaaaaataatctcccaacaaataaaagcccaggagaagatagtttgaaattctggttgctgaattttaccagttgtacaaagaaaaactgaaacccatcctccagaaactctttcaaaaaattgaggtggtgggaatctttcataattcattctattaggccagtatctccctgataccaaagaccagagaggacagcactaaaatagaaaagtatagacaaatatcccgagtgaacaaagatacaaaaatcctcaacaaaataatagctaatcatatccaagagcactccaaaaagataatacaccatgatcaagtggttcccccactgccagggataccaggattgttcagcatttgcaaatcaataaatatggttcatcacacaaacaaaattaaggacaaaaccatatgataatcttaataaatgcagaaagaagcatttgataatttccagcatcatttcgctataaacaccctcacaaactagtcatagaaggaacatatcttctataataataaagggcatatatgacaaatccatgaccaacatcgtactgatctgggaagagtttgaagcaatccctctaagaactagaacaagacaagaatgtgcactttggccaatcctattcaacttagaatggaagtcctagccagaacaatcagacgagaaagaattaaaaggcatccatgttggaaaaaaggaagtcaaattgtttctattcattgatgatcttatacttgattagaaaattctaaagattcctccaaaaactcttagaattgataaatgtatttagtaaagttttattatacaaaatcaatttacaaaaatctgtagcatttctctgcaccagtaatggttgagctaaaaatgaaatcaagaatgtaatctcatttacaatagctacagaagaaaaaatagttagtaatatatttaaccaaggagatgaaatatccctacaagggaaattacaaaatactgatgaaagaaattgtggatgacacaaacaaatggaaaaacatcccatgctcatggagtggaaaaattaatggtattaaaatgaccatatacccaaagcaatctacaggtttaatacaattcctatcaaaataccaatgtcattataaagaattataaagtataatcttaaaatttatatggaatcataaaagagcccaaatagctaaataaattctaagcaaaaagaataaaactggaggtactgcattacctaacctcacattttaccacaaggctatggcaacccaaacagcattgggaaaggacactcttcttttttcctttttctttgtcttttttttttttttttttttttgagacattgtctcgttcttgtcaccccggctagagtgcaatggccctattttggctcactgcaacctctgcttcccaggttcaagtgattctcctgccctagcctcctgagtagctgggattacaggcacccgccatgaccggttaatttttttgtatttttagtacagacaggatttcaccatgttggtcaggctggtctcgaactcctgacctcaggtgatccacctgcctcggcctcccaaagtgctgggattacagacatgagccacctcacccagccaggacactgttttcaataaatggtgctgggaaaattggatagccggatgcagaaggataaaactagactcctatctctcagcatatagaaaaatcaactcaagttggattaaagtcttaaatataagacctgatactattaaaatactagaaaaagacctaggaaaaatacttctggacattgatttacgcaaggaatttatgactaagacctcaatagcacaagtaataaaaacaaaaatagataagtgggacttaattaaactaaatagcttctgcccagcaaaggaaataattaacagagttaacagacaacttgcagaataggagaaagtatttgcaaactatgcatctgataggggactgatatccagaatttatagggaactcaaacaacaatcaaaagaaaaccattaaaaagtaggcaaataaatagatatttttcaaaagaagatatataaatggctaacaagcatagaaaagatgctcaacattactaatcatcagggaactgcaaattaaaaccacaatgatatgtcatctgacgtaagtcagaatatggccagttataaaatggaaaaaatataatagactttgtgaggatgcagagaatagtgaagaaacatttagacactgtttatgggaatgtaaattaatacaaccactatgaaaagctgtatggagacatctcaaagaactagaaatagaactaccattcaatccagcaatcccactactaggtatctacccaaaagaaaagaaattatcatataaaaaagacacctacacttgtatggttattgcagcactattcataataggacagatatgtaatcaacctaagtgtccatcagtgatgaataaataaagaaaataatgtacatattttctttatccaatggaatgctatggaatactattcagccataaagaatgaaattgtgtctcttgtagcaacatggatatgtaatactgtatacttatgataccatatcattaaaaggatatgatgtcattgtcttaagtgaattgcaggtcattatcttaggtgaaacaatgcagaaacagaaagtcaaatgctgtatggtctcacttataagtgagtgctaaaaaatgtatgcacacgtacatagtgtggaataatagacattggagcctgggaaaggtgggtgagtggaagcaggggtgagggacaagaaattacttaatgggtacaatgtacattattcaattactggttacgctgaaaggcccgacttcacctttacatgatatatccatgtaacaaaactgcacgtgtaactctttaatttatacaaataagaagagaaaatattgtaatcctgttagaaaaaaatgtaagaagttaatatttaaaaagcaaagggataaaagaatttaaagataccaattattctctttagttattgaacatttttcatccatatggagctcaatataatttagtttaatatttattaaatctaaaatgactgataaaagacacattgttcaggacagaaaacaatctgaactcactttactatagcaaattatcagttttaatgtgttccattaaataacgtagacataaaatatgtattaagggtcaacgttaatcatcttaatatatatgccaaggctgtctttataatcccggtactacttgctatctatataattttggacagttaacttaagcctggtctttggaactagttcatgtttcatttagttacaccatattccccagatattccttttattcttcatattacttagatgtcttttaattcctatatactcattaacttagatgactgagaactacactaagtaatgctcaaatttctagtcagatgtagccaaaagtacattgggcttgcagtcagaagccctgagtttcagtccaagctgttatttattaggtgtttaatgttaaatcatttaatcacatttttctacagcttcttcatccgtggtgtgtaggatgtaagtaggaataaattgggcaattaaaaacaatttctagcggttttcacatttaagagtgaggagaaatatgtgtggctaacggattgggtagagtgggatgatgcaaaagattagtcttgttttcctctgaaagcagttaaatttatttgttccccatatggcaagcaatggggatttgggggcagttagaaaaatgtgtaatactgtagacttatgatagcatgtcattatatctacacaattaacacaaataaaacttctgttaatataattgtatcattggattattttactcttatcattccattaaatttgtttcaatgtattgtccagtcaagtagctcatgagtttatttgagggttggaaatactgattttattgtattatattttatacttcatattacccacaccttataattgtatatatttaataaatcttgagaaattaaattatatgaattcactttctttaaaaatatgtagcttattaatagcaaatctttatcttaaataatgtttctttccaaataccatttaatttattttcaaataattctaaatttcttctcttttatgggaacatttgcattgggtgtcactagtggcactcctgtaataaatcttttagatatttttaatttccagtgttttaattctcagtatatgacatgtaatactacgcaaaaatgataaactcttttttttttttctttgagatggagtctcgctctgtcacccaggctggagtgcagtggcatgatctcggttcactgcaagctccgcctcctgggttcacgccattctcctgcctcagcctcccaagtagctgggattacaggcacccaccaccgcgcccggctaatgttttgtatttttagcagagacagggtttcaccgtggtctcgatttcctgacctcgtgatctgcccgtctcagccttccaaagtgctggcattacaggcatgagccactgtgcctggccaaaaatgagaaactcttagtctttaagcattgttatgaaaggtaagagatttagaatcacattgcccatgccttatctcttactaactttgggaccctgggaaaattaatttatctgaccttcaaggctcttatttataaaatcagcattataatatcccatttttgaaaataacttttaacgggttaaataatgaaacggcttcaaagcatttagtcaggtgcttagcacatggtaaacctttatgttgttactactaataaaatcctcctgcattttaaagtagtttcctaaaaaaatcttttgcctctaaattttgtaagctttttgttctcacttatttcaacacaaattcagccattataggggtgacttcaatgccctcacaaatgattcattaatacctcagtcttacagatgtttgacttattctgctacagtgacctttactttttaccccaatcccacaatcattcctcaatattatacttttttaaaaacatactcagagaaacatggatgtttgagctaaaaacaaaatgcaataaacttaatttactttggtatcaaagtgctctccctgcgtatttatattattcttcctgctctttctttcaatgagtaagcagaaagtataggtagttttcattagttaatacagtaaatagctctgtcgctcttaaactaggttcttttggttgcaagtggcagaaacccatctcaaaccaagtcaaaactcatttcagagtagcttagttttagctaaaagatggaaaattattgattaatgttacagagaggcccagtgctggttttggatttagggatggttgcatctgagaggttcaggcagtgttgcttactttgtctctctttagctctttatgtctccttttctgtctttgcctttcaatctaccttaacgttttggcttttttgcctgttatcttttatttttagacaagtactagaaggaagactcctggctatcttagccctatatttatagataccagaaaaagtggtaacctattattaatagctctgccaaatagtctagtaaaaactttgattggctctgcttaggtcatgtgccaatttttgaaatagacaacaatggccaggagtggggagtattctgataggccatgcctggttcatgtgttcaattcaaggcgtgaggatgtgagatttatttaaacctgtgatggcaagctagggcccactgcttatttttatataacaagttttatttgaacatagatatagccatttatttacatattgcctatggctgctttcacactaaaatggttacagtactgacaatgttacccacaaagcttaaaatatttgctgtctggttctttacagaagatgtttactactgttctaggtagagttcaaagatgatccccaataactcacgtccttatactgtgagcaaaaccttccccttgattgtgggcaaaacctgtaagtatgacgagatggtactcctgggattatgttactttatatgtaaaaggggatttttacagatgtaattagtacccccaatcaactgagttaatgaaaagaggctatcttgcataggtctaacctaatcagatgcatttttaaaaagagagtgtagaaattagaaatggaggcagtcagagagactgtctcctaatggcctgtaagaaggtaaacatttatattgttaactttctgtggcgccatgtgacaagggactgtgggtaactacagggagctgattgttccctggatgatagctggcaagaaaactggaacctcagtcatcacagctgcaagaaaattaatttggctaaccttggatgaagactcggagactcagatgagaattgcaacctggttaacaccttgatttcagcctggggagatcatgaatagagaatccagtcaattcctactcacactcctgacccatggtaactgtgagatgataaatttgtgttattttaaaccaataattttgtgataatttgttactcagtaacataaaattgacatagactgttgtacctgaagttggaatgcttctgtaaatatcttaaaaaggggagcggctttggaaccaggcagtctgtggaggctttggatttttaagaagtatgataaagaatatctaaattgccttaaacagaccattagtagagataaggatgttgagaatactcatggtcaggacttagaaagaagtaaggaaattgttatttaaaactggaagaaggggaactatcattatgttgtggcagaaagcttaatggaattatgtcctgcagttaagtggaaagcagaacttgtaaatgatgaacctggatgaaaggaaatttctaagtatactgttcaaggtgtggtctgttttcttcttcctgcttatggtaaaaatgaaagaggagtaagataattaagggaagaactgttcaacaaaaaggaatgaagtctgcatggttttgaaaatcctaagcctctccagatgatgaaagatgctaaaagttagaaatggctatgaaaattatgacattggttaaagaaattgtagataaactcagaattaataagtgaatttagcaaagttactggatactaaataaataaacaaaatccaattatacacttagatttatgccacagaaattaggaaacttgaaaaacaaaatgccatttacaattacaaaaaactctatgataatttatctaataaaaagtatacaatacctctttagaaaagtgtatacatttttgtttagaggacataaaattttataaataaatggagaaatccaccataatcaggagttggaaactctgatactgcgtagctgtcaattttgctaggctaatccatatatctatataatctgaactgaaattcctgcagttttgtgtgtgtgtgtgttgttagcaagcttgccctacaatttaattccatgggccatgaataagcaatatcaactcaaagaagcacaagttgggaggcattttctctatccgatatcacttattttaagaccagaataatacaggaaaatagacaatgtaggctgggtgcagtggctcatgcctgtaatcccagcactttgggaggctgaggcaggcagatcacgaggtcaggagattgagaccatcctggctaacacagtgaaacctagtctctactaaaaaaaaaatacaaaaaatttagctgggcgtggcggcgggcgcctgtagtcccagctactctggaggctgaggcaggagaatggtgtgaacccaggaggctgaacttgcagtgagccaagattgcgccactgtgctccagcttgggtgacagagcgagactccatctcaaaacaacaacaacaacaacaacaacaacaaatagtcaatgtaacagaataagaagatgagaaagagatccatgcatacatggtttattcatgagaagtgtggtactactgagtagtgataaaataacagtacttttaataaatgatttaaataaatatgcaatcatttggttatatgtaaaaaatgaaactttatccttaccttacaccatatacaaagaataattacaggtttattgcatatctaaacatgaaaggtatattaatatattcttgaataagaaaggatttcctaagcagataatcaaaagcattaaccaaagagcaaaggtaaatgaattaggttgcattataacttagaaattaattccatcaaatgacacaactaagagaaggaaaagttaagccccagcataggagaagctatttgcaacacatctaactggagctaaatttttatagaattttcatgtattataggtggatgaataaattggcataattagtttggaaaactgccttacctactaaatttggaaatatgcatacattataatacagcaattccacttctggatacctgcatacaagaaatatgggcccatgagtagcaaaaataaaacaaaactaagccatacatataagcacattcaacataagcaactttatttgaaatagatacacattggtaacaccccagatgtcctatcagtggtagaataatctattaatttacaatgatatgttatccatctatgaaaatgtagaaagcactgtaatatggagcaaaatgaatgtcttctatacgcatagtatggaatgaaggcagctagaaacaacatatctacatatgcagatctatatatttcaaaaatggaaaacaaaatctatggtttcgtatttaggattcccaaagacaagaggtaaaggggtagtgacaaaatggaatcaggagttggacttacaaagtatcagtaatgttctattttttgacctgggtggtaattaaacagatgtatttatttttgtaaaaatgaattgagctgcacacatagatttgtgcacttttttctgtttgttagaattcaataaaatgttgaatttacaaagcaaaagacattgggaagaaataaaattacttttgtttgaagacgacatgattacttatgtagaagatccaaaataatttgccaaaaacctcctggaattagtaagccattatagcaagttacagtacaaagttaatatacaaaagtcaaccactttcctatattccagcagtgaacaagtggaatttgaaattaaaaacacggccggggtggtggctctcatctgtaatcccagcactttgggaggctgagacaggtggatcacttcaagtcaagagctcaagaccagcctggccaacatggcaaaaccccatctctactaaaaatatttttaaaaagttagccgtagtggcacatgcctataatcccagctactcgggaggttgaggcaggagaatctcttgaacctgggaggcggatgttgcagtgagccgagatcgccccactgcactccagcttgggcgacaaagtgagactccgtctcaaaaaacaaacaaaccgaaaccactatatcatttagattggcacccccaaacatgaaatacttaggtctaaatctaataaaatatgcaccagatctgtatgagaaactctgatgaaagaaatcaaagaactaaataaatggagatttatttcgtgttcataattagcaagactcaatattgtcaagatgttagttctttccaacttgaccagtagattgattgcattgccaatcaaaatcccagcaagttattttgtggatatcaacaaactgattataaagtttatatgggtattcaaaagacagaacagccaacacagtatgaaggagaacaaagttgcaagactgtgacactacctgacttcaagacttactataaaattacagtaattaagacagtgtggtactggcaaaagaatagacaaatagatcactggaacagaatagagtggccaacaaatacagccacacaaatatagtcaattgatatttgacaaaggagaaaaagcaatagaaagtagaaaagatagtattttcaagaaaggctgctggaacaattggacactcgtaaaaaaataaatctagacacaaggcttatatctttataaaaatgagctcaaaatggatcacagacttaaatgaaattactaaactatgaaactcctagaatataacagaaaatctagattaccttggatttggtggatatagcaccaaagacaggatccatgaacgaaagaatcgataattaattttaattgattaaaattaaaatattcttctctgccaaagacattgtcaaaagaatgaaaagataagccaaagactgagataaaacatttgcaggagacatatctgataaaggaccattatacaaaaatatacaaatgacttcagaagttgtatatatttaaggtgtaaaacatactgttttgatatatattatgcatagtaaaatgattactacagtaaagaattttaatctgtccagcaccttccatagttacctttatattttgtggtgagagtacctaatatctactttcttagcaaatttttagtatgcaatattattgattatagtccttatgatttacattagatctgtagattaattcatcctatatgtttgagccctttgacctacttctgtccattttctttccctccttgtcactagtaaccaccattgtattctctgtttctgttttcaacttttctttagattctacatataagtgatatcatacttatgtatgatgttgtaattctgtgtctggcttatttcagttagtgtagtgtccttcaaattcatccatgttgtcataaatgactgatctttttttagggctgaataatattccattgtatatgtattccacaatttctttattcattaatctgtcagtagacacctatgttgtttccatatctttgttattgtgaataatgctgaaatgaatatgggagcacagatatctttatgaggtgctgatttcattacctttgggcatatacccagcagaaggattgctgggtcatatggtttgttctacttcacttgttttagtttatttatttttagataatagctatcatgagaagtgtgaagcaatgtctcagtgctttaggtgggagcatgaaagttgtggtgcttgatgcatgcacaagtgtttccagggagattttgcagacctggatttaccactggagcaagctggaggagaggtgtgggaagtactctcactccaattcaggctcctgtaggtcgattgtttatctgcctttttctattaggctatttaaaagcctaatagaaaaagtgtgcagatttccaaggagaaactgggaactggacacttcagcctattctctgcactgattgttggaggaggagtgtgaatagatccccctggaagtacacgtgcatccatttaaaatcacctctttgttctgtagcctagggagacacaaacgctgaatcattttctgttttcagagtcaggtgaattaagggctcaactctgtgggaggaactgtaaaccttggggctctgtaagtgtatttcacaaccttttcttgtcaaagagaagttgagagttagaggttctctcctgattataaaaaactggtcctggggtggagtttgtggcatatgtgtgtctcagcttttccttccttttttgatgcagatattttatcagtttcccagtttttaggggtttatcaactagttttgagatttgtcctagagggaattgacctataaataactgtttacttagtacatccataagaggagggaaagtcaagaatttcctattctgccatcttgctgatatttcaagaacatctttctgaagttcttaaaatacaacaataagaaaacaaacttttatattttgatagggattgcattaaattttgggtagtatgggcattttaacaatgttgattcatctaatccatggacatgagatatctttccattttttgttccctcttttatttctttcatcaatatgttagagtttttattgtagcaattttttaaaaaatagagaatatttttcataggaaaagaaaaaaaattctaaaatttatatgaaaccacaaaatacccagaatagacagaataatgctgatcaaaaagaacaaagctgtagtcatcatactacctggcttcaaaatatactacaacactatagtaacccaaacagtatggtactggcataaaaatagacatatagactaatattagaaacaaaagacaaaattcagaaataaatccactcatttacagtcaactcctttttgataaaggcaccaagaacatatattggagaagggaaatccttgtcaataaatgatgctgggaaaactgaatatccatatgcagaagaatgaaaccggacccctgtctctcaccatatataaaaatcaaattaaggacaggcacagtaatatcactaaaacacaggtgaccaaagcaaaaatggacaaatggaatcacaccaaactaaaaatcttctgcgcaacaatgagaacaaccaaacaaaatgaagagacaacctacagaacggaagaaaatacttgcaaacgattcaactgacaagagattaataaccagagtatataaggaattcaaaaagttcaatagaaaaaacctcaagtaatctgattagaaaatggacaaagatcaaaagaagacatatcaatgaccaacagatatagctgggcgtggcggctcatgcctgtgatcccagcactttgggatgctgaggcaagtggatcacctgaggtcaggagatcgagaccagcctggccaacatggtgaaactctctctactaaaaatacaaaaaaattagctgggcgtagtggtgggctcctgtaatcccagctactttggaggctgaggcaggagggagaatagcttgaacccgagaggtggaggttgcggtgagccaaaaacatgccattgcactccagcctgggcgacaagagtgaaactccgtctcaaaaaaaatgaccaacagatatgtgaaaaaatgctcaacatcactaatcatcagatgaatgcaaatctaaactacaataagataccatctcacctcagctaaaatggcttttatattatcaaaaagacaaaaataagtgctggcaaggaggcagagaaactggaatgcttgtacactgttggtggaatgtaaattaacacagctactatgtgaaacagtatagaggttcctcaaaaaaccctgagggaccagagaaccaagctgcagacctggttccagccccttagggttagaacacacagcccaggagtgctcagctgaggcttggaccgctgaaaccatccagaaatgaagccaatcaactaaatccaacttacaacatagtcaaaccctaaagagcatcaaagaatataaaagcagaaaggccgattccaaagacagagactccaaaggttaaaggaacatcagcccacacagatacataagaaacagtgcaagaactctggcaactcttaaagccagagtatattcttaccttgaaataactgcactagctcctcagcgatggttcataaccagactgaaatggctgaaatgacagacattggttcagaatctggttggcaaggaagctcatcaagataaagaagaaggttgaaacccaatccaagcaaaatagtaaaatgattgaagagtttaaagatggcatagccattttaagaaagagccaaactgaacttcaggaaatgaaaaagtcactacaggaattttggaatgcagttcaagcattaataacagaatagacaaagctgagaaagaatctcagagctctaatacggctcctttgaataaacataggcagacaaaataaagtaaaaagaattttaaaaatgaacaataggttttatttaataattctcctccttatactttctgtctcaccagtttcccctcaaactgatttacctactacacaaaattattcttatcgggcttatgtgccttttcctccacttatttgacctctcacctggatggatgctcctgcggaaatctatactaacgatagtgtgtggatgcctggagctacagatgactgttgccccgctcaaccaggagaggaaggcactgcatttaatgttactatgggttataaataccctctgtgcctcagacatgcacctggttgtatccatctagaaactcaagtctgggctgcttgccttccagagagatcagccacaggggaatggggacatttggtctccggcctctccctttctcctttaagacaaatgaaagggggagtaatgagagataccccatactttcaatataaacctgtaggaaaatcatgtcctaaaaattttgagggcccatctaaaactttaatttgggaagattgtgttaactcacatgtagtagtattaaaaaatgcctcatatggtttagtaatagactgggcaccaaagggctattttaaaaaacaattgctcctctggtggaagggaatgcctggaggctacttattttatttctcattgggaggacaaggatcatcatcctactttgcataggaggttcagctcattttttcccttaaaatgggaagataagggcattacccccacaaggcctcatatgatattccccattctgagcccagaacacccagaacttcggaaactggctatcgccatgtccagactgcaagtatgggaaggggaaacttttctgtctgttatccccagtactgcccctcacatccatgattctgaaccccatgataaatcccctttgagcccttttcctctttttgatgcctatcctcctttatgggactccaattggcattatgataattcttctcaatccaggtatgccccctacctcttcagcatccctaggcccctcggattgcttctttatggtggagaacatcgggcgttcccaccgccactcctctccctcagtatcaatgtagattcaaacattctgctttgtttacctccagcctgactattcctatacagagttgtgttaagcctcctttgtgctgttagtaggaaatagcaaactttggacgaataatcaaactgtccaatgcattaattgccatttatacacttgtgttaactcctgttttgcttcaggaaaagtataatgttggttcgagctcaagaaggaatctggataccagtaactttacccagaccttgggaatcttccccctcagtacatttaattaatgaagtgttaaaacaaattctcaaaagatctaagagatttgttgttactttaattgctgtgatcatgggcctaattacagtcacggcactggccaccactgccggagtggcattacaccaatctgttcaaatggcttattttgttaatgattgccaggccaattccacccaaatgtggaattctcaacagggaatttatcaaaaattagctaatcaaattaatgatttaagacagtctgttatttggcttggagatcggctaatgagtctcgaacatcgcatgcaaatgcagtgcaattggaatacttctgatttctctatcacaccatattcctacaacgagactaatcattcatgagaaatggtcaaaggacacttgctgggaagggaagataatttatccttggagataactaaattaaagaaacaaatttttgaagcctctcaagctcatttatccattgtgcctggagctgatgcattagatcaggtggaagaaagtctttctggactaaaccccacgatttggattaagtctattgggggccccactgtagtaaattttggaatcatgtttctctgtttaatcagcttgtttttagtgtgccgtaccagttaaagaatcctgcatcaaaactgagagaatgaacaagccttcatccccatggcatatttatataaaaagaaagggagaaatgttgcaggaagtcagggacccaaatggagggacgggctggagccatggcagaggaacataaattgtgaagatttcattttaatatggacatttatcagttcccaaataatacctttataatttcttatgcatgcctttaatttttaatcatgttatcttcataagctgaggatgtacatcacctcaggaccactgtaataattatgttaactgtacaaattgattgtaaaacatgtgagtttgaacaatatgaaatcagtgcaccttgaaaaagaacagaataacagagatttttatggaacaagggaagacaaccataaggtctgactgccagtggggtcgggcaaaaagggccatatttttcttcttgcagagagcctataaacagttgtgcaagtaggagagatatcatcaaattcttttcctagcaaggaataataatattaataccctgggaaacgaatgtgttcctggggggaggtctataaatggccgctctgggaatgtgtgtcttgtgcagttgagataaggactgaaatactccctggtctcctgcagaaccctcaggcttactagggtggggaaaaactctgccctggtaaatttgtggtcagaccggttctctgctcttgaaccctgttttctgttgtttaagatgtttatcaagacaatacatgcaccactgaatatagacccttatcaatggctctgctttttccctttgtcctgttccctcagaagcatgtgatctttgttagacccttattggtagttctgctttttgctctttgaagcatgtgatctttgtacctaccctctgttcttacaccccctccccttttgaaacccttaataaaaacttgctggtctgagactcaggcaggcatcatggtcctaccgatatgtgatgtcacccctcgcggcccagatgtaaaattcctctctttatactgtctctctttatttctcagctggctgacacttatggaaaatagaaagaacctaccttgaaatatcaggggtgagttcccccaatagataggagggtgaagattgaaaaactacctattaggtactaggtgcaatatctaggtaatgacatcatttgtacaccaaaccttagcaatgcacagtttactcatgggagatacctgcacatacaccctgtgaacctaaaataaggttgaaaaataaaaataaaatagataaaataaaatgtaaattaaaataaaatttgaatacagttttatttttagtagaatttctacatgtagtttccagagttaataatttataatgaatgtctacccatgtgattattttattttccaccaacatatatttttaaatatattctcttttatagccctttccatacttagtctttttatgattaaaaagaaactgtcaggccagacatggtggctcacacctgtaatcccagcactttggtaggccaaggcaggtggatcaccaggggtcaggagtttgagaccagcctgggcaacatggtgaaacactgtctgtactaaaaatacaaaattaggcaggcatggtggtgcatgcctgtaatcccagctacttggaaggctgaggcaggagaattgcttgaagctgggaggcagaggttgcagtgagccaagattgtgccactgcactccagcctgggcgacagagccagactctgtctcaaaacaacaaaaacgaaaaaaagaacaagaaaagaaactgtttattgacatttgcttctgttactcaattctagttgtaatcaatgcctaagctttgattatatcttcgtttaacttggctatattgcgtatcatttattttgggagacagtagcctcctatcttagctctttaggtgtgcacatattcatctttacatataaagggatttgagatatttctgtgatttcataaagtttttatgaagttatcttctttaaatttacttttactttacactaattgaatgtgcattattttggctgatctattttttggaagtataataaattgctttatgtatacttcagtggctttagattttttatttatgatttttagcattatgtgtttgccttagagtttatgtgcacaaaactattatatatttgttcacattaaatacaatttatgtatgttttaatcaatattcacctgcatgtagcttgctctgaaagaactagaatgctttcattttccatacatataatttttttctatatctctggagaataatgttctgcatatttttgaaatatataggtaggactatgctttgtgaaagagtctattaaagtttaccacatttgatgagttttgttttggaattaattaaaacctgaagcaaaattgatctgacatataattatgtgtataattattatggttactgtgtcatatagtaattaggcataatatgaattttatttggttttactgcttttatgtaacatatccatcattgttttagtcagctgggaaagaactataggtaaacaattatccacattgtgaagcactttcatgagtattatctcattatgtatataaataggttatgatatttatttcatttcaggatagtaaaggggcatttcaaaaacaaaaaacaacatttttttaaatgagaaaaagatcctttaattccaatagggttagaaacaagtacgttatcctcttttcctaggtaatttatcccatgcccacaggttcagttaccatctctatattaattctcaaatattcagaacagatctttcttttgaaatccaggtatgttcagccaacttcttaattgaacctccaccttggatgtctcaaaggcatctcagattcaacatattcatacatgaactcatagtatctcccatctctactaaaaggcctcattgcctggggtaaatgcccaggttttggtctcatggccaaggaaatcaaagactcagacgcacacacgcatagtgaaattggagcaaaagtttaataggcaaaagaaaagaacagctctctgtcacagagaggggtcccaaatgggttgctgagtggtagtaaaaatgtcagggtttatataaatgggctagtgaggagggtgtgtcttatctccgtggggcctgaagaactggttaggaccgggtgtgccgtatgttgagggcagagcctctagtagtccccaccccttgtgcaggccgactcttagtttgtgctgctctgcgctgcttatctgagcatgctaaaagggagggagagtttctgtgcctgttccaggcactttcttgcagctgcaggtgtccctgactcgccccataccccgacccccaccccatctcaccccactccctccctccactcccgcgcttccagctcagcttccctatctttgtgtgcttaaagaaagggagatgaatgtgcttattatggcacactgtttttactggggcctattgtttgtatgtgaagtttggtgattacccaggacacttccagctctgtgcccaagttgcttgtctgtgtttttcagcctgatcttccaggctgctctttgttagaagagaggtgatttctttgaactgcgtgaggttagaatgggagcaatttctgagctgctttttgttagaaagaaagttttctgccagggactctctttaccctaactacctaaatgatttctttctatctcctgtaacactaccttggtacgtatttcagtgattgtcatcatcacccatcctgttaggcaaaccagaaaactcaaagccatccttgttgctcctctacatccctcactctatatccaatttatcatcagattctttatttttcttttctcaactctctaatatattatatccatgctttgccatttctactgctggaactaaccctagtcaaatcacattcctcctttgttgggagtattacaataatattctctacaaggtatacccactcaggaaacagagtgatctaattaaaatataactatttttatgtcagatcttttagtgacttcccattgttgttgagatgaggacaataattattaacaaggtgaacagggactgggatgttctggcccctgccattgcttactgaatcttgcaacaaacccccttgtctctttttttcaggtgctgaaatgcatcatggcctctcctgaggctgggcctttgcatatgccctaacacaacttaaaatcacctgtctttgaaagatgggctattgtatcagctagactaataaaaattattctccacataatcatgtttcttattattaattaacaaacatgaaaaagataccatgtaaaatattagaattcagttttcttttgaagagatctttttgaattaacagcttttaaggctattagttcctatgcattcttcagatatcagttcaagcctcattttcttagggaagtttttcctctgttcactctaggccaggttatgttttattccctatctcatagaacctagactcttgtttccttttttcttagaacattgcctcagtttatggttcttgtattgtaataatacacttatcaatatcattcttgatcaatatttatttcttccatttcaagctctgagaggtctgatactctgtctctttttgtccattgttttttctctaacctctcatagtgtctggttcataatgataaataattttcaagtcaatgaatataaagtggtagtaagtgagagagctgggatttgaaatcagagctgactctaaaactactattctgcagtgacagtatatttttaacatgtgcattataacaataaattacactggatgttcagcacttgtcttggatatattcaaaagcaaaacatgagtcttagcttttccagtttaagcagtttaattatattttcataatttataacattaataaaatggggaattgtggtaaaagagattctgaggtgcatataaaaatgtttgcaggatgaaccacttaagtaagggagacccagtggacatctgccagtgggagctggctgtgaaaggcaacaaggtagaatgaagcccagtttctgtacttgagggacccaggcaccaggcagtgagtgtggcactgatggcccaccttggtctctcctggcccagcctcaaaatagagtagaaaaagggagtcgatgacaatgaattggttctatggaagaagacagcatatgaagggaaacttcattggaatcacataggtagatttttttatgttgttggctgttgtgtccaaaaacattgcagaggaaagattcaatattaaaaagcaaattggttcattgctgagagaatgtaaaatttattctcattctctttccatctattcctcttttcttcccttcctttatctattactctctttcttcctccccttctccatgactcgctataacctctgattcttcagtatgaaagtagtgtacatggacagaaatccctaatatacttgtttttaatagcaaacggggaacatgtaaccacaactctccagcgaaattgagatcatggccacataatctacagctttttctctcttctctatgtagattataatagttttatttaatagaaaacaaaaaaattatgtattaatttcaatttaaaaattttcttgatgttagcaaactatggatcatatcttaagaaagcagtgtatatttcttacccaaattctaacactaaaatattttaaaatattatttatttcctttggtttttaatccatatatttgtgtgttagtctataggataataacaagattatattttctctatatctctcttgccatttgtaactttgtgatttttacatatttaaaagacagttaataggattgaagttgaaactgtatttctattccagatgttgatgtcttcagaattgctttggaaattgtcagatttccaaattaatatcatagattgacttcttcatctctattcttaatcaaaattttccaagaagtaaagatatttggtcaccgggaagaaaattataatgcttagcagtgactttctaagcagcctgaggtgtcttattaaccagagtctgctcaggcctcaagatctgttgctgcccacatgtagggcagtttttctcataagcctaactaagggctgagctcttcttttacagtcattctataatgcacacccaaagctaaaaaaggagtggtcagtttacgttattgtcttattagaatgcatgaaattttgtaatacaagcacaaatgtatgtattctttccatctgttagacacacaccccttttagagttttaaactgtatctttttatattctatatcctatagttttgtttgattctgtgttataaacttccagagtcattctaaagatcttgaaataatctagagttcattctaatatagtggaaaaattattttaatgtcttatcttttgaaatacagatttcaaaactacctagttagcaaatgctggataatgaaatttgttcagagtttgactttttattcattttcttatcccactaacaagagcaccttgaagttctctcatcattaatgagatttcttaaaatatgtgattctgaagttttacctgaggaaaaagaaaaattcacatgtacttttgtgatggagtagcttaacttcaaaattcattttgaaacaatttttcctttcttggttttagccttgaaacatactttacaactctgtttacctccctccccaccaaacatccccttgtactggtagcttatctagttatatccttacttagaagttccaggggctaatcttgaaacaagccaggcatggacacccgaaattccagagattacctcaaggcggtttgtcaacaatctggctattgttgagatgatgtcagcctatgctccaggtcagcagtccccagacttttcggcaccagggactggtttcatggaagacaattttttcatggatgagggcaggggtttagtttggggccaaaactgttccacctcagatcatcaggcattagaatcttataaggagcttgcaacctagatccctcacatgcacagttcacaatagggtttgcgctcctgtgataatataatgcccctgctaatttgacaggagtcaaagctcaagtggtaatgctcccctgcccatggctcacctcctgttgtgtggcctggttccagtctgccactggagggttggcgacccctgctccaggtggaccatgactcaagatagtcaccagaacaggacacacagaccttgtatccagcaccactcctgcatgccttccattccaggttgcccttttaaaacccttctccccagtctaaagttttgaatggttttttaagggaataagcttgtccattccccaactgctagaatttgagtgaagttgcctgcctttcgccacaccttgcctctcatgttttctggctctcagcagtgagcagccagacttggcgtgtggttacacttttgtgcgtaaggtattttaaaatgttctatattatgttattatttatcatattgttattaagttttttcatgtctcccattgctagctgtgcttttagaagaatttgtatgctgtaattacatactttcttaattatgcttttcttgcatattcaaatgctcccaaaagtctttatctttcacttcatttttgatttacaaactgaggaatgcaaatacttccttgtatgtactttaatcccaaactctattaagaaaggcttattcagtgtgtgtggctagggaaacagtttcaatggctaacaagtgaatatagcagaaggaagaagcatatgtatgtctgacataattttttgatgttttgaaaagttatcattcccttggttgtttccccaccattcttcaatgttccttaatagattttcatttgagtttattttctcttaggtattttgtaatttattttttatttcttaaataattttgtcttttgctttcattttttttcctgagttgtcggctctttttatttcttttctctttcctcctcttctgcctttaatgttcaatttatcagtcaaggatctgtttctccaaattcttctttgagtgtatgtaactcagttttgaattgtgacttacagttttcttctgcttcatgaatattttgtgagggaatttttgtcagttcagatgtaattaattgttttattttaatttttggaacaactctctatggattaatattttttcttctgcttattttggttgatttggtattgtttctaacattcctaattaattaatgccttcttgtatcttataacaaagctggtttttttagtggatttttttgagttatgtgtccttcatttttttttttaaatgttgtgtaggatcctaaatgttcgcattgcattttttccctttcattattcatctgccaaagagcatagctacttttcttttggccttttctcccagaaatcatgccttatgaagtcctccacttaacgttgcatgtttttctaatttccttccctgcaatcctgtctaccaggaaattgtttccctatttgactatttaggatggacttactctttctgttgatggttatgctttgctagcattcctcttttccaagcatttttttctcaggttgctcttcctctatgaaggtttagagtagggtggagacatgagagattgtttactggaatttggcaatttctgtctatgtacttcagttacttgtaaatttgagcagactgttctgaagttctaattttcgtggtttcttgtacttcacactttgttcggtattatttttaaaggacatatattgagatgccattataggcatacttgttcttttaaacgtttgaggtttatagtttgaggcaacatgcaaaaacttttgaattgttatatctaccctgtggcttttaacatcatgggtgtcccttttcttttttttaaaacccttgtattaaaatctttgtgtattattcaagccagaccagatttatttttggtgtctgcatggcatatacttttcttcactttgctttcactatttttaatctacatattttacttttgtattttgaacacagcatatgcttaaattttacttttaatttctgtctgacagcatacttattttgattagaacatttagtatacttacattcaatgtaattagatgacatattgggataaattttactacatactttctttttattattccctcttcttttattttttttttccttccttggcctttttgactaatttattactttcttattctatttttcctctagttttaataataacttgttaatatttagtggacatattacagatgactgcttgagttttttactcatcacattctaatataaactagtacttttacttcttcccaggatctttgaactttatttattccctttccttttttgctattctactattgccacattttcatttgtatagattttttattctgtaagactccattattattgttaacacaattaattttcttttagatatactcacatatttacctatgccatttatcatcattacttcatatatccctgagcttgcatctgagatcatttgccttctaaatgatgaagattaaaaaaaaatccttggctgggtgcagtggctcatgcctgtagtcacaggactttggtaggtcgaggcaggcagatcaagaggtcaggagtttgagaccagcctggccaacatagtgaaaccccatctctactaaaaattaaaaaaaaaaaagtagctgggcgtggtggtgactgcctataatcccagctactagggaggctgaggcaggagaatcgcttgaatccaggaggcggacgtggcagtgagctgagatcgcgccgctgcactccagcgtgggcaacagagtaagactcagtctaaaaaaataaataaataaaaattcctaaatgtaagcctattcacaacacattatttcattttgtttaaaaatgcccttatcttcatttttgaaatatattttcactgtgtacacagttgtatattggtaaatattttctttcagcactttgaagatactgttccatcatcttctggctctccttattctattgagaagttgtctgtcatttttactgttctccctttgaatacaatatatctatatttccctctggctacatttaaaatttcccctttatctgtaataatcagtaattacgttttaatatacataaatatgtttttctttttatttatattacatgtagtttaccatgttttttgaatttatgtgttgatgtcatttatcagttgggaaaattctcagccattatctcctaaaatattgcttgcttcttcgtcattttctctcttttccaacctgggagtccaatttacatttttgaagaatttctcccctttttttactttgtaccttatattcttttctatatcttttagcttcttcctatgccagccagttgctttctttggattagtcttccagttcacaaattaaaggttgtgactgagttcttcattttctgcattcttgttggtgagtttctaatgtccatcatttctcctgggtttggtcatacagtcttacgtttcatatgcctattgttgttgttgttgtttggttttatttttttctttttgggtgcaagacattattttcctaagaaatagagggctaacttaaggctcaagagtgattttatcttcttccaaagaaatcttttactgacatcttgcaggcaactgtgctagaagcactattaattccatgtcaccttaatccaatgggtgattgagatgattcaaagtttcactttagtacctgtaggtcaagtctatttctaggaatgaggatcattcttattccttgtatgtagccctcagagtctcaatccaaaccatggggtgatcactggaacccatttcttggaaggtcttcagcttcagttgtagtccttgtttcaatttctttgctttctccatcagaattgtctggcagcagccaaagattcagaagaaaatgaactctaagtgcaaggctcatctgcatgcatgtcgctattctcttggattgtgaatctattattcttcattacattgttacattatccaatgctttcaaacacatttatttttgttcatattttgaccatatttgctacttgcttttaaatggagtgttattccacataaccttgttcatcattactgaaaatctccacagctttaaggaaaaatatttataagtttacatttctgtaattgtgtgtagattttacccccactgaataatttcaaacagtatattattgttgaaaaatcgaatatatgttctagaatcatattcttggccagagatttcagtccctccactgtatgtgaaagtcaagttgttttatctggtcttcctgtttcttcatggtcttctgccactcacctttgcagactttccattcctgtctacatctactatctgtttatttattttcacttgcatttacattttttttcttccatactctgtctgtaaagatacctgcagtaccaggatttgattttccccgagtccaaattattttttagattattgcatgttgtttgttaccatcttctccaaatataataccattctctgtgtgcaacactgtgaaccccttgagcttgtaattagttgatctatatccatagaacaagtgtaatgccactgtatcaagatatatccataccagggcctctacccctttctagttgtttccctctgctgaaaattacatggctgtaaataaatgtgctttacttcttttcatgtgcttgctaatgttgcagggaacctcaatcaggaataaaacagaatcacgtggcaaagagattaagctaattttgaccataagaaaaatgtttgcaataatttaaacaaggttatcttgaattgtcactctttaatctttgattttgttatgaatgcatagtaaatttgatatacatgtgcatggctagaagtcaaaagatagaacttaaatcagactctttgaaaggtattactaaaatataaatgtgttatggcttaaagtcatagttacataatgctacggttggtcatagtaaatcagtaaatgtattttttagagccactaaatctttcacactcattatcattctatagtgcaaaaatgaataatgttttcagcaagtctcttatagtacataccacctagtgactgaattagggaaataacattcctaagtaagttcctgtataaacatgaatatacatatttatacatgaatataaaaaatataaattataattttactttcatgccatttctacctcagaagaataggttgaatctgttccacgaatgaaacataaacaggacattcacttgtggtagagccatttgttcactaaatacacatttatacagtgactattatggataaggtattatgctagagagagaaaaatgaataatatgccatccttgtttgctagtagctcataggtgaatggaaggactatgcaatgacacaattgcaatgttctgtaataaatgcagttctacattattaacagaggcaacaaaaaggaagaggtaatatggcatggcttagtatagggtgttatatttattggagcagtataagataatgttagagagataggcttgagttatccctatggatgatcttatagagtaatcttaggaatttaaactttatccagtggatagcggagtgccattcgatggtaatacatagatgaatgatgtgcaagtatgtatgtcttttagtaatgttattttgtctgagaaatttgttaagcagggagacatattagaggctgcagcaacatcttgtgaaaacaatgaaacttataataagaaagaagtaagtgaatagagaatgagcaatggatttttaatatgtgatttgagaaagcttaaaataattagaataatggcacatttcaggttggcaagtgccattaatcaaaatcatgaaagcaagaagaggaactgacttaagtgaaagttaaaaaaaatgtttagtgttaggcagtggaacatccaggtagaattagatgaagccagcaaagatataataggataagccctaggcatggacaaaaatgctataggaatagatgaggaatgagaaaagatacagatggttatggactcaggagaagctcaatgtttcagggacatggatgtatgtgtatgtgtatgtgtgtgtgtatgtgtatgtgtatgtatgtgtagtattctgcttactaaactaaatacagtgacaatgcctggacaggccagggaaattgttggttaacattagattatcagtcataaatgagatgttgaaaaaaatgttaaaaacattgtattctgattatgacttaaagtgttgatggtgacacattaacagcaaataaataagaggcaaggcattgtgtagtacaatttttaagagattgacttgttatcttaccccatgctgtcaaagaccacttctacagaattgcttgacttttggagtgaaaatagggaattcctacagtcaaaggcaatattttacattaaacagagcccacataactatgcagacagtatatggagttaatttcagctggacactattatattcagtctttacaaattgatgcctcagccataaaagcacctcagtgcaatctctagaaattggatggcttcccattgtaagcctttttgaggtgttggacacaaaataagtttttgattgtatttggaggagatcacatgttagttgggggtttgatatgactagactgtgtccctacccaaatctcatcccgaattataaaccccataatccccacattttgagggtggatcaggtggagataattgaatagtgggggtggttttccccatgctgttctcttaatagtgagtctcacgagatctgatggtttaataagcatctgacatttcccctgcatgcattcagtgtgtcctgctgccctgtgaagaaggtgcctgtttctcctttgccttctgccatgattgtaagtttcctgaggcctgcctagtgatgtgaaactgtgagtcaattaaacctctttcctttataaataacccagtctcgggtatttcttcatagcaatgtgagaatggactaatggactaatacagtaaatcggtaccacagagagtgggtgctgctatcaagataccccaaaatgtggaagctactttggaactgggtaataggcaaaggttgaaacagtttggagggctcagaagaagacacaaagatttgggaaagtttggaacttgctagagatttattgaatggctttgaccaaaatgctgatagtaatgaagtccaggctgaggttgtctgagatggaaatgaggaacttgttgggaactggagtgaaggtcactcttgctatgctttagcaaagagactggcagtgttttgctcctgccctagagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtgccctgcatccaagctactccagctgtggctaaaaggggcctaggtacagctcaggctgtggcctcagacagtgcaagccccaagccttggcagctttcacatggtgtggagcctgcaggtgaacagaagtcaagaattgtagtttgtgaacctctgcctagatttcagaggatgtatggaaatgcctggatgtccaggcagaagtttgctgcaggggcggagccctcatggagaaactctgctaggggagtgcagaagggaaatgtggggttggagcccccatacagaggccccactggtgttgcagtttttttgcttctgtagttcagcaagtgcgagggagtggctcccagcagcttcttcactcccatagctcagtgaccatctgttccacagtggaatctatttcagtgaccttcactgccaaaggagtaaaaagaagtacagcgtatgatccctcccaatctgggcctagagagggagaaagaaaaggaagagtccttactagtactaagtcccctggttgaataaaggtggccttggttcatgggtttgggcctttgacatttgtttccgttcctgcaggaaatgggccaaagaacttacatggttaatcaaatcaaaggttacatggttaatcaaatcagaggtttcttggtctagaaggaaatcattggtgagaaaaggctgtccttacgtcatttcaaagggaattaaactcagcttcaaaggggtgtttctaaaacagtagtgccatgggcatgagagtaatccaggggagatgagtctcttaagaaagttttctgaagtgccttttgataatatcatgtttcttttctgcctttcccaaggaatgtggtctccaagcaccatgaagatggtactgtatacctagtgcctttgagtccccctgggtgacagcaaccttgaatgagaggctgttattgcctgaaggtacttagggagcccaaagtgaggaattatctaattaattagtacttctatcacctcagagactttctctgtcagacatgaaaatgcttctatccagttaatgaaggtatatacccataccaggaggtactggatgccccttatctttggaatatggatgaaatccatttgccagtcttctcccaggtagcctcccattctttgggctccagcggggagacaccattgactggggggattatttttaaggcaagcctcacaagcattaatgacctgtttgaccatttttacctgacaacaacctttgagccagttggtaggttttatcctttcctacgtggaaggcttggtgaaagattttaagaactttccattggctggaatttggtagatgaagtttgccatcctccagttgtagctgaaaggtatatccttgagaggaggcccattctatttctgcaggagagtactgagtttttgtttcttttatggagccctcccagattagaggggcctcaagtggatcagaaatctggggtactctaactgccaatttagctgcttgatctaccagtttatttccctcagcaatttcatctatctccttttggtggcctttacaatgtattatgccacttcccgtggaaggaaaaccaaggataatagtctgttaatttcccgatggtacttaatgagagacctattagctgtgaggaagtctgtctcttccagatcatggcatgggcatcgaggattgcaaaagcatacttagaatcagtataaatgttaactgctttccctttgcttaaatgcccccatgagggcatttaactcagctagttgagcacttgcacccgagaaaacaggtgcactcacaatagtgtcattcaggatgactactgtgtattctcctttatcccttgttctacaaaagaaattctgtctgtaaagagagtccattctgcatcctctaaggggtttttttgaggtcctctctggctgcataggtttgcactactatctgttcacagtcatgttcaggcttcccaagtttctctgggagggaggtggctgggtttaggagagccagattcttaactgaactgtagattcctccaatagcagagcttgatatttgaggaggcaattgtttgttagccagagactccccttagaagacagcagtcctgccaggttttgtggggtataaatggctaagttcttccccatgattaacttagtagcctctggcaccagctaagctaccgctgcaactgcccagaggcaggccagtcatcctttagccactaaatcaagttccttgctcaagtagcccatgggctgttggggtgggcctcagactgaggatagaactctgtgatgattaatattgagtgtcaacttgattgggttgaagtatgcaaagtattgttcctgggtgtgtgtttgatggtgttgctaaaggatattaacatttgagtcaatggactgggaaaggcagacccaccctcaatctgggtgggcacaatctaataagctgccagcatggctagaataaaagcagacagaagaatggaaaagactgactggcttagtctcacagcctaaatctttctcctgtgctggatgcttcctacccttgaacattggactccaagttcttcaactctgggactcagggactcagactggcttcctttcttctcagcttgcagacagcctactgtgggacctcactttgtgattgtgtgagccaatactccttaataaagtcccctttatatatacatctatcctattagttctgtccctctagagaaccctgactaatacaccttcctcactgatacataaagatttaacatcttccctatgggaagactaagggcttgtgcctcaagcaaggcttgtttcaattggtgaaaggcccttttaatatttggttccccaattatggagtgagtcttagctgcctgagtttctttcattaggtgatataagggatgagctatctcactgtgcccaggtgtccataatctgcagaatcatgtaatgcccaagaaccccctcagttgtttgagggtttgaggaggggaaagtaggagatgggcttaatcctttattcacctgttgccctggtctcctctgacaagagtagacctagatacttcactgaagtctgacagagctgagtcttagattttgagatcttatgtcctctgttaccctgaaagttaagaagaggcttactgccttcctgagtgatttcctcagttagggcacaacagataatgtcatctacatattgtaaaattttaacctgaggataaaggaactcagagagaccccttgacaacactttaccaaacaggtgggggctgtctcagaatccctgaagtacaccatccaggttagctgggtggtctggttggagggatcctcaaatgcaaacaaatattgagaggcagggtatagtggtatgtagaaaaaggcattctttagttccaggactgtgagccctttagttccctcaggtatttgagttagcaaagtatagggattgagaaccaccagatatatcggaaccacagcctcatttatgaggtggaggtcctggagcagtctgcattcccatttggatttctgtgctcccaatattggggtattacaagggctgttgcagggtttgaggaggcctgcctcttcaagttatcaatgatggcttctagccctttcctagcttctggttttagggctcactaaactagcttctggttagtgaagcaggtgggatcctaaaggtggagttggaccagtatggtggttgtggcttgatcaattttcccttgagctgccaaaacttctggattagtattagtctgcaccagtgggagacaaagagcctgccttggagccataaggatggtagttcccttatgaggtaaaatatccctatgtagcagaggagttggcctcctggcatgatttaaaaggcacgagtaagcaagaggtttccccaactgcaagtgagtggttgggaaaaatatcaggttaaagtttttcttgagatgcccctcataggcatgctaagggaggaggggaggcctggactggagaggagaacagaaatggctgtgctggtatccaagaggaggttcactttcctctcttcaactttcagagtcacttggggctcctgaatggcaatgacattttgagttattggagccagggagagaagcccaaggactcctcagtcctgctggaccatttgtgagtctggctctggactcagtgacctgcatctctggggacagtccaccctccaatggttccctccagagattggacagggtcaaggtggcttcctcatgctgcctgggcagttgttaaggtgccctggcttgccacatttgtaggagttatcaggtgcatctcagggattctgggtttttaagcctgcaaggcagctattagagactgtaccttttttcttgtgtctcctctctctctcttcagtctcctcctgatccctgttgtaaaagaccaaagtagccactttcaggaggttctctaaagtgctatcttgtcccatggcctgcttctgcagcttcctcctgataccaggggctgcctcctaaacttactctttaggattagttgtccctcaaatgaattaggggatagagaggtgtaccaaggcttctcttagcctctccagaaaggaaatgggtcatctgatccctggtctatcatggatagtttggagtaattgagaggcttagttttagtccttcataagcaaccaatatgcacatctgaaagtgtttcctcctctattctcccatgttgtattagtcagggctctctagagggacagaactaataggagatatatatatatatctctctctatatatatagatatatatatatatatctatgtatttatgtacagatatatatatatctatgtatttatatatagatatatatatctctatgtatttatatatagatatatatatgtatttatatatagatatatatatatctatgtatttatatatagatatatatatatgtatttatatatagagatatatatatctatgtatttatatatagagatatatatatctatgtatttatatatagagatatatataaaataatatctcctatatctcctattgtgtgtgtgtgtgtatatatatgtgtgtgtatatgtgtgtatatatatatctgtgtatatatatgtgtatatatatatctcctacatatatatcatatatatatatgggaatttattaagtattaacttacaaaatcacaaggtctcacaacaggccatctgcaagctgtggagcaaggagagccagttcaagtcccaaaactgaaaaatttggagtctgatgttccagagcaggaagcattcagcataggagaaagatgtaggctgggaggctaggccatctggtcttttcacaattttctgtctgctttatattatagccacactggcagctgattagattgtgcccacccagatcaagggtggatctgtcttttccagcccactgattcaaatgttaatgttctttggcaacaccctcacagacacacccaggatcaatactttgcatccctcaatccaatcaagttgacagtcattattaaccatcacaagtcaaccccttgtcaacttgaacccatacacatgtcctgagattatacataatcaaataaagacaacaataaggtaataattacacctaacataataaaactatcctttgtacatcaggaaacgcaccaatccccaacccaaatactattacataaagttaataatacttaaatgctgaggtgaagtcaataaatcttatgtcacatgatagaggggaaaggaaataaaatgaagatgttttcttagtacaggtgtatacatgcacaaacatgtttttaatgaaagaaggaggaaatacttatgacaattacagtcctcatttctgcagctggtcatgtggtcatagctggtattgatgactaccttcttcaactacccattctgtattccctttgccttcagcaagcacctcagcaggttttttttttttttttttttttttttcctggtggaatgacccaagccttcattcctgaagggtctgggtcatttgtagtcccacctgggttggggtgttgcagtttcccattgacattaatcacagggcatggtaatactgtgagatgccctaatggatctcctatattccacgtatactgttccttacctttgttgtggagtagtagactgatttcatcttgatagtccaggtcaatcacatcagccaacgctgtaactcccttcttaacctgttgtcttaaaggtaggaggagcccaaagtgtccaggtggcaatcttaacatccagtttaatgaatcattgttgtgtctcctggtggaagcattcccctctctagaactaagacttctagactagtagaatgtaatgccatgggaacaggaagcaagaattttgctagtgtatcactagaagtgatggtgagtggtgccacttccacttccaccccttgattcctggacctgtgaatcctgtctatgggagaaacagtaccatatattggatgctgattcagaacatgcatggccttctggagaactttgcctcatccaagcgaagtattatcacctagttggcattgtaattgtgacttcaaaaggccattgcacagtttttatcagtccagctgcttcaggatgatggggaacatgataagaccagtgaattccataagcatgatcccactgccccacttttttagctgtaaagtgagtgccttggtcagaggcaatgctgtgtggaataacatgatgatggataaggcattctgtgagtccatggatggtagtcttggcaggagcattgtgggcaggatacacaaacccatatccggagtaagtgtgtattccactgggcacaaatctctgccccttccttgatggaagaggttcagtataatcaacctgctaccaggtagctggttgatcaccctgaggaatggtgccatattgtgggctcagtgttggtctctgctgctggcaaattgggcactcagcagtgcccatagccaggtcagccttggtgagtgaaaatccatgttgctgagcccatgcataacctccaatcctcccatcatggccacttttctcatgggcccattgggccatgacaggcttggctggggaaagaggctgagtggtgtccacagaacgggtcatcctatccacttgattattaaaatcctcctgtgctgaggttacccataggtgagcactcacatgggatacaaatatcttcacagttttgaccacttagagaggtccatccacatatctctgccccaaatttctttgtcaccaattttccaatcatgctgcttccacatccctgatcatcaagccaaaccattggctacagttcacgaatcagcatataatcacacatctggccatttctctatccatgcaaagtgcacaaccaggtgcactgctcaaagttctgcctactgggaagaattccctttaccactgtccttcagggatgtcctaaaaaggggctgtactgctgcagctgtctacttttgggtggtacctgtatattgtgcagaaccatctgtgaaccaggacttaatcttctcttcctctttcaactgatcataggtaactccccatgaagccatcagtgcaggctggggaagagaaggtacggaggcaggaggggagcatttgagccacttcctcaagtaacttacttttgccttcagaacctgcttgagcccaatcacgtatataccacttccatttgatgatggaatgctgctgtgcgtgccccactttatgactagatgggtcagaaagcacccagttcatgataggcagttcaggtcacatggtgacttgatgacccatagtcaaacgttcagtttccaccaaagcccagtaacagaccaacatctgtctctcaaaaggagagtagttatctgcagaagatggcagggcctgctccaaaattttagaggcctctgctgtgattcacctatgggggcctgccagaggctctgatcagcatccctatctgccgctgtcacctcaagcactattgaatttgctgggtcatatggcccaagtggcagagcagcttgcacagcatccttgatctgttgcagagccttctcctgttctggagcccactcaaaactggcagccttttgggtaactcgatgaataggccacagtaacacacccatatgaggaatgtcttgcctgcaaaatccaaataggcccactaggcattgtgcctctttcttggttgtaggtggggtcaaattcagcaacttatccttcaccttagaaggaatgtcttgaaagatcccacacaactggacccctagaaagtttactgaggcagaagttccctaaattttagtcagatttattttccatcttctggcatgcaaatatatcaccaataagccctgtgtgtttgctacttcttgctcactggatttcatcagtataagacatgaatgtaatgaacgagtgtgacatcttgtagaagtaaaaagcgatcaaggtgtctccgaaaaagattatgacacaaagctggagagttgatatacccctgaggtaggacagtaaaggtatattgctggccttgccagttgaaagcaaattgcttctagtgggccttatggacaggaatggagaaaaaggcatttgccaactcaatggctgcataccagataccaggagatgtgttaattttctcaagcaataaaaccacatgtggtacagcagctgcaaatggagtcaccacttggttaagcttttgataatcgacgatcattctccaagatctatctgtcttctgcataggccttatgggagagttgaacaggaatgtggtgggaatcaccacccctgtgtcttttgagtccttgatggtggcactaatctccgcagtccctccagggatatggtattgttttcaatttactatttttctaggtagaggcagctctaatgacttccatttggcctttcccaccataatagccctcaccttacctgtcagagagccaatgtgagagttctgccagcctgctaagtatgtctatgccaattatgtgttctagcactggaggaataatcacaggatgcaccacaattcagacctgagctaaaactccattagttacctgacctccataaccccctactttaactggaggaccacagtgacattttgggtccctaagaatcaatgtcagctcagaggcagtgaccattagtccccgaattatctgatcttttcccttcctccaatgcacagttaccctagtaaaatgctggaggtttccttggggaagaatgggagaaagattaacagcataaattgtcagtagtgtagtggtgtccttcctcaagaggtcttggctcccccttcattcaaagggttctgtgtctgtaaactggctcaagtctggaatttcactgaggggccatgattctctgtttttataattcaaattcatcttttgtcccttctacgtagaagttttctgcttatataaattaagtagaaatacagtaggcttcctatcaatttcacttccaggaactccgtgattaattagccaatgctagagctctacttgagtcagactattctgattgcttctttgtctctgctatccattacggtacctatgctcaccttgcttttgatggttgagtgtcgccacttggtccctgccatctcaggatccaattattccaattgtgtttaaattttgtagatgagaactgcggttcctactattagatctgacatacagagaagagcaattacagggctcttcaaagatgcgggtgctatcctcacaaatctattttgcaaggcattggtcaagttatatcttctggaccctctcagctaggatgattaggtctgaagtgactaatccactccagcatcccaatctccctaagcctttggatcctttcctctatattaaaccaagggagatcaggcacagtaggccatcttttaatccatatttcagctaaccaagcaaataaactactagaaccttttttactccccaagctgcaatattaaattcagagtccctacttagtgggcccaaatcaataaatttagcctgatccaactctatgtttcttccactattatcccacacccttaatatccattcccatgcctgttctccagatttctgtttatataaattagaaaactcaagcagttattttcgagtgtagtacacctcctcgtggtcacactctcaacctcatctctaggggcctgccgggactttagtctagttatagatctagaagcaaacaggtgttgggtgtggctcctgagaagaatcaacattatctttcctggcaactgcctcaggggaagtcatcactgttgcttcaggcagcacagggtttatctcctcagacaaaggtggaaaggctgatggcagcatgggttggggaggggctgttgccactactgggcatggggatgcttttccttctggcaaaaaagtttcatcagagtttacaaactcagtgtccccatcttcatcagcatccttccacatgttcccattccaagttgcagggtcccattcttttccaatcaatgccctcactttaatggtagacacctggaaaggctgcacatgcactttttgttgtaggttagccactcacatgataagagcttctgtctttttttccacaatttcagctcgttctctacaggagataggtctctcagggaaaccttggcagatttgaggctcagtatctgcttctgaagttgggagatagaatccctgggttcctcattttctttcatcactttgtctactgaacttaggagcaaccaaccagctttattacattccccacatatggtcaaaggtattatatatatagtcacttaactccttgcctctcatgtttggtgactcaggagtgtcaaatgcatttattttgtgtatctctataagcagttcacaccaaggactgtcagtgttctccatactattagaagtagagtccttagcatttttgagtctaatcatattaagcagccaactccagaaaccctaaaaccaatgaaagaactctatccttaatattctgttcctctagaaccactcctggtaccaaaatctgtattagccagggttctctagagggacagaactaataggagatatactggcagctgattagttggtgcccacccagattaagagttggtctgattttcccagcccactgactcaaatgttaatctcctttggcaataccctcacagacacaccccagattaatactttgcctccttcaattcactgaagttgacactcagtattaaccatcacacatgtcatcattggggtcccatttagggtcctccaatggtactgctgtttttccaattgtataaagctcttccccttgcttggcactatatgaggtacaaagctcatccccaaatttctctgccacttgcagggctgtctgcttctcagcggtagtcaggattcgattccaaagtaacattacatccttccaggagagttcaaatacttgggttaaattctggaaagcctctatataactgtccgggtcatctgaaaacctgccaagatccccctaaatttgtcttaagtcctgtagagttcaggagacctgtatcttaatgggttatattcacaaggcattttctataggggcatgagcaaggcttggacctgcctaaaatgatttttaggatgggggcaaaataatataagaagttttttcttcaaagtctgaggggtcacaggagtcccagtgattcaggatacacttgaggggagtgcaggctgcaggtggtttgttacccacctgaaaagagagaggggagaaaaggcatgccttagtctctcccttgctaatcttgaatttgaagcatccctcaaatctcagtaactggtactggcaccatggatgggctcttgctgcttatgccatggttgtgagtatgaccttcccccatgaagcagaaaggactagttggcagggatagtcatgcttacctgcactctgtcctagccttctgttgttgacttcctctggttcctcagatctagttttctttttagggctccaaactgaagcatgaaaaatacactggagtaatggtaaggtgaagctatggaaatagatccttctcaaacaaaggaaagaaaaggaaccctgagaactggggacctggcctaataagatgtcttccaaaaggaaaaaatcagtccttcacatagaaaagctccttgtattttcaggattatgttgattcctgacatggtgggaaaagaaacaacttaaatgcagaggagggaaggtccctgggggaagtggtctcttgcactatgctaatgggtttcttcaacaggggaaagaaaactctcttaatttttacatccccctgtttctaagaatagacagaaacaacatggttcaggtttacactcccgataactaagccaagtattcattctacccactaatattatctttttggcttgcaaaaacacttgtaacattgtatataaagaagggatagaagccacaagagtcttgaaagaaagaaaatgtgataggaaagactggaagttttggtgcaacacctgaacaggctgtcgggaattggagccaatccaggagtcttccagtaatgtcgaggcatggccttggccagataccttcaattgccccaggaccttattctgatcccacatgacagctagaattctggaagagaagctggattggaataaagtgaacatttccaacacccgagggtgaagggggattgacaaaatcctcccctgcaagcctgttctctgaatcttatagaccagcagctgcactatccactcttaactggctgacaaaggcccagtgttctatctgtttttgtaaaaaatctgaggacaagaagcctcggaatgaaagtaaagagtcataggtccactcttactcaaactttaattgatcctggatgaacccccagaaatgttgtggcatttttgctcgcatagtttggtgagtgggaaggagtggcacccagtggcttcttcactcccatagctcagtgagcaggagggagcggggcccagtggcattttctctctcttagctcaggtagtggaaggggatgttacagctcttttactctcgctgcccacagcttggtgagcaggagtgttacagctctttcattcaagcagttcagagatttctacattcttgtcctgtgaccaaaaggaataaggtatgtggacactggagagtgagtaaggcagagtagaattttattgagcaacagaaagaaagctctcagaagcaagaggggacccaaaagcttgttgccatctgtgaagctgagtcgggtttttatgggcttagaatgggggaatgaatgctgattggtccatgggtgggctcgaaaaaggcatcatttgatgggttaaaaggcatcattcagaagaaatcaactgagagagagtagataagatggggatggcagttttcactctggtcctagactctatctggaactggaagctcagttttcaggctttaggctatccttggcttgaaggtcaagtttcaccagggacccatccctgtccacctatgaatttgtctgtctcctgtatctatcaatggggcactgcctaataaagctgtgagaagagggccaccatcctccagacctcagaatggtagatccactgacagcttgcaccatgcacctgaaaaagccacagacacttaacaccaagctatggaagcagctgggaggggagttataccctgcaaagccagaggaatggagctgcccaaggccatgggagcccatctcatgcatcagcatgacctggatgtgagacatggagacaaaggagatgattttggaactttaaggtttaatgactgccctgttggagatcagacttgcatggggcctgtagcccctttgttttcacgatttctcccatttggaatgggagcatttattcaatgtctgtactcccattgtacctaggaaataactaacttgcttttgattttacaggatcataggtggaagggacttgccttgtctcagatgagactttggacttggactcttgagttaatgctgaaatgaattaagactttgggggactgtgggaaggtatcattggttttgaaatataagaacatgagatttgggaggggccaggggcagaatgatatggttagtttctgtggccccaccaaaatctcatcttgaattgtaatccccataattcccacattttgagggtaaaagaggtggagataattgactcataggagtggtttcccccatgctgtgcttgtgatagtgagtgggtctcacaagatctgatggttttagaagtgtctggcatttccccttcttgcactcactctgtcctgctgccctgtgaagaaggtgcctatttctccttttctgtctgccatgatagtaagttttctgaggtctccccagcgatctggagctgagtcaattaaagctcttttctttataaattgcccagtcttgggtatttcttcatagcagtgtgagaatggactaatacagggttgtatatcagaagtcatataaagatagaagaatattaaacaggtacatttaaattttgtcatgaggttatgacaagttactctgacttcactaagcaaaccacctgagctgtttagatatcttaagtctagctagcaaaataaaacactgtctatatcaatgtagcagtatatgtgaaagggatttgtaaattctgtaatgtcataaataggagtactatttttgtactaatagaaaatttttaagtgtggcttgttcttgtggcctgttaacatgaatgtgatggtagctactattacaaaattaccacctcttctctactctcgaggatggtgattcactagcaacagtttctctttaggaactttgatatcagggaatgcctttcatagttccgtatcccaggcatttagcctgctatttgcacattaatacattaatacattaattcatttttttgaatgaattaataaaaactatgtgactgttctggaagattctgccatattcctactctgtgagtggtgggagggggaagctaaaatcaaggaggcttcacttaattattcttatccattcatcttctgaatactcttaagaatcttcaatttaaccaatagtcttaaataatcttactaagggtttttaatacatttaatgagttataaatcaaggataaggatagaaaattggcagtccatagatgcattttgtttggtcctcccaatgttgacatttctcagggttaaataattataataaaaatttactgtcagcattaaaaatttattctagttcacctaaacatgtattcttttctctttttcttctccaggcacactggcttccttttttttttttttttttttttttgtaaaatgccacatttactcttaaattctggactttgaactggctttttcctatgccaggaatgttcttcttctaaatatcatcatggtcaactctatcactgtcttagtctttaatcgaatgtcaccttctccatgaggcctcgccagattgccgcatgtataatttcatacatcatgccccaaaaaattctccccatgtacttccagtctctcttacactgctttttctttctactgcatttttaatctaacattttatgtgatatacttgtatatgtttattatttattttctgtctcctcaatatattataagctacatgaggattgagatctttttgtttgtgtgtgtgtgtgtgtttactagtgtatttcaggcaattggaataatgcttgataaattaggactatcaataaatatttgttgaatgattcaacgaaaaccccaaatatatggctccttttgaaaaaaaagcactatctgttaacattgggcttacattcctacatcctccaccatttgttggaactgagaggcaacaggtgctttaggcaagacatgcatgcattcctcggtcctctacagccatcaccaccacacttgtcttcccagtgctgagccttatctgcattggcatttatcttcatatttattcttttttttacaataaagaggaaaactatgtctagtactcatatctatatcaaaagggggtaacatgggataaagaaagatcaagaaagttatatgtttattgaaacaagggggacagcatgtttccatgttgaggtgatctacgtgttaaacatgtagaatatatctcttcatatgtccacctagttcattcatttgaattatttttctgatgcctggcttttgaatttctgacctctgctctaaatagacataactgcaactttacttaaaattcaaagataagaagtatggaagcatgcattatcagaaagaagataaaattatggaagcttacaataagatcaagtatcttgagtagctaatagtagaagttagttattttactgtggaattttattacattttaagttgccaacccacacaaagataatccttgtggacatctatagagaattaaattttcagttagctaagatgctataactttgggcataaacttgcatttatagctgggcatgtaaagcaaacagatgccaattggttgggacagtactattaggcatatccccttagccaataatgcaaataagttagccttgctacagcaaagttttgccttgcctttgaggaatggaagcagattaaagcagggaagagatgtcaatatcatccatactttctatccacaaaactaatcagaaaatctttgacatttactcagagtaataccatacctgaaataggtgaatctatgaattcttaatttagtaaatctgttagaaacaggtcaccattttcaaaagctgttacattaattcactttggtgtaaagcattgtctagcactatttcagcacccagtattgacagaagtgatcacttgtgtcatcatatggcacacacttttccgaacctccatatgcttttggctacctgtctttctattttgtacactttccctttgaatatttttaggtttgcaacacttttatgtgattatcatagtgttaaacagaagttataatttactgtccaggattattttacatataacatgtaactgaccctttcagatgttttttattattacataacaagcttatcaaaaagaaaaattgaataacttagaaataatatttattaaattgtaattattaacctgttagcattaaagtcaggataagatagctgagctgtattgcaatttcaattacaaaaatgcgtgcttattcttcattttggaagcccgccaactaaagaatatattaggcagtgaacgcaacatgacaagccattcaattcagcaatttctagttggtcagatacatcttcaggcaaatttaacctttataaggcttattcttggtctctgttttgtagagattacagaattgtttattttaaataaaaattatgttgagagaggtataatctaaaagtcattgaaatttccacttctatcaattttaggttacatgctgctaggtaagaggaattaataaaagtttagaaagtcttcattcattttcaaagtaaactgctagtagagaaactgccttactttctaaaccttaatagaatacgtttttattgataaatgtccaattcattgacttttgtcatctttcaattaattgcttacattttttgtttttaataaggttttaaaagttgttataaccatttatcacaactgtgaactgacttgacttgaaaccattagcaaaataaacacctgtattttagtagctacccataagcaataactacatactatgtaagtgccccctgacctcctgaatcctgcttcaattttgtttagcctctgtttaagctcctggggattatgggggcaaccagtatggcttccaaagaaacagagggataagtaacccaggtgtgtcctctttgtgccagtagtaggaactatgccagctggctgccctctggcactgtgcatagtgaacagaatatttcttgcattccccaaagggaaattttagtaaaaggaacacaaatgaattggatcattattcccatttctcagaaaaggtctgtgcaagagaagggcacagacttcattctttgctttatgacacaagtttattaaggttgccattgcagtgatttttgtaaatgaaggaagcatcagaacatcactgaaatacatactataattgggaattacagacagtaataggatatcctgacttggtaatgagaagagaaaatgagacttccctaaactttttctcagtatgtatgatcttatctaaaacttgaaattttggtgtctgcacaaaaacccaactcaaatatctcagtggattaaaacagcaaaatatatctctcttgtactacattgtgcaagggagcttcgctcatcataatcactgaggaccacaggctggatgggagttcctgccccatactttcatattatcaaatgaagggcacaaaggggtggccaaacacatgctggcacttcaggcttgcccccatgttgcttttgctcacatttcattcatcaggtaaatcacatggccacacctaggtacaagagggcacagaactgacatttgtaaataactctaaaactactaaacatcccgatgctgaatttgtctcagtttaaggaaatgtcagcagcaaaaattagtgccatgtgctgggttttgacagtagtaagattataagcattttcttatttagtaggaaggaggaggtttataaaatcaaatggtataatgattcttctaattttttatttagaatttttattttatttatttatttaaaaatgttcatttttattaactaataaactgagatttaggtttaggtataattatgttcttcttaggtaattataaaccatcagtggaacatgcaatttgaaatatctgattactccctgacacagagtctggtaatagatgagaaaaaggctttgtgaatcacggttctgattagagtgtagaattatgtatctaggaaccagattgttaataaggtggcaaagcccatttatgctagaggaaaaagaatattaaatagataagccattaagttaatttgcttatattcttttaaatatggtatttatagattacatacatatttaattccatgattttctgtgttaaaagtaacattaattccttatagaaaaatttgaatatgcagaaatgaatgaatacaaaatattataaagtaaaaagcatatgaagttagttgctattaatatttggacacactttattttagttgcacacatatatgtgtaaatatacatatatcatttatattaagtggacactttcctatgtccgtattcttcatgaatattattattaataactaaataatgtttcatcatctggatgcatggcattctatggttcaatcaaattaaacaccctttatttgaaatttaggtgtttctagtccttcactataataaataacgatgcatagaaaactttatatgtagatcttagcaaattggtctgaatattttctcagagtacgtttttagaaatggacttaattatggaaggtgtttggtcattatttaacataattgatacatattgccaaatttctttctagaaagtttgcattattaccagcagtgtatgagagcacctgtacaaatttacatggtatatatattgaacctgttatattaatgcttacagataggctttataaatcttttaactgtttgctaaatttcgaaagatgggttgttgagcagatggattctcaaacttaagcaagcctcagaatcacctagaaagctcactgaaaacagattgttgggccccattcacagagactctgatttagtaagtttgggaaggggtttgagaatttgctttgcaagtaagtccccagataatgttgatgcccttgtcagaggcttgcttttgggagaactgttgaaattgactaacgggagtttgttttaaagtaatagtcattattcttcaacatagtaaaaataggcacttacttaactttagaagctaaatattttctaagcatatcaatttttgtgggttagcctttaattgtattctaaaagtgtttcttaaaataattccttctatgcaaaatactgtgcatactaagaaaacataaatctaaccatttcctatgtttttaaatcaagcagatcttttatctctgttcgttagtttatgacacaaataagaagtttagtcaagaaatataatgttaaaataatgatgctgtgaagtttctaagtgaatgtttatggttgtacatcttttttttcattttatggcttcagccttatcttatatgagtcaaagttaaaaaagtttcagggataaatttaaaatacaataaaactattttgttttatataaacatctagaatagaaactttaaagactaattagatacttgaggagtactaaattaaaaatatttaagtacatttgggaaacatcattttgcaaatatcatccttctccctacagtctaaagcccaagaaatgaagacaaacataaaggtcaagtaattgaatagatatatgagtaagaaagacttttcctgacccattcgtattttcatacttagattgtgaatgtcaattagctcaatcaagccttgctgataatgtcagctgtcagtcactcctaggtagtgatgtgtgaagtttgtcagcgggtaatgggccatttgagtgatgaatgaaataatgagggcacagaagcctaagcaaaacgtctccatttttggtaaattcctctccacatgggaaattaagacaaggaaagaaaagccatataaaatctcttttaatacggtgtttattttaaaaatatatatcttaaaatatcttttaactttttatttttaaaaattaatttaaatggtcagtgattaattatcatttcccaatagtattgatcagtgtaagcaacattaggtactgcaagagataagcttgctcccagattcacgttgatattttgacttgaattgaatatttaaatcgaacttcttcagaagtttatcagcagactttctgagtccatggactatctatactaataagaccttgctttatatctctgaataaagtgtagtttctttctttaggcttaacacatttcttgttagtgttctagtaggtatttttatctgattgctgttagagttagagttagtggaatatttttcttttcttttttttttttgagacagcgtctcattctgtccattcaggctggagtgcagtggcacaatcctggctcactgcaaccttcgcctcctgggctcaagcgatcctcctgcctcagccccccaagtagctgggagtacaggtgggagccaccatgcctggctaatttttgtattttttgtagagatgggtttcactacattgcccaggctggtctcgaactcctgagctcaagcgatccacctgctttggcctaccaaaatgttaggattacaggcataagccactgcacccagacaatatttttcttttatatcttctgttaattcattgcatactagcgaaacttactaattttataatttgtcagatgtaatcagccatcataatatggtccctttagtttctttttccttttggcttatctatctaaacatctatcagtgtaatcatatctgtaattaatgatcattttatctcctcttttccaatagttttattgcttctttatttgcttattatcttttgcatatttctactctagctttttccagtgatgcatttttttttttcatttatgctgtgtccttcacaggactgtgaatccttggagtggaagcaatgtattctacttatatttgtgacctagtaattaacatagtgcctgaaatagagtagatactcaaatgttgacagaatgcctgattgaataatttttcacttccacttaaaaattgtttggggcaattcctgtgaatgttagttcaatgaacagcaaataacaagatagggaagcagacctctgttgagtggcacagatctagggtctgggggaaacctgggtactcaagggactcatggggaaagaggcctaatagatagcttggcttcccgtgggatgcctaactgatgtattactcaagttaagaaagaggtacccattgggtctttgaaattgaaaatattttattatttttaattgttttcagggtacatgtgaaaactcatataatttgtaaagttcacatcagtataattgaggtacccatcaccttaaatgtttgtctttatgttataaatgtttgaattattctcttctagctattttgaaatgtacaatagattattgtaaactagagtcaccctactgatctacagaacactaggtcttatttcttctatgaaactatgtatttgtacccattattcaacctctccatccttccttctccactgatcttttcagccttcagtaaccaccaatcaattctctgtcttcttagatccacttttttagcttccacatatgagtgagaacatgcagtatttttatttctgtgcttggcgtatttcacttaatataatgaagagatggctgcattctcatgtttattgcagcactattcataatagctgaaatatggaatcaacctaagtgcccatgaaggggtgagtgaaaaaagaaaatgtggtatatatacaatggaatattattcggccataaaaaagaatgaaatcctgtcatttgcagcaacatggatggaactgaaagttattatgttaagtgaaacaggccaagcacaggttttccattttttaaaatgtaagactatatttaattccaactggcccataaagcaataacttcttttattattggtactgagacatatatagatagccagctattaactggttatgaaactgggattcagtaagattatgtcaaaatcaagtctgcttcaatcaatatcccaggagaatattaaacttataatttgattaatatagaattatttcataataaataagtggagtatgaaacaattcatgatgaatttgctatccagctgaaattaacatgccactagttgcagaaataataaaaatagcaatataaatagataatgtttattaagaatttaatgaacatgttaggtgactaacgtgatgaatgctttgcagagattatctcatcttcatgcagcgtttaagacaggtatgattggggttgcattttacagagagaaatatatatatatattttgaaagcttgttaaatagcttgcctaagttcacacttatatgtggtggagctgagttgctaaggaaagccattattttaaccctgacttttatttcacatagaaagctttaaaataaacatgagtgccagagccttactctcaaattattatttaatttatttggggtgtgactcagtgatactggtatttttttaaaaagctgcctagtgagttcaatgtgcactttgagttaagaccagtgaactattaaagcacactgctgagagcttagctttgccttccaattgtatcttgtcaatacaaaaaaaggttatgttttttttgcttggaagaataattttaagatttattttacctcttctatcctgcacacattgtccttatttatgtatctcacatttacctcactgatcctgcctacccatgtattggccattgtctcctgaaatatttcagcacataggctgggtgatataagaaatctaatgtttacctctgcaagtgaatctatgcttagattggattgtttttactagggttttgccgctctcgatgtaaatctttttttaaatagttgttcagttatcattatattttactattttattagctctactaagtaggcagcaggacctagttgattaggtcgtattaaatacctctttctatgattattggtttaacaatgcttataaaaattgctgtgtttatggtttcagatattttcatgaagttcaaacaactatataagactggatttggatccatcttgctatattttctaacatagtaatttacccttcccctatttccaacccaagcatcatcattaaaataaaataccagcaaaacaatagaaaaataggcaatcagcataaatatgcaattcagaaaaaatgaagtaaagcaaataaataacaaatataaaaatgtttaacttaattatatatgaattggcaataattttttccataggctttttattttacagatataaaatagtatatatgttcattatttatattgacctaggtgttacttcttttagaatgtaagctccataagggagagaattttgtctattttgtttagtgatatattaaaagaactgaaactggtgcctgtcataaaattgacactcaataataaatattattcaaaggaaataactattgaaagaatggatttttttaagtgcatgtgtgtatgcacgtgtgtgtatacgccattaacaaagatatggtaaattgcacacagtactacatgactggcagcagtataattggtacagcttttctaaaaagcagtctgtgaaaaggtatcatgtttttctcaaatatttattctatttgaattatttacacttctagtactatgctttaaggaaatacttagtgaagtgcagatttatagaccaaaaactctgttcataacattgataaccataagagagacaaaaatcactgaataagtaaaatgtggcattcatcattccttcaaaacagactaaatgatgtgaaaatgcagcaatgataaatgaaaaacgagagaagacaatagagcgtgcttccaattttgtaaaaattgagagagaaagatggaaaaaaattaagtaattaaaccacagtgttaatagtatttatatctgggtggtgagactaagcgagcttttaagtttttgcagaattatgaaatgcagaaaatttctatacgaatatgtactactttgttaattagaaatatattatttcacgccagaggcggtgctcacgtctgtaatcccaccactttgggaggccaaggcgggaggatcacctgaggtagggagtttgagaccagcctggccaatatggtgaaaaccgtctactaaaaatacaaaaaattacccgggcgtggtggcacgcgcctgtagtcccagctacgcaggaggctgaggcacgggaatcgcctgaatccggaaggcggaggttgcagtgagccaagatcccgccactgcaatccatcctgggcaacaaagcgagactccatctcaaaaacgaaaaaaaaaaaaaaaagatttttcatgcctaaaataatgtttgagataaataatttttgaataagtaaatgggtgcaaaaattcatgatatgagccttctctcagagcaattttaaagaattagctgtaaggggattcataacttctttttttgagtacagttaagcaattactctatccttcattatgtgttgagtgcttatttgtagcatgtcttttttccactgaggaaggactactttctcatggactgaaaatgctctttgatctgtagctatggtttgcttggtggagcgggcggtgaccaagaaatgacagatgtggattctaatatgtgtgatttgacaggattaatagaaatggtttactttcagtaagtgtttttaaattagtactgtgtccttagatttaaaaagaaaatcataatcaatcaattagcaaatgttaactttgttacccaatgaaagtgtttttagtcggccatttataggggacaaaaggggcataagaattgtagactttcgactgctgacactacggttgggcctggaaagcttatttaaaaaaagacaattaaccaataatatatgacaatgctatattgtgcttcattggaattcaaatagggagtattttcaagtaatttttaacatgtaacatgaggcttagaattgaaattggttatataaattgatatttgccttatttaaaattttatctttttaaatattttctcaaaactaaaattggaaatgaaggacttcatgtaaattctgggcaaatataatgtttatgttgtaatttaatattaaatcagagtatcaacctgtgcagtgattttgatatttaacacagagctcttgtttaatttttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatattcatacacatttattttaaatcttataaaatggagagtatttttattcaaaattcaaaaaatctgtagaaaatatgcatatataaaccttataattccatggtacatttacatttcattaagtggccagcttttgttgataatcatggatacatcattttaattatggtttagtttatataagtaacattattttcttgcatttggtcatagagtcccaaatttatgtaattgttcttcaagaaatctaagacttatacaaaaatatatggcatttgttttgtaattgctcctattatacttaaggaggactaatgactcagaagagacattaaccactctttaacacatatattttacctatagtgagtatttttttttcatttgcaaagcttcctctgctcttgatgaccatatggcatgtgcaatctacttcctaaaccccatttgtttgattatttcctcatagcaagaatattgtctatggtatatgtcgtgagaacatagcacatatgaatacttctgtcataaccaaaagcagtaggtgaatgaattgaaaaggtctgttagtaaagggaaccataaaaatgatacatttataccttagtgttctatttcaatgtaaaacaagtgcctgtacattcatatgctagtcttttgatgtaaggtcgtgactttttcttatatgtctatcgtttggaattctacacaatatttcttacctaagccatgccaataatgcatcttctacaatttcaatttgtcatttcttttatctaaaataagaacttcagacaacttcagatgatctccccacctttttgtaacattaattttcattgacagtaattctgtttatccttctcatatttcatcaccataactaatgtttatactacaataacaaacacaactggcttataaacaggtttaggaccaaactcttgggactctttacaatcatgaaccttggctgatgggagtggccaatgctggtctacttgtgtgattagagagctctgagcagttggggttcagtgagtgcagcttgtgtgttttgtggagataatggaacgtgttagtcaatacagcaattaagtggaggttaagggaaaagcttctattaaatgaaaatgtggagaagaaacagagggaaacatttagctctcagtcaaaggcaaaatatggatttcagcttaatttatttccagcctttggaaagacagctgtcctgattactactactgcaactcaaggaataatggttttgtaacaatcttcactagttagcctattaggagggaaggctgtcacattattagtttattagtagaaaaataaatcggtaaaggaaaaataatcactagtctcttagagtaacataccgcagtggaagattaagttgtgactttgggacaacttacttacatgggacactttttgcctgtctacttcatttccaattggtctcattttctgcttccttatactactatttctttttttgctgtgtgtgtttgtcagtctcccaaacacatggcaaaagtagtagtttattctgcgacttctttctctgtactctcattctatactaccagtccttaactagacataatataaaactcaatttaaaattgttagtgtttctcaaatagtttcataatctgtgttcttaattttaaaaccagtggccgggtgtggtggctcacgcctgtaatcccagcactttgggaggctgaggtgggcagatcactaggtcagattgagaccatcctggctaacacagtgaaaccctctctctactaaaaatacaaaaaattagctgggtgtggtggtgggcgcctgtagtcccagctactcgggaggctgaggcaggagaatggcatgaacccgggaggtggagcttgcagtgagccaagatcgtgccactgccctccagcctaggcgacagagcgagactctgtctcaaaaaacaaaaaaaaacaaccaaaagaaaacagataccaccccctctacagacatacacatacagaatcttagtaagtctacaatacagtgtttattgacccaattatatacttttttaaggaaaaaagaaagttgttttttttttttttgtgcttggggactatgtatttttaaaatttatttttgtttttcatttgccatcagtggaaggaaagttcttcagctatggtgtgtaggtttcttaacttcaaaaatatagcagtaaaagtaatgacaatgataatggaaataatatcaataacaatgctttgctaagcctctataagtgccaggattcagctgctgtatacacacactatgtctgacctttgtatttctataaggcagttattatttttctctctctctctcgtttctccttctctgtcacatacatatacgagactcagacaccttgcgaatcacaaagaaagaatttgtgtcagatctggttaacccaaaggcaaactacaaaatagtgaataagccatgcattattttaaataaacaaaatgaaaaaaatctctgcttttatagttgggcatacaattttgccagtaatacacaactatatgacctatgatttgggcaaaatgcatgacaagcacgacctaggataattgctataaacttaaatattaaaataagtagttagattgtgtttaagtgcagaataattatgtttttttcccctctggagaaacagatttatcaaaatgtgtttttataatgtttttctaacaaggtcataataaaataaatgcatattaaaatccaggtaatttaaaaatcattgatgtattactagtttgcattttcatagagtatggtttcataggccaaagaaccagacagattttaaattaaattagtttagagagtttttgagctctgatttaggtagatgtctttcttctactcttacacgatgcttcccatcagcctagaacatgtctttcagtgactgccactagttgtttgtttgtttgtttgttttgttttttgagatggagtctcgctctcttgcccagactggagcgcagtggtgtgatctcggctcactgcagactccgattcccaggttcaagggattctcctgcctcagcctcctgagtagctgggaccacaggtgcctgccaccacacttggctaatttttgtatttttagaagagacagggtttcaccattgtggccaagttgtttaaaaatttttttttcttatccggagaactccccatcaaacctatgctgtttcctcatatcctgctcattgtctctaaggaggctgacaaaagtgcggactgaattaatagcctccacttgtccttgccattctcctctgccatcgggttctcttcctttcctctcctgaaactgctcttgccggtcattagccactccccgtgtccaccaccagtcatcactcactcattctcattttcttcacctctgaccactcctgcttttcctctcctgactcctattatttgcatgattctagttttcctgctgactcccaggctcatatccttctcagcatcttcagtgagctgctcctctctggccagatttctggttgataggttggccctagactcaactttatagcttcatcttttcactctcatttgcaggtggcctcttccattctctggctttaaatactttccatatggtggtgtctccaccatgatgtctctcctgagcttgaatatctaataggtttctccaaattttcatctgtccaaaaaataactttggttttcccccaaaagacctaatcttctccttatctccctcatttttgcaaacgtaccaaatctgtgtgaacttactcaagctaaaagcctaggagtcattttaattcctcattccctcaccctgcaattcccaccattaaatctaccagaaagtctgataggtctttcctccagaatatattaattttttccccacttctttctacctgtattactgtggtcatttctcatactcttgcaaaagcctcctaatttaccctgtcttaccccacaataattcactggtgtcacaatagccaaacatattttgaaaatgtaaatcagatcatcagatttcctgctttaaatacaatgatgtcttccccttgttgaaaaaataaaacccaaacttactactgtgtggcctttgcaagatgagactcttgcctacctccttggctgcatgctctcccactctcccttgccctatctcctcaatgacaccagtcttctcactattctgcaaacatgccacacttattcctactccaaggtctttccactaccttctccacagactcccagtattacttctccagtttttacatgtctagctcattctaacctctcttagctcaaatgttacctcctcagagaggcagtgcctgaaaaatgtagctaatatttttattcctcactcccttagtcactttcagtcctttcattctactttatttcattcatggttctcagtaggcatgcagtgttttcctagtttatgtgtggcagagatgggtagatgctcaccaatccagtttcctcttctctgagcccattgggagattatatcttcagtttggaattgaacttgggaatttggccatgtgcctaaaaatgaccaaaggcagtgcatatcacttccagacctaacccctaagacttccagtgggattcactgttgactttgaaagttctaagccatgtgatagaagaagcacggttccctgaaacatttgttggttgtagagttctccaaactttatcaagctttaatcttccagactaatgagctatctctttgtgaaattagatgttaggccacatatgataaatgaattttaaaaataaaaatattgaagagattttcacattcactcattcacacaaaaaaatgttattgaacacgtgtcaggcactactctgggcagttaactaactagacagaaatctgttctgagggagattacattgattgaaggaagaggtaataagccaatagtgaacacatgctgtatttgatggccataaatgctgtagaaaaacataaagtgagacagagggaaactgagtgtaggatgaattcagttttaaagagagtgaccgggacttttcttgagaaagtgatatgtaagggaaacctgaagcaggtgatgaagtgagacatgtggagcactaggaagaaaattagagtcagagagaacagcaaatgcaaagcccttgaggtgggagcatatccaaaatattgtgggaacagcaaggggtccggcatggacagaataagtgaccctggagaataggagggggaatataaagttatgtacttggggatcaaagagcctgtgacttagggccttataaatcatggtaaagaggactttgaattttaatctgagaatgtcaggaaggtattagaggattttgaacagaagaattacacagttttacatacataaaaacaaggtgtctgtaactgctgtgaggaaattatactgttataggggtcaagaatagaagctggtagactagttagcaactatttcagtaatccaagaaaagtataaggtttcctggagtaagttgacagtgatatagaggctaatgaatagtcagattttcattatttttttgataggagagtcgacaggattttctgttgggctggttgtggagtgaaagaaagaatttaagaatgattccaaggtttttggcctgagaacaggaagaatagagtgaccattaatttatatggggaagactgagggaggaacaggtttgaacaggtttgacatgttaaatgattgatggtaattaaacttctaagtgaacttagatatacataggacaccttggactgtgctgtgaacaaagttcataactgtgtatgctgcctagcgaacaggttcatgtcagtactattccttgtattttaattgaaacagacaccagaaataaagttactaagtagcttttactgtgaaaatatgggcattatagaaatgtaacttttggaaaacatataatttaattattatatatggatatgtataatataagctttaagtataaagcttaagtacttaattatacatatccatatatacatatccatatatataatgcttaagtacttaattatatatatccatatataaactatattaattaaattatatgttttcaagagagtatgttatattttaaaatgtgagttttgaaattaaatattttgaaaataattatagatatgtatttttccaatggatatttagaataagcttaaattatgttgtaatttttatgtttacatcccatcaaaacaaacaaacaatatattagagccaagtctatatttaaattttgcatttctaagagaaagaacttatactccatttagcttcaagaaaattccccttaggaaggtgataattacatacaattgaaacacttgtgatcattacttataagtattttacagaataatttaaaatattttctataatataaagatacagtctgctagttttacagtttattatcaaagtactaaggtattcagctatcttctattaaataataatatttatgccattaaattttaagaagaaaggtgtacaatatgcagcaaatataaacattcattttaatgagctatttatctttttggggtgtgttctatgaataaatacattatctaattagtagattcaattttcgatttatttcagattgtctttagagccattgcatgtgtttgtcttcaactttaaagtaagtttgtttagacattgggttttaaaacctgagcaactatcatcttccagaaggtgttctaccttgtttttttttttttttatggtcaactcacagccaaaattatggaaaggctttatcgttggtcacagatgatgcacagagcattttcaattccagtgtttcatagactcggtgatagaccgacagttgccctcctgggactgtaaacatttttcattctcttttaattatctagatctatattaataaccacagtgacctataagaaggcattgttggccatactataattatatatagcaattatgtgtagtgccaacaatacataaaaatcccaccctttaactacggttggtaagaaatgaaactatgcttttctgccttaggatatagtttcagtttttgaaaaattaagacattccatttttacataaaactttttctggagtatattattatggtaaggcaggtctatttccatggactgacaatacattaagaatattccaataaatatagaaagcatctctcactccagcttcctccttagctacatactggtatttcctattacatactgtataacagaaagggaaatgcaagttcaaagcaaaggttaatctttgtaatgcagaatgtcagagaagatggtttagaacaagtaccaatatatctcttgttctctttgaaaatttatttagtatttcaaactatattatattcacacatgtattcattattctgtttaaataattaaaggtggcaagacatggtgaagtatgagcaatcagtagttttgatttaggtgaagcacccatcaagtaatggcagtagtaattgccatttgccaatgtcttggcaagttgaggtgaaaccaatgtctttagtccgtgttaaagtcaatgcatgtggaatggtatcccataattgacttacttattttttttatgatgaatgggttgtaaacatcagtgcctgtgtcatagatctaaatcttaaaccaattttggcaatttcttatagggccatgactagagaatgatattgtcatattggtttatatcattaaatttttcatattaaaagtgcttttatagtctaatagaaagtaataaaacttttattagatttatacaccaaacatataaaacaatattgatgctctgatttcaatttttaaactcctgacattatcccaagctgcaatgactgttaattcagagtacctcatgaaataggacatttcaacttgcatgtcttgtgagcacctcaaatttagcaggtctcaataccagctctcctttttcatcattttcctcatcttcatgctcaccaactttctcccattttatttaatgttattatcatccatatggtcatctaagatgacctgtgagtctttttaacatcctctttaccacttatttgtcacatgcaatccatcacttaagcctgtgtattttatgtccaaaatgagttgttcagtcattcacgtctgtcaaagaccatcatctgtcacttaggcttccccagcagtttcccatggtctgcctccagtcactcctccaacttgaatttatccttcctactgccatcatagtagtctttctaaaatagagatccaatatcttatttgtgctttaaaatctttatttttcaagcccttaagacacatttggctcttccctatgtagctctaaccaatttttttttctagttctattgtgtcctttgcttctgcaccccttatgctctatattcaatgaaatcccttcatgtgttcatgcattggctcatgttcctttgaccattatgtctgttacctcctttttccacttgcaaatattcaagcaacctaaagtatgtttctatactatactagagctcctttctgttctcttgatactaggtacataacatagaaaatgcataatacaggggtgcatagaacagatcctatggattctaatgatttatttttgtgtctgtgtctcccaacaccacagtaaggactcttgagagcacagatcatatcttgtcactatgaatagtccctgacagataggaagtgacttaatatgtgttgaaagaatgaatgcatgacttaagttattatgagtgcctatagttctatagccaggtttttcaacatactgtgtattatctacttataacctggctatcaccagctgtcaccctctcttttaaaatttatttagcttgaatgtcaagaaatttatatgaatgcctgtggtataattttcctactcattatcataaccataactggcattctctgtgcatatagggtagctataaacactactctcgtaataattagagttacttctgtcatatgctcatgaccaaattctcttgcccttttcagaaagcacaaaagaggatccctttttttcagcctgccttattctctcagaattctaggtttcttactcttgcttgtctgttttctcaacagtcatcccccaattctcatacggactttcttgtccctgtttccagacactggtttctttagtattcctaagactttcactggattcttgaatcttctgctttttcctcatctatttggccttctcgattctaaattttgacagccagttaacctttaaacttgagcttgctaaactgacacctgggttttcactccataatctcccagttctattctttaactgtccaatcagattcttttggcacctgtatttcatatcattctccatttggggaatgaggatacacctgacaaacccacagaatgctttcatggggaaactcagtaacaaatataaatttagagtatattgtgtattctggattgaatccatgggcttaggacttttcaattgatgaagagtatatgaaaggaaaactaggcatttcaggtacatttgatatatgaatgtcacagatatggagtaaaatgtagtcaaaatctcctccctttttcaataagaccaccaataggaggaagataattgatttggtcaaggccaagaatataattgggtcatatcgctaaaacttgcaactttatgtgagaggagaaaagtggtcttgaatcgagaaaaacccagttatttccccttggttttcttcacgcattcaatggttgtatactcaattcctaccttgtgttctaaacattaggaattaaatggtaagtgagagagagagacagagatttatttctgtgcttctttttatcattacactagtacaacctagagatccaattattgactatgggcctagaagaaaaggacagagaacgaccaatgttattttaggccttagagtggggtggtaggtaataggttgaaggagtccagctgtcatatttgagagcggagataaactagtttgcatttacccagagttctttttgcatattttcttcagaaggaattaaaaggtgcccgagcaaggacttgggcctcctagtgtccaaacagctctagcccctaatcacggcaaagcaatatcaggaaagggataagaaagttgaaactgtgtaggtcatgagtaatgagataatatgttttatggtatacaaacacatgggtaattcttggtgagggtagagaccgttcccagaggggaaaaagtacctgtatatttctaatctcctatccaagtactcaccaggtctaaccctggttagcttccaagttttgacaagttagggcatgttgagtgtggaatggccatggactgcacattcctgatctcaatagggaattctagactaaatcttttaaggtaacttgtttctgcaataattcttgcagatgccattgacaagttttataactttcattttgttatgttaaattgggctaataacaacttctcaagaagcctaacaaattgttgatattaggtatcattttccttgctttagtaataatattgaacatttattaagctgataatattaactgcctgagaaattgtgatctaggaatagaaagaatttacctgcatttgttttacatttatgcttaaggaaactgaaataacagcacttggtgaaaaaaatatacgtctatgtccaaattttctagcttttcttcctaatattttcttatgcaaaacactatcagggaactgacatgataatgccagaaattctcttcagaggaagctgaattagtatgtcttaagacctgctctgtgtatttaaacagaatgattgggaaataactaccgtaatttcttagtgataattttgagactttttctccttttgtgcaaaatgttgtagtacatttaagtctagttgtttattacatgacaatagagtatacttttcctttttgtgcttggcagagaatgtacatttatttgtgatgtttatgtagatattaaaaatagatattggacttactatatactaaagcttagttgttctagaaaagtaattttatcgattttaatctttactgctagtcatattgctatttacttatttttctttttaaaaaacaagccaacaaaaaattcctgaaaattgttaattaacagatttagatactgaattagcccaatcaaatgatgtcttaggctattaaccaaagtggtttaagaattacatacatttatttttatttagctatttccaaagtgattttttaatttaaatagtggcttttattctggaataggacatagtaagtaaaacctttaaaaaaaattcaaacgttgtatctttgttgttgttgctgttcttttttgagacagaatctcatcctgtcactcaggctggagagcagtggcatgaagagggctcagtgcagcctggacccccagggatcaagcagtcctcctgtctcagcctcccccgtagctgagaccactggcatgcaccagctatttaaaaaattttttttttctgtagagatggggtcttgccatgtttcccaggctgatcttaaattcctgggctcaagcgattcttctgcctcagcctcccaaattgctaggattacaggcatgagccactgcacctgtctcaaaatttcctttttatacaaggaaccacatttataaataaaaatattttattttttatttgttcaccctactataaagtcatttagatgaaagtagaaactttgaaataataggctaaataaaaatgtgatttatgaattagtttatgaatttctattaagagatcagcaaacagttatgcttaaatcttggatgatgttaccacaatgatgatcacaatgaacattttttgaaaagttgaaccaatcacgttaaaggcttttcacataatttctcatttaatcctatgaacagttctttaatatggtactattattcatccattttacagaggagtatatagcagttgcccactttcccatctgaatatctgaatctcctactggctatcaacttctttgggaaagaactggctcttctttacatattctagcatagtagagcttatgacaacatagttggcacttaaaacacagtgacttgatgaatgaatgagttcctagaaaacagtgagtctgaattttctagtcaagtcatatgtacaacagaagggtcaaatataggtgagttttaaagactcttcttaataagtatgagttagccagtttctcaaccttagacatttacccttgattcccatctatatatcatgaaaatttaatagtaccgattactatgtatctgtttatgtatcttggacttttggaagtccacaaaacattctaatatctaatattgtttcacctcccccatgaatcaattttttgcctctgttggggcagctttgctctgattgagaatatatgagttaagcaatgggtgaagacattgaaatgttgatttcctcagaaaggagggatgtagggttttgctctttgcctaccttctttatgtgcctcaccatcttgttttcacagtgcttccttttagatatctttatgacattgccataaaaggtcatgttggcatattaccttaaaatactgaaaaggtaccattttagaagaacatttgatgatgaagtgaagcaacagccccattgctcctcaccacccctcatgcccttcaggtctgatttaacctgtaatgtgacttcaatattttaaggtgagatcaaccttttctttttggagaggtattcataaaaaggctaatgacccacttgtgctcataaggaatgacacagggaaacctgggggacaaagctaccaacttttcttctttggaggaaattttcccttagcttagcactatccttaaaaataaatcattaaacaagaacaattttgtgacaaggaataaagggaaattggtaaatgaaagtgaaatggtaaaatacagaggtttaagagtttaaaattaaataaattaaaatgtggaaatgtaaccggacccaggttcagctcctcaccacttgaaagccaaacacagaaggtgagggttagtgggaggaaaagcaggttttaattggaaagccagcaaactgagaacatagtgaactagtactctaaaataccatcttaaattttacagtttaccataggattttttaaggggaactttgtatggcagacatgtgggagtggtgcagggtgcagggtctgcgtgtcttgttctcgtggctatcttgtgagttattgctggtctggaagtctgattggcattatcttcactctccccaatagtggtggaatgattgtttgtgactcttgctaagcggaaggactatgcaggggctccatgcctggtttgtagcaagattagattttggaatttcttaagcaagaacataattagattagcatgcattgccagagggcagtgtgtagagagggaaggaatgaagaagtgaaagtggagggaaggaagaaaaagaaagagggtgatatttaaaacctgggtccctggttatggtaataaaacaaaacatctttaaattttaatcagggacacactttaagaaataaagattaaaggtattaaaataaaagaaattgagaggttaaaaacctgaaagtagaaggcagcaaataaaaaagttgaacttgagggcaaaaaaattatttttagtttaaaaataaagacaactagggatttctttatatgcctagtaaacaaaaatatattagaagataaagaaggcttgttggaaatagggagactaaagataaaagaagtaaggatccacttgaagtttgaaaagggggcaatttaaaacaactagcaagaattaaagcaattggaaaccataaaataatggcaagctgctaggctataaaactgtatgttctatgaagatgtaagaaagaaaatatggtggaaaatggggaaaaaaggggaagtttataaaagctccaagctataatcaagtgaggttgaattctggctaaatgtccctgtggagatgtgcaaaatgcatacatttataggagcccatttactttcacctgatcttaggccctgcctgtcagtgtgccacagacttgcccagattggcaaaaaattcatgcccttcggaattttccaaggcaatgtgctctgtgtctcacagtctttccccctcagacttgctccacagcatagataaacacttattttggttcgaggaagagcatttaagtactggcattcattcaaaatatcatttgtatcagtgacattttggtatttattatcatttataacagcaactgttttgtataaatataagtagacctttctacttgacaactgtgacctttaatttcacctggactgcacatattatatataatggagatttaaagagtattatagaaatggatagggggtatcaatttcaaatgtacaatgtcaaaactactagctgcagttgaaatgaaatttatatgtggacacaatttttttttaccttttttggttttgtttttcttttttaaattatttggagataatgagtaaaattctactatattctggtagcatcactctgcaagatttactctaccatacaaatgtatgttttttggtattctattttgaaaggttgtgttgttataatattggtattgaaaatattgatgagttaatattttaaaacataagttagtatttatttggttaggatgaagcagttgatgataatgacaacttttaactgcaggtaaaattgctaaataatacataattacgtacaacttgtggcagctttgtatttagagataatgatgtttaattgggtgtttttcttttaaaatgaaaatgagtttattctttttttaatagagtaatgcatgctcccctttacttcacttttcaaataccaaaacagataaaccctattaacaatttggataaccattatccttttagaaatccctacaagccccatccctccacacccagtcaggatcatataaagactattctgaaacttgctttatgcagttaagaccttgtgactatccttctgtgttagccattccatccttgtttatatatctgattaatattaataaatcatatataataatatatcatcatttttataaataacagctctgattatattttaatatagctctttatgtacttgtctgcttcatttggatttctttgtaatttatgagatttttgtacttttcctatttgtattagatatttatggatacaatatatttctggggttaagttaccttctagaattaaactacgtctatctaagttaccttctagaattaaactaagtctattaaactaaatctatttaagtgcttaatttaaggaaataaggacaatagatgagaagatagttcttgatgcaataatatttttatttctatgtattatatagaaacatgttaattattttagctattgacttgtagtgaatttattttcttctactagagtatatgtgagggtaaacaggaatattccattaatcattgtaaaaatgtatatacattataaatttcataatgccaggatataatgtgataggtataaatgctttcacttaataaattttatcccaagtgtgtcaagttatattttttttacattaaagtaaaaagaatttctgtctgcctaatttccttctacacctttttcatttatggaccactttaactcatggtgattagaaatccttcctcatcttatctcgaaccctcatctcagctcctcgtggactgaggtttattaaatgatttcctgacggccattttgaagactatttatcacctgaaccatgctgccatcccatctgctaccaatataaattgggatgccttatgttgcgagtgactgaaaatgcaacaaaatttgatttaaagatgaaatgaaattattggattaattaattaaaaagatcagaagtaggaatagctgcaggttaagcttgatttgctgccttaaagatattaccaaatacctgatcttaactgttttctgtcttttgtatcagcattatcctcagttcttctttcatggtagcaaaatggctgaagcaattttagacatcatatgctttcacaatgctctctaggaaaagagactctctttccattatctttcaaagaaacaaaatgtaagttctctttcctgcaagcttaggcaaatgcctccctgtgttgcattgactaatcaaattaagtgctaccccagagttgaaaactgttaccagggagaatgaccactgtatcaagaaagctatcaaaacttaccctaaaggtggggataagtttgaactgataatgaaaggagagggttgggggaagattcctttaaaaaatgcctgggtattattaccagaaagaaagggaatgatgctaaataattatacattgtactgctcaagtttccatcactggtgtctctgagttttggcaccgttgttttaaagaccctgttcttgtactatttagtattgcatagtacaaataaaattaccactgatatcaggcattcagccttttatttggcaatattcatcaaatatactcagaacgttgttctatgtcctggacagaccaaacaaaagaaaacacatctcatgatagtttaagtattagattaaatgacctacataatagtaggtgatacgatttctggagcatggtatgtcctcagtagatgatagtctttcattttgcctatttagaataggcagccctccttttcagcaatgtagtgacctgagacagggccttatcaactatgaatatatctttaagacattctttacctactcacctggacctctaagtgttacttatacctattgaaactcacctttgatttctggtgctgtttgacttgagatggggctaatttgttgacaggatgattcgatctccccactgaatctctgctgccatctcttttctgtcttcttaggtgctcacctgtgtgattctagaaggcgggtctgcttcagctctgatcactctctattatcccttcattttcctctaagtaaacaatcattaatcaatagtgtatggtaagagacagcagttttatgtagagaagtagattactcatttgactggggcaagagcttcaggtaaaataaatgattgatactttaagctcactaaattgaaacaatagccatcacattgtatgctttgctgtggtgattcctcagggatctagaactagaaataccatttgacccagccatcccatcactgggtatatacccaaaggattataaatcatgctgctataaatacacatgcacacgtatgtttattgcagcactattcacaatagcaaagacttggatccaagccaaatgtccaacaatgatagactggattaagaaaatgtggcacatatacaccatggaataccatgcagccataaaaaatgatgagttcggctgggcgcggtggctcacgcctgtaatcccagcactttgggaggccgaggcgggtggatcatgaggtcaggagatcgagaccatcctgactaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtctgcagtccggcctgggcgacagagtgagactccgtctcaaaagaaaaaaaaaaatgatgagttcatgtcctttgtagggacatggatgaagctggaaaccatcattcacagcaaactgtcgcaaggacaaaaaaccgaacaccacgtgttctcactcataggtgggaattgaacaatgagaacacatggacacaggaaggggaacatcacataccggggcctgttgtggggttgggggagtggggagggatagcatttggagatatacctaatgttaaatgacgagttactgggtgcagcgcaccaacatggcacatgtatacatatgtaactaacctgcacattgtgcacatgtaccctaaaacttaaagtataattaaaaaaaaaaaagtcccacagcctttaactccttttactgactgtgttgttattttctatacaatattttcttttcttttcttttcttttttttttgagatggagtctcactctttcacccaggctggagtgcagtgatgcaatctcggctcactgcagtctccgccttccaagttcaagtgattcttctgcctcagcctcccgagtagctgggattaaaggcacctgccaccacacccagctaattttttatatttttagaagagacggggtttcaccatcttggtcaggctggtcttgaattcctgatctcgtgatccacccgcctcggcctccaaaagtgctgggatttctatacaatattttctatattttctatttccagatagagtagaccaaagtaattgatgacctcataagcatgtttcataaatgtctctgagagattcactatgtcttattaaacctttgcctgaaatcttcttgcattattagagagaattaaggtcaaaaacaaggaaggaaaagaaataagcagttttatttatctacccatccattcacccttctacactttcatccatctgtccatctaacctctatttactcatctattgatagactagaaagataaataccaaaatgtacgggatataatctcctggtatgccgttggaataaagatgttctttgaaaccaacgagaacaaagacacaacataccagaatctctgggacacattcaaagcagtgtgtagagggaaatttatagcactaaatgcccacaagagaaagcatgaaagatctaaaattgacaccctaacatcacaattaaaagaactagaaaagcaagagcgaacacattcaaaaactagcagaaggcaagaaataactaaaatcagagcagaactgaaggaaattgagacacaaaaaacccttcaaaaattaatgaatccagcagctggttttttgaaaggatcaacaaaattgatagactgctagcaagactaataaagaagaaaagagagaagaatcaaatagacgcaatacaaaatgataaaggggatatcaccaccgatcctacagaaatacaaactaccatcagagaataccataaacacctctacacaaataaactagaaaatctagaagaaatggataaattccttgagatttatcctggataaatgatttttactaggccctggaaaatttagacatccctcatatagcactttttgaaatctgaaatcctagttattttcatatcacttcaaacccttcctggagatattgggtccatccataataggacaaagtttctagtgtagtttatgggttttagtcctcaaccatagcaaaaggacatagctgcagtttggtatgattttaatataagtacttggatagattgggatacatttaataaatttagtgagataactaatcacattctttaactatttaacattttttttattattttatttttttacagatgatagtcatgtacattagtataacatgctgtcaccattggtgaggcattcaatgaactttcaattgtgaatctttaatgtccttgcaagatataaattcatattaaatttcaacgtaatatggaatatatttgactcggatatatgtaactggaaacaactttaacttggatatttgttaaagctcagggaccagcaatgtgggttttcgcgttacactgcctacactatcacttgttgactgtgcaacctttgtattgataactggacttagtacaggcataattttttaatctgacaagtgtacttgaccatgaaacatcaactttactgaactgtgagtggattaagtgagaaacatgtgtcatatagtaaatacttaatggaatatacctatgtttacctagttataattaatatgttacttgtatttctaaatatatttccaatcctggaaccaatttatagttcatcttattgaaaccaaagtttaaaacacttgctttttcattttgtgatgtttaaactgccatataagtaattctggtttataaaagcatctcagttatgataataatagcattttaattttgaaagccctttggaaaagttattttgaatattaaaatattaaaaatgctaaatggcatttgggtatatgaatatgtaagtaaaatattaatataaagttcttgacttatttttaataattatctctttcatacaacgctatcctgttggtattcagattttacacattgactgacattcagactgacttggcagaatatttttatatgacgttattagctttttatgacaactaagcaaagagagcaccagtaagtaactagattctttgagctaggatgattctcaaatcccatcacttttaaaatatcagtgaaaaaactaacatgatttgaaggctagtttaaaataaaataccatcgtttcgagatttggaaaaaatgtatagttaaataaatcacttagtgtcttcttgaactataattctgcatttttgttaggggtaattttaaataaattggttctaaaggcaaaattcaatttaagaaaataaatgttagatttttctatagcataattattatttcctttttttaaaaaaatcttatttcaccctcaagcacatcaaaaagaatagttgccacctagaaagggcctttgtgctttgtatgtgtatcatgctttgtttttctctggtatttcttatcttcatataacaatagcttttagcattgtattttaaattaaaaatgttctactatcaaacttattctagtgagatttcttgcctttcaaaattacagtattttatttcctttaagtgtctcatattcattctgttttcacccttgatagatgtaaagtcatattatagagctatataaaacagggtggccaatctactaaaaataaaatacaaaagcatattttttttcaaaatctcattttttagtaaaacatttgcactcacaatactttagttttgagctttgttttctttatgaagtccagaaaaacattatagatgtctaatttttctcctctggagaaaaataaaataaaatatattacaccccttttatagagaagcacagattatattttagcttaattagctaaaatcacaacagtcatggttatcaatgaataacagtcatacttacagtatgttattgcaatggtgaaacaaattttcagtggcactgaaaaggcaataagaggtagaattcagttaaaattcaatgatgagggaaagaagcatataaaggggaaagaagataaacaaactagacttttgaacaaggtggagtatacatttactgatttttctgtagtatgataaagttagagagacagacaaaatggacttgaaacaaggtatacatcagttgtcatatcgtattgcaagaaaaaattattttttgcactcaagctacagagccctaaacctatcaggccatgtaagggaagtgcttcctgtattaattactaaagaccatgtgagggaactgcttcctatataattactggaaaaaatgatgaaagattgagaactattgattcacatcacatagcataaactttgtgtgaactggcactttaatttatagccctaaaaattcggctaggagactggagctgtcactggacctttgtacaagagaagggtgtggctgctaaaccaagagattaagagcccagcactgtgcaggtcagattgactccatctggcccctagcagtttcaccaaacactgccaggattttccaaaataagtatcccccatcacatatcattactttctgctgaacagattataaagtactatctccaggcatttcctgcgtttattgggaactggaagttttgaatcctcattgacttgaaagagactgccaacaatcaaacctagtcattatggcactcccaccaagactggaaatagccccaaactgctgctggtaattcctgatatcctcagctttcttatcttccatacatattaattttgtcagcagggtagttctttagggccctcagagtgcttctggaacctgtggagattcattaatggagtctggttgtaatgcattcagctaactccttttaaagctatacctgatgtcatgctgtctgttctatgatcctcttttccactgtcacgtgtgtatgtatgttttgttttgtctgtttcttgttttatcacctaattgcttgtctttttatccttgacttgctgttttgtaaagaacttagcatttatatcttctatgcttctctatgccctatattttcaaaggctcattccaaacctaacgtggtcatacactgtggctgaaccatattctaccttcaatgaatgcaccactttgaggatggggacctacaatttttgaagtctcttctgtatctgtgcttccaatattccatttctatgcatgttctcaggcaatttggggttcacacagttataaaataagtttatttctcattcaaacctgggcaatggagatgttcctatttcgatagcttttctgagcatcttttttttttgcaagtggtgacccatggaatctcagggatttaggatctttctaattttgtaatactggtgtcttcgacacatgaccttcaagattttgagaagggtgaaaacagaatgggatgggagttttatggccagccctgggagtgttatacattttcagagctagatgcaaggaagactggacaatgtgtgctaaagttaaagcacatagcggaatctctgtcacatcgtctttctgctttatacttaagctggtccccttcatatttatgaggtggctgcttgctgtataattttatacttaagctggtccccttcatatttatgagttggctgcttcctgtgtaattactaacaggccatttgcagcagcaaatgttatatccagtgggagagaggaagaaaacttctctctcaatcatagattgcaaatcttttcttatagctttggtcagaaagtatggaggaggattgagcaaccagacaaaattaggattttgtaaggagaggaaggagcggtaaatagataccagacagttaatctatcgtgagtatgacaaagaatcaagacagaatggtatcacagaacaaagagagtagagagttttgaaaagatggagtgcccaaacaggattataatgatgctaattttagaaattagatggtccttggaagctccgtataaatagtcccaaagaagtcatgagattatttctcacattatggtttatggagaagtgcatgaaagctgaggaaatgggcccttggtatttattcataatgctgtgctccatgcagttgactttacttcctaaataaatgttgcattcttgatgaaagtttaggctaaatacagtgagccctcaactttgaagataatataagaatattatcataattagagtttacatcatttaaaaatataatttgcttcattaaaaattactattagaaatttataattttgtcggcatatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtatatttttaacttttaaaattctcagaaatctaaagtaaattataattttaacactgaaattatttgctagtgaagatacaaatctatgctaattgctctaataacctagataattaattattatgcattcctaaaatggaatcctattaagttattttactatgatggatgtaatcattttgataataagtaacctacacatttttctagattaatcacagatgctcttctaaagttgtcttaatgtgatgaattataattgttcacttataagcatcaagggtttttaaactctcttgataaccatattcaaattttatcacctagaggtagatttatatttttattcaaaataacatgtcaggtgttatgcgtcttattttctgcaaaatagctaacttgtatgtaattctgaaataaactaaataaatattcaaactattagataagtagtacgtatgtatatatatatataaacccattctatctgaatcaatttaaaggttacttaaattaggtctttcttggactcagtagcccctactgatatcttcaaactgcactttatcctccaaagtcactcaattctttcaaaacaagaaagcccattatttaacagcctcacattgttagatgcgaggaagtcacattgatgacttccttttacctaaggataaaaaccaaagtcctctatacttcatcctctacctccctagctagtctattgccctgttgctctcaactggagtatttcctaagccatatttgtacacctgctgtgtccctgatgcgagcataaagtatgtgagtaaaaaatgtttttgaaatattatctgctttttaaaatgatgtaattcctttttttccatttcctttatcccatttgaaacagtttggttctatacttatgcctgggggaaaaatatgacagaaaaaggagatgggggagtttaaaaatatctttcttaccttggcgctttaaagtgcttaggagcagaaaaggctcactgcatagctacagcacatcagaacaaatataatgagttaagactcatccaccccttttccctttaccttcagataattttatgggagccaggaatgcaagagatctgttcttcatttcctgacaagaccccagaaaagaaattgttgcattgtgtgtctagacagataccatcacagagtttcagccctccggtgtgaagtaggaattgctcaatgattcctgtactcccaagaatgaaaatgaagtggcagaaagagagctattgaaacaaaataggccatagggagaggagggaaccagaagtttccactgagacttgtgtgatatattgataaattatttaagtgatgcctataaagccggatgatatttaggcttttatggtgttacccccagtgttggcataaaatgggaaaccctaagaaattatgctcaaaggaaaaattcagctaatgcagagaaagattaagaacctacatttcttgcattcttgaaattacactctagaattcacatcagctgtggaaatttatacttacttctttgtgtgtatttaagtaatggcataataaaaataatcaattcaccactgaggtccaatcatttcttcccttcaataagtgcccatacgttactaacatctgataacaaaatgaagcccaagttcttttgtaacattttatctttttcttaaaaaaatgaacttatcttagtgcttctttatttttaaagagaataatctacatttcttacttcctctggaaggtctgactccagagaaaggttaaaggttgcgctatatacccctaagtcttttcttatttttattttctccttcattccagaatatctatttagctattgatatgtgccaggcactattttaggtggtagaattccagaagtaaagacagtctctgtcctcaaagaactcaaaatctaactgtatggcatacttagaaaaataatgcaataaccacataagggggcctcctaaagcaaactgtgatgtggaaatgaatgtcaaaaaatctccctatcataggtagcctttgagtatagcattgagaaatgtgtatatttgatgagaaatacttttttggaaaaataattatgttgtttttcattaaatggaaaaaatagaaaaaagtttcaagatgataattgattttcatattaatgaatttatttaattcactgtgatctaccatcaccgtttgcattaaaacatttctgaggaagtcctagccaatgcaatcaagtaagagaaaaaaaatgaaaggcattgaaataggaaaataagtcaaactgtctcttcactgatgatatgattctatatctagaaaattctagagtctcttctaaatggctgataaaactgataagtaattttaggaagatttcaggacccaaaatcatacaaaaattggtagtatttctatataccagtaatgcccacgctgagagtcaaatcaagagcatgataacatttacaacagcggcaaagaaaacaaaatacttaggaatacagctaaccaaagaggtgaaagatctctaccaggagaattgcaaaacactgctgaaataaattagagatgacacaaataaagagaaaatcattccatgttcatggcttggaagaatcagcattgttaaaatgaccatactgcccaaagcaatttacagattcagcactactcttatcaaactaccaatgtcatttttcacagaagtagaaaaagctatcctaaaattcatatggaaccaaagaagagcctgaatattcaaagcaatcctgagcaaaaggagcaaagctgaacacttcatactacccaatttcaaactatattataaggctacaggaaccaaaacatcattgcacttgtataaaaacagacacatagaccagtggaacagaatagaatagaaaactcagaaataaagccacacacatctgatctttggcaaggatgacaaaaacaaatggagaaagggctccctgttcaataaatagtgctgggacaatcggcccgttatatggagaataatgaaactggacccttaccttttaccatatacaaaaattaactcaagatggattaaagatttaaatgtaagacctaaaactatgaaaattctagaagaaaaccctaggaagttcccttcttgagatgggccttggcaaagatttttggactaaggcaccaaaaggaacttcaacaaaaacaaaaattgacaagtaggacctaattaaatagaagagtttctgtacaacaaaagaaattatcaataaactagatagacaccctacagaatgggagcaaatattcacaaactatgcatctggcaaaggcctagtatctagaatctgtaagaaacttaacaagcaaaaaacaaataaccccactgataaatgggcaaaggacctgaatagacacttttcaaaacaacacatacaagtggccaacagacatatgaaaacatgctcatcatctgccatcatcagagaattgcagatcaaaaccatgatgcaaaaccatcgtacaccaggcagaatggctattattatttgaggcatgttctcactctgttacccatgctggagtgcaggtagcatgatcatcgcttactgcaaccgcaaagtcctgggctcaagggatcctcttgcctcagcctcctacaggaagctgggactacatgctgaggcaggtttttttttcctgtagagacaaggttttgctttgttgcctaatctggccctgaacttctgggctaaagcattcctcccacctcaacctcctgaagtgctgggattacaggcatgagctaccatggctggcctgattggctattattaaaaagtcaaaaaacaacagatgctggtgaggctatggagaaaagggagcatgtacagtggtggtgggaatgtaaattagttcagccactgtggaaaacagtttggagatttctgaaagaacttaaaacgagctatcatttaacccaacaatcctgttactaggtatatactcaaaggaaaaccaaaaagacacatgcatttgcatgttaattgctgcactattcacaatagcaaagacatagaatagacataggtggctatccatggtggactggataaagcaaatattatacatatacactgtggaatactatgcagccataaaaagaacgaaatcatgtcctttgtggcaacatggttggagctggaggctataatcctaagcaaattaatgcaggaatttaaaagcaaatagcacatgttcttacttataaatgagaactaaacattgagcacacatagacgtaaacttgggaataacagacactgtggactaccggtggggggttaggtcaaaaaactgcctattgcatactatgctcactacccgagtgcaatatacccaagtaacaaacttgtacttgtgccctctgtatctaaaaaaaggtagctataaaaccaaaaaatcatttctgaaatgctgaatagaaaccttaaaattttctactgattcatacccttacttttaaaaaagttagctttaacattttatccttcacctgttgatatgatttggcttggtgtccccacccaaatctcatcttgaattgtactcccataattcctatgtgttgtgggagggatgcagtgggagataattgaatcatgggggcaggtctttcctttgctgttctcatgataatgaataagtctcatgagatctaatggttttataaggaggagttttcctgcaaaagctctttgcctgccgccatccacataagatgtgacttgcttcttcttgccttctgccatgattgtgagtcttccccagccatatggaactgtaagtcaaattaaagctctgtcttttgtaaattgccagtctcaggtatgtctttatcagtagcatgaaaatgaactaatatgcctttgattaaaattatgcctaagaatgttaacatttactcctagaaacaaactctcttcagcaatatatagtgcctttgtatgtaattcttctgtagcaatcatacaaaaaaaaaatgaaagcacacatgttttcatagtatactctttgttttgagttgaattgtgtctcccaaaacaatatgttgaagttctaatcccctgtacctgtgaatgtgattacatttggaaataacatttttgtaggtgtaaacaagttgaggacattttggattagcatgagccctaatgcagtatgactgatgtccttattagaaaagaagagacacaaacatacgcacaaacacatacacatatgcatgtgcgtgcacacacacacacacgagagagagagagaaatagagaggagagagagagagcaagagcaagagagagagagagagagagagaatgctaagtgatgacagaggcagagattggagttatgctaccacaagccaaggaatgaccaggactattggcaaccaccagaagttaggagaaagtcatgggatggtttctctttcacagcctccagaaggaatatgctgtgctcgtaccttgatttcagacttatggcctccagaactgtaaaagataaatcttggccaagcgtggtggctcacgcctgtaatcccagcactttgggaggctgaggcgggaagatcacgaggtcaggagattgagaccatcctggctaacacggtgaaaccccgtctctactaaaaatacaaaaaaaaaaaaaattcgctgggcgtggtggtgggcacctgtagtcccagctactctggaggctgaggcaggagaatggtgtgaacctgggaggcggagcttgcagtgagccgagatcacaccactgcactccagcctgagtgacagagcaagactccatctcaaaaaagacaagataaatctctggtgttttaatccatccaacttgtattactctgttacaacagccctaggagactactactgtgttctaattgctctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaagagttcacaatagtcatgtttggaaatgtgtcattttacatttatagtactcccatgctgtaatgtgttgtttaaaatttatgtgttaccattacaaatggtaaagttagcatgactacaaagtaaattattgtttatgcttttctgcgtgccctgggaagacttgcatttgtggtcaacatcaatgaagcatagcaatatcttttgggagtatcattggaaaccaatattcatgatggatgatgcagccttataagcaatagtgtgagcatcaaataaatggaattagggaactgcagagccaagaacatctatattgttcaatataaagaggttctaaagatctatagcattgctatctttttcctgtggctggctgtaagaaattagccaggaatggcatatttgacagaaaagaacaaagaaattgttccaggtcctgaataggaggagatgggggcctggccactataaggaatctttaagtttgttgattggataataaacacagatgtaaacacttttcactctccattattcgaaagctttattgacaaatcaaggtatttcacatgagacaatatattttaagtaaaattgttcatgtagacaggaacctaacaaaaaatatttgcttgggctacctaatttctagaggcaatcctgtcaacagctatttaaaaaggggggtgggaagagagaactgggcagagggaaaagtggacaaagcctcaggcaatccagtggggttatgccccacatctgactgaaatggtttggcctttacacccctgcctctctcagttactggtccctggaggaatatgaccttatacaagttggctctctgtggctgagacagagaaggtgaagaagctgacagctggagaccatctgctgtttgcacaccccaacactgggcagcaaatcctttcttgaaatgggggtctgggcagcacatctttgtgtctaccacaaatataatttcaggacttagtttgagagagatctgtaaatgaaatttaaatatattctaaaatgcccaaaacttacatgccaaatatatatatatatataacaaacttatatatatataacaaacatatatataaaaaaactaatatatatatgttttaggcattttagaatatatttaaattacatatataaatgtatgtatttatatttgttcaaaattatggagaggcagaggcaactaattattgttaatttaataactattaatagcccttgtcttattaaatttaaaacactttgtctaaaatacttgatttcccaattactaattgatatggtttggctgtgtcacctcccagatctcatcttgaattgtagttcccataatcctcacatgtcatgggagggacccagtgggaggtaattgaatcatggaggcagtaaccctgatgctgctgttctcgtgatagtgagggatttcttacaggatctgattgtttataaagggcttttcccccttttgcttggcaatcctcctttctgccgccatgtgaagaaggatgtgtttgcttccgcttccaccatgattgtaagtttcctgaggccttcccagcgatgtggaactgtgagttaatcaaacctcattcttttataaattacccggactcaggtatgtcttcattagaagcatgagaatagactaatacagtaaattggtaccagtagagtggggtactgctataaagatacccaaaaatgtggaagtgactctgaagctgggtaacaggcagaagttggaacagtttggagggctcagaagaagatagaaaaatgtaggaaagtttggaacttcttagagacttggagggcttagaaaactggaagatgtgggaaagtttggaacttcctagagacttgttgaatggctttgaccaaaatgctgatagtgatacaaacaatgaagtccaggctgaggtggtctcaggtagagataaggaacttgggaactgaagcaaaggtgattcttgttatgctttagcaaagagactggcagtatattgcccctgccctaaagatctgtggaactttgaacttgagatagatgacttacagtgtctagcagaagaaatttcaaagtggcaaagtgttcaaaggaagcagagcataaaaatttggaaaatttgcagcctgacaatgcaatagaaaagaaaaccccattttctggggagaaatttgcataagtagcaagagactgaatgttaatctccaagataatgggaatgtctccagggcatgtcagagactttcttagcagcccctctcatctcaggcccagagacttaggatgaaaaaattgttttgtgggctgggaccagggcccccttgctgtgtgcagcctagggacttggtgccttgtgtcccagctgctctagccatggctacaagaacccaaggtaaagctcaggctgtggcttcagaggattcaagcccaagccttggcagcttccatgtagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgacctggatgcgagacatggagtcaaaggagatcattttgaagctttaagatttgacttcctgactggatttcggacttgcatggggcatgtagccccttcattttggtcaatttctcccattttgaatgggtgtatttacctaatgcctgtactcccattgtatctaaaaagtaactatcttgctttcaattttacaggctcatggttggaagagacttgccttgtctaagaagagactttggacttggaattttgagttaatgttggaattagttaagacttttggggactgttggaggggcatgattgtgttttgaaatgtgggacctgtgatttgggaagggtcaggggcagaatgatatggtttggctgtttccccacccaaatctcatcttgaattgcagttcccataatccccacatttcttgggaggtagcttgtgggaggtaattgaatcatgagagcagctacctccatgctgctgttctcatgatagtgagtgtgttcttacaacatctgatgtttgtataaggggcttttcctccttttgcttggcacttctccttgctgttgccatgtgaaaaaggacatatttgctttccttttgaccaggtatgtaagtttcctgaggcctccccagccctgtggaactgtaaatcaattaaacctcttttccttttcttttttttttttttttttttttgagacagagtctcgcttgttcacccaggctggagtgcagtggcgcgatcttggctcactgcaacctctgcctcccaggttcaagctattcttctgcctcagcctcccaagtagctgggactacaggtgcccaccaccatgcccagctaatttttgtatttttagtagagatggggtttcaccatattagcaaggctggtctcaaactcctgaccttgtgatctacccgcctcggcctcccaaagtgctgggattacaggtgtgaaccactgcacctggccaattaaacctctttctttataaattacccagtctcaggcatgtatttattagcagtgtgagaatggactaatacactaataaatctgataatgttacaatttttaaataactaattttctacatcacttcttctccacacttgggttttaaagtgctttcttaaatatatccatgtctatgtatatctacatctgtatctacctaggtagagcaataatagatttataatagatctaccagggtagatacagatgtagatatacatatctatatattcttaagtttttatttgctacaaattttataattatctaggttgtacatgtgtttcataaaaaataatagtgtaattataaaattaataaaatagcattctgttcttatcctcatcaacttgcttctccagaattaaacacttttacctatttgtctgttacttatctccacatttctaaatagcctccttttaaaatggatttttctggtttaaagtttgtatctctatttcttaatatcggtatcttaacatagaaaacctatattgcttaaatcatcacacacttcttttctctttattcaccctcctatgcactttctttctctccagtctcccaatttgtaattatatcataatgtatcactaattcaatttttagtgttcatataatactcaatatttagtatttacacaatatgactatggaagtactattttcagttgaatcaagttatgataatattttatttttgtacaaccttttttcctggggttattttcattattttctcttgtttaattctatacacctactacgaattcatcctcaaactttttgaaagatgtgtaaaacttattttaatcaaattggtttcatcttctttcccccttggagatagagatctttccagcacccctttggctctgatctggaccacatgctgtctaggttggctgcacagatgtcaacttggagcctccttttggcagcaccttaagaaactttttggcatctctttgttgaatcccactttctggacaccatattttgttccctcttgaattatcttctcatattgatggagtgcattctccatcagctttaggagaaagaaggcaaagaacttgaacattttgagaacttctatttctgaaaatgtctttattattctgattcatacttggttgaacaaatttctaggttaattttttttccttcagaatgttgaagtattgctacaatgtcctaaacttgagaatgtgtgtggggttgtcaagaagacctcatcataagggtgaggaacagtatctatgtaaaggttagaatctacaggtgttctctctaggctggtttgtgttttccagagaagaaggatccagtgctctgctttggctgaaagagagaagatgactgtacagtctcactattcagaaatcaatttcagctaacctctgattctcacccttcctctcagctgtgcctggtatccttaaagctatctctgccatggatcaatgtctttagacagtgaatcttttgcctcctgccaaggaggatgtgtagtttagggaaggagattggagtctagatgctactgatgtaaagtttctaccagtctgcctgttttcagctttactcagtgcctcataatctcatatttttcagggttctgagagaaaaaactggtttgcttcttgtgagtgttacccctacaagctgcttggttttagctttctcaggacagctaaattggttaacattcatatgctttgcagcttctaaaatgttgttctctctctgcttctgttgctcttttatatttcctttaaccttgtgggatttttgtttattccttattgtcattttagctgagatttaaggagaggaatttagcatcttcatttaatgtattctttaaatcacaacttctgatcaataataatttctgcctttttgcctctccattataatgttcctctccctgaaatagtaaatgtcaggaatagcacaaaattctgatcaaatatggcagagtgaaggttttcattacattttctactccaaaagaaattgcgaaaaacaaaaattacactaaaaactcaacacacagaaaataagacaacaatttaagtgaaacggaatcagccacaactctgaaaagaatactttaaaaatagatcaggagatacatgaaatatacagaaaaacatgcaacaagctgtagaagaaagggtgccaagtgcacacccatctgtatatttcttgcagcacatagaagttttctaaaatacattcactatagaaataaaaattaaactagtagcagcaacatataagctctgctgaaaggtagttatagatatggatgagaggcttgaaaaaaatcaataaaaatataaaaacaaatgaagctgattagacaaggggaagaagaaatgaatcatgatgtaaatatcaaacaaggtggatattgatagaccatagactttgaaaatataacagaagagatgaagcttatatgggattttagttcaggacaaacctatgttttcaacgggcgcccatcagaacctcttccatggccaaagggtactaaatagagtcagtgggtaattttcaggataggtgaaactccaatattatgtttgcaatttagagaaaaataacatttattttctaagatactattataatacctagaaaaagtagtctttggcagggggtgggggtaagaattgagtaaagtttgatgttgtaaataaaactataaagtattttaaagtataatttaattttcagaatgggaaacctgttttggttttaccaaaatcgcatatattaacttttaaatttttatatatagtatgtaacagatgtgtgtgtgtgttctatctttcatacattctaatcttgaatgaatgatttattcatttaattgccttctcaatacagaataatttcaccaaaaattatacgtgtaaaaccagaagtgacttgttacttccctactgaagatattttaagtaaacttagcctcactcccctctttgacagcctgagcaagctggaaacctttcctgtaatcctttcttgtatctaaatcaggggtatccaatttttggcttccctgggccacactggaagaagaattgtcttgggctacagtaaaaaacactaactatagctgatcagacaaaaaaattgcaaaacaatttcataatgttttacaaaggtttacgaatttgtgttgagctgaattcaaagccatcctgggctgtatgttgcctgcaggccatgggttggacaagcttgatctaaatgaaagaagtattaactaatctgaaattatagattcttgaaaaatgtcctttctcagtagataagaattttatgtaacatgatacttggtattaaattctaatgagaataagttttacaacagatttaagttgagcttcagatactcaggctgataatatttctttgtaggatttaatttttattgacacattaatgaaactattctctactttagagcagtagggatgacataaatttcattattttaaggaataaattttattaaattttcattaagttactaaactgtaggatgtttaaaatgtttttaacatgatcaatgcagttaccatggatattgctctttattttaaaaccacctcagaataaattgtggtctgctggtcaaccaggcttcccttctactcctcaaaaaagccctgatttgtagaatttgctgatttctgtattaaaccctgcattatggctgattttgagctatcaatctgatgtcactgatggtgactttagggagaaaggtgaacaatgggctctccttggccatgtgagccagctctagcacactactgcattaacacacaggggtgcatcacttaacaagctgagtgtgttctgagaagtgtgtccttaggtgatttcttgtgtgaacatcatggagtgtacttacacaaacctagatgatgtagcctactatgcacctaagttatatagtataggctattgctcctaggctataatctgtacagtatgttactaaaataaatactctaggcaactgtaacacaatggtcagtatttgtataactaaacatagaaaatgtacattaaaaacatggtataaatgattttaaatggcgttacctgtgcagatcacttcccatgaatggagcatgcaaactggaagttgctcaaatattttctttctttatatccttattctttagacatttttttctatttttaaaatgctttataatttttagttttttgaaagtttttgttaaaaagtaagactcaaatacacacattagcaaaggcctactcagggtcaggatcatcagtcaatatcactttcttccacttccacattttgtcccactggacgatcttcagagattatcttcagagataataacaaggatggagctgtcatctcctgtgataataatgccatcttctagaatacctcctgaaggacctgccttaggctgttttagagttaactctggctttttaataagctagagtatactctaaaatgatagaaagtaaataataaatatataaaccagcaacagcattatcattaccgagtattatgttctgtacataatcatctatgttatacttttctgtgactggcagcacagtgggtttgtttacaccagcatcacaacaaacgtgagtattgcattgtgctgtgacattgtggtgtatgacatgactagggaataggattttttcagctcctttgtaatcttatgggaccaccatagtatatactgttcatcattgactgaaatgtcattatgtagcgcatgactgtaatcatctttgtaattttcttttttctcaaaatttatatacacctttaaaaagtcaagtaggaccagaagcatttataatgaaaaatgatccaaacctcattctaccaacatccttcccagacagaagttactctcttgaactgtttctgtttttagttctgccagttattatttcttcccaaatctaaataatttgctgtaaggctattttttgatttggcaataatatgaacacttccaagtctttcaattagaattattttctattatctagtaactttctcccctctattttctctgttctctacaattcctgttagttggatttaaggtcattataagtgatactcttgtcttttcttccatatattttattcatcttttctgctgtttcaacctttttttgattttatgtaccaatcatgtgtttgtatatttgtgctttttctcattttttcttagcattgtcttcttgcttaaataagaaaatattacttgaatttatgaatctaattaaagttatttataatcttttttaattcctgaaatatctgtttttcttttaagttccttttttcctcttgagctatatccttttattgctggttttcacatacttgttgaccttttgttgtctattcatatttagcaatgtgggatgagtatgatttgtctgctgaatgatttgagtgtcctctttacctatatatgaagttttcacactaggacattttaacaggtctttgagcacctttcatagatgtgcaatgtgctcaggcttcaatttgggatttttctggggaactcccaaatgccagaatggagaagccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgtagcttcatttttctgtttgatataatgaagacttcagtctgtcttcatttacccccaaatttttgaaatctctcattcatcaaaaaggtccttcttttttactaatttttctgtaattttattccatttttttcctacacaatcatatgaatatgaattggaagtcatgatctattgcacagtgaatccatttggaatcttacaatcagtgaaccatccctgtacctctttgggagctatgtacattgtatcttgtatatgtacagagttacgttttttagattttgatacaaacacccaaaaaaacactgagcaatcccattagggtttttgtttgcttttaaaaaatactggcatcaagaaattcttttattctaaaagtatacctatttgaaaaactcatatccaaaattctggtttgtaaaattatgagcattatatatgaagtttagaggacatttatggagattccttcatatagaacaaaacaaaatcttataaattattataatgtcatgttactggatatgatttcttttttaaaaaccacagtcaaaatataaatctgcattctttaatgcttcctttgacaaaacaatctttagaaaacatttattgtcacactactttggcctgaactatgaattctaatttaatttttatatactctgtgttaaaaataatttgatttggggagaaatttggaggcgcttcaaggcaattgacattatgaagacaaattctgtttatttcttgaaagtttctcttcatatgagtttaattgaatttttttttttttttttgagatggagtcttgctctgttgccaatgctagagttaagtgttgccatctcggctcaccacaacctccacctcccaggttcaagcgattctcctgcctcagcctcctgagtagctgggactacggctacacatcaccatgtccagctaattttttttatttttagtagagatgtggtttcactatgttgtccaggctgatctcgaactcctgacctcaggatccgcccgcctcggcctcccaaagtgctgggattacaggcatgagccatcgcactcagctgtgtttaactgaatttctaaaacttgaatatgattttataataagctataagtttattctctcagtatttcaaaccatataatacaattcttatgcttctatcttataaccatttaaagttatttagttggttagctatttaaaggttaatcctatgttttaacaatattaaatactttatataagaaatgtgttcatattttatagtaaattatcaaaggaatacagccattcaaaaaataaacattatttgccacatttatttctgtgtatactgctatgaatgcaactcattattcttagaatatagtttctctgtattgtagaatatatacttctatgtgtatatgtagcttttatgtatatatgtgatattaaatgaaaattagcacatatatgcatgaatggatgtcaaatgtcccctatttttcatatatacacaacactaattcatatatgtgtgtatgtgatatgcacatactatctttttttgtatatatgtatatatgctttcaaggccagattaagcagaaggatgctcaaatttctcctccctcctcctatgcctgattattctgcaccagaccttcacttttattgagtagctagggttgggctgacacttttcaggctgaaaggcagaaacatttatcttcactgacaaacaatttgtgaataccttccttgggttgtgagacacttgctctaacacaattctcatctgttttattatggagtccctgcaacatttgacatcctcttactgaatttgcgtgttgtgaaccgaatggtaccataggttgattgtaatatatttttttaaagttcatgccaatttttctgtctttgaaatttagaaattaatgtgggattatttcacctgtattttttaggaaggaactctattaatttttcctctgaatataaatgtaatctgtgtttctattagaaaactatgagaatatgagaaaataccaggaagaaataatatctatataatatctatgatcctactaatcaatgataattgctattagtattttatatatattctttaatcatgtatttatgcataaacatgcatgatattaacttaatgctagaatcatgcagtttatgtttgcagacttttgtttgcttaattttgaatgacattaaaggcttggtttttaattgatgcatgatatttcatcttatgtactttctgacatgtgatcacctcctattgttgcatatttacgttatttttatttttgatattctgacttaaaccatgataaaattcatatgtaagggtttatgcacatctacagtagtttttagccattttttaaggttttgtatgtaacctgatcattcctttagcacatttaaaaaataatatccatttgtgttttcttattgatttataagtcattttttctacaatggtgttaatctttgggctatcttatatgttgcaaatgatttctacttttttggttgttttacattatgtgtattttttatatatatactgtaatttaaaatgtccactttagtacagcctctatggaaaactggttggcaatttctcgaaaggttaaacacacatctactttattatctagcaactttatgcataagtatataccccaataattgaaaacatatgcccacaaaagacttatacaaaaatgttaattacgtctttcttcaaaataacaaactattggaaataatctaaatttacgtcaaaaagaatagtttaaaatttgtgatatatttataaaatggactacaactcaggattaaaaggaataaactatgaatttacacaaaaacacagacgaatcccaaaaacatactcattgaaagaagcaagacccaaaataatgtatattgtatgattctcttgctgtgaagttcaacaactggtgtaaatgatttatagtgtatggagtcaggagaatagttgcctccatgaaggggaaagggaatgaaaggaaagagacacatttatttgtcacaaatcaacaaacgctactattatggggctgaattttgttcccccaaaattcatatgttgacattctaacttcctgcacattagaatgtgaccgaatttggagacagagctttaagacataattaagagtaaattgagttcattttggttgccctaatccagtatgactggtgttcttaaaagaagagtagattaggacataaagacacacaaagcaggaccgtgtaaagacacagaaagaagacagctatctataaaccaaccctgctaacatttgatcttgaatttctactttccagattgtgagaaaataaatttatgttattttattacctggtctatggcaaaaatcaaaaatgtttataaaaatgtttaaatatccagaacccaacaatgtaaaatcataatgtttggcatccaaacaaaaattacctggcataccaagaagcagaaaaacatgactccaaatgagtacaaaaacatcaatcatctataaatgatctggaaataacaatgatgatagaattagcatacaagtatattaaaacatttaaataactacatatcatatgttcaagaacctaaaagaaagcttaagcaagtgtagtagacacaatgggaaatataaaaaagacacaaattcaacttctagagacggaaatcatgtctgagttgaataatgtcacttatgtctgttttcctttgcatttatgctaagtgcatacaccatcctgagataaaaatattaaaacaaacttttttgtaatttctttgcaattttcatttcttattgaaatcataccttaaatgtattttgtatataatctatttttctgtattattaaacaatattcagaactctaattgttttgttacccatcactttctcattgatttgaaatgccagtttttaacatttatgagtgcaggtatgtgtaaatgagtatacgaatttaaaagtctctatcataagaagaaatgttctttagcaattaagagtgcaggctaacaaatgactacattctaactgtaaccttgaccacattttttttcatgagtcttgacagtaatctacttgtatgtaataaatgtcatgtggatagttgaacatattttacagggttgctgtgagatttagtaaggtaatgcaagtacagtcttgccttgaattataatagggacattttaagaaattttaaaggaaatttacaattaaatgttaaaggaaatttaaagcatattttatctattctttcatccagaggtatgtgagtgtgtgtgcacgtttgtatgtttaaggtttgtgtattggattttattttaaatgtttctattttgcctcttaaattttgacttagtcttttgtatagttcacattctttcaagaggatgttgatttttttcttcttgtttttactcaaatttgaataaagaaattgctatttggatcaagcattaggttgaactatatgaaatttcgtttttactgtgtaaaaatcctatatagtgggatttcatatggatcaacttaaaattgcttaaaaatcactgagggtagatacataaagaatctccagtaatgcaatggctgggtcaaatggtatttctaattttagatccctgaggaatcgccacactgacttccacaagggttgaagtagtttactgtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctacataaatgtcttcttttgagaagtgtctgtttatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagacccattactgggtatatacccaaaggactataaatcatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaagatgagttcatgtcctttgtaggtacatggatgaaattggaaatcatcattctcagtaaactatcgcaacaacaaaaaatcaaacaccacatattctcactcataggtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattaggtaacaattacaaaacaaatggaagcaatacataattccaagctatgatagtgaaaatgttctaacaaatttaaacccactttttcagagatcgatattgaaaatgactctgttttctttcaatatggtcccaacttctgtacatgtagcaaaaaatttgatgaaatgtttggatgatacatttttctaattaccagagtgattcagttttccctattttaaattcctttggtcatttcaatcaggattaggtaggatgtgatgttacagcctgtgtttaaattgacatcctatgtcaaatttattatatatgtccttaagaaattaggatttactttgattaaaatctttctgtgcctcaggaatgagtagtatattttatgattttctaaggataactttctctgtaatttaaaagaacaataaagtgtttatttccttttcttaaaaaaataaaattcactgattcagttaacctagagaaaacaaccattgtgcatagttactgagggagtatgttaataatcactttttaaaacaatgtggagaatgtctgcatcaaaggattctgccatcaccctaagtattttctccctatcttatctttttttctcctttgactaatagctttaacattgatttagttgaataaaacatttgacatttttaaggttcagtgcacaaaaaatactatttaccattcacagggttaggattattttgtattaaccaaaaaagtatgtatgtacatatgtacgtatctatttatctatttatctatctattatctatctatcatctatatatccacatacatacagacacacacataatcatcattgatatttaggatatttgtagttttctttgattagatatactctgtaaacactttgccagtagaaatgtactgtataatgtgacagtgatctataaaaatgcattttatttcattcaaacttaaaactatgcacataatctggttatcttctaaaacaggtgatatgcttctttagattaagatttgccttcttgtgctttcgggaagggtttgaacaatgagtgatatgtgattgaatttatggtgaagaggcagaaatgctcttaaatattataaattccgtagattcatagtacaacattctcttcagctgtgccaaaattatccctgtagaatgtttttatctagtaatagcagcgatgagtagttgatctcatggcaatgtgataccgcccctcatggacacctgctaaatcaccagtatctgttttatctgaagtcatagcttgtggtgacaatgtttaaatgctcattaagcacattaaacatagctaagttcaaagtgaaatttagctggccaaaaacttattactcgagtcttgtaatatgttttgtacaagtctttttcaacttgtacaactatcactgggtgtttatgaaaaagtccaaacaagttttcactatagaatgtttgtgtctttgtacccatcagacctatttggtgtttggcaaacaaagcaagcaatcatgatttttctgacttaaaaaaatgcatgattgagtgatttcttgctacaagaatttagtgcttcactgtgttacaaccgaacaaaaagtgaacactacagttgtccttgttaataaaccatactattaagcatattaatttttgctaaaagcgtggttaaacaaataataatacaagtacataattaatgaaaattattttcaggttgttactgatatttaaaaaataaaaacgttgtaattttaaacaacttaccaaaggacagaaatctaaatactaagtttggtataatgagtcttttaatttcatctttgtacaccactattttaatgtactgacatattttgtgtgttgtaatcgccttggtcagcacaatttttagataaaggaagtgaaataaatcgagtttcttattagcacaatgataccattatatttcttaatttttttttttttttttttttttgagacggagtctcgctctgtcacccaggctggagtgcagtggcccgatcttggctcactgcaagctctgcctcccgggttcacgccattctcctgcctcagcctcctgagtagctgggactacaggcgcctgccaccacgcccagctaatttttatttttttattttttttgtatttttagtagagacggggtttcactgtgttagccaggatggtctccatctcctgaccttgtgatccacacgccttggcctcccaaagtgctgggattacaggcatgagccaccatgcccggcccaaaaacaatcattgtatttctaactgaatctttatattacacaaagtctgaagttccctaaacttggaacttgggaatatcagtgtggatatacatttattacataattatcatttattttcataaatgtaaatacctttatataaatcaatgaaaatttaatattacatttcattttctgtcattatttcttttcatctttaattaacaaaagtttctcagcctttagttaattgctttgttaatgatttttcaaacagaattagaagactttaatatttaaaggaatatttccatattatgaaaaataatactttaaagaatgtttcatttgtagttcttcacaatttggagaagttggagaatgttcagtgaaatagcatataattatgcattttaattaaagtagccaatgctgtgacttaaaaaatggaatattatgcttcagactttacttttcaccgtaaataaaacaaccacagaaatgccagacagaacaggaacattatggtacctgcagtacactcgggttacatacacacaccaaaagagagaatgtgaaaatctagggagagggatggaagctatttgtgtgtgtatgtgcgcgtgcatgtgtgtgtgcgtgtgcacgcaggtgcactcgtagagttacaagtaaagactagaggggctttcctctgcatggttaatatttacatatgtgctaattctgccattgattaggtcagtactattgttaccatggtttttccttttttgacacttctgtcattgtttcatttacggtgaaaacgaaaggctgagaatgggggccatgaggaaacggaggtctgagtagtgagagcagtaggctgtttgaggatggatttggggagaaaacctgtagtctctagaggaaaatccctcaaaagccttaccattaggatgcagaaattaggacgcatagagtgaaaactgctgacagagtatgctcttgaaacatcttgggccatgcacggtggctcacacctgtaatcctagcactttgggaggctgaggcaagtggatcacctgaggtcaggagtttgagaccagcctggccaacatggtgaaatctcttctctactaaaaataacaaaaattagcctggcgtggtggcacacacctgtagtccaagctccttgggaggctgaggcaagaggatagctcgaacccaagaggtggaggttgcagtgagctgagaccatgccactgcactccagcctgggtgacacagacagactccatctcaaaaaagaaaaaaataatcttgaagattggaggaggttttggctagaatagaagagagaacccttccaagatgtataataaacataaagaacaagaatttcagacctctatcgacacacagctgaaaagaaagcaatagtggtttgtttctcttctgcaaaagcaggtggataattaacgtcttcccttgtctatagaaagaaatgtttttgacagttgagaaattgttttttccataatttaagtcctacccactgagttcttcctcactgggggttgacacgtagtaggcctggggagtggatggagataccaactttatggttaccatatgagtcccaggtgccatcgtctgtaagtaccacaaagtcagagttagtttaatccagcaaaaaaagtctattttcatagacaaattctcaatattaaacctgagctatacttgatgtattaaattagtttgatgagaatttttttctgtaattaaaaagaaacgtaacaagaacacagtttacatgggaaactgtctcatatataagtgaataagtaagaattgtaaaagtctttgctattatgtaatttaaattaagttagtgcatattaaattcttttgaagatggtacttgtggtcattcatccttttcatttttatttatttttacatgaaacctagctaatataattatttttacaaagctttactttcttcagtgttttcttattcattaagaagaaagcattatcttcacattacaatttatttttgggataaaaatttgtctagttcaagtttaaaataaagaaaaataagaaacaaaatattgttatgtattgctgctgtttttatttacttctttctttgtcagtaaaatcctcccagtaagccattgcattaccacaagtttttcaattacttaccctcactgatgtcactaattatgatgcattaaccatgagaatgttaatgcagaaaaataaaaacaacaaccagaaaaatcaaaacaacaaatactaagtataagaatattgcgaattaaaagatgcagaatatttccactgagattatgcaaatagaaagagaaaaaatgagttgatgcagctatgtatgtctctgatagttaatgttactgattatagttcttaaattgttgtttttttagtttgctcaatgctatatattttcttgttttacttgaattgtggaaacatttgtgtcacagaagaacaaattaatcccaatgtaagcagtagaaagtgaataataaaattaaaatgaatcaatggaataaaaaacagaaatgatagagacatcagtgaaatgaaaagctggttctttgagaagatttataaagttggtagatatccagccagactgatcagaaagaaagaagtttcaaattcaataacaaaaatgagtgatggttcattgctacaaattttccaaatgtttaaaagataatcagaaagtattaagaacaattttatggtcaataaacacactttgatgaaatgaacaaattccttgaaagacacaaactaccaaagcttactcaagaagaaatcgatgagctaaagagcccctaagaaattggttaggttgagcatctcattttatttcttttttatgaatggtcatttcatatcttttgcctatttctctattagactctcagtacttttttatttgttgggttttttaaattttatatattgatcccttgtcagttttagacgttgcaaggaacttctctattttttattggttaatttcaactatggtgtcctttattgaatggaaatgtttatttttaatgtacccaattttcctcttgtggattttaatttttgaattttattcagatctttccccattcctaggtaaagagatactctagtacatcgtaatttattttctttattgtttttctattcagatatacatatttaattcttctgcatcccaatttatttgagatttaatgtagcaatcctgttcatattggtaattttccgagatctctatcctgttccactggtcactttgttcttgaccaaacagctttattatggtagcttgtaagtatattttcatgttggtataatgagcctccccactttctttggtctttttaaaatcaaaattgacataaactcttcatgcacttttattctaccagatacaccttgattaatcatattgacttcctaaaaaacactgtatttggaattttcactggaattgtgttgaatttataagttaattttgggataattggaataattacattgctaaatggttttattgatgcatatggtaaaattttgttgatctctttcaagccttttaatagaagctttgcgtatttctcaatgaaagtcttgtgcatgctttgtttaatttctttgagtagcttcccatatttttcttgtcttctctttcaggaatgcatgctagtcaaatgttggacctattgtactggctttctgattttttttttatcactttctctcctagttagtccatccttttttcttctatatggtcccactctctgaataacttctttgactttatcttggaaatattaaattggcattttaattttaagtaacatatataattttcaaaaactgttattcctgcataatctttcttcataatattcctgcttatattctgtgagtacaataccttcttttatttgtaatagactattaatcatggaattttaaaaatatactttaattttaagagcagttttaggttcatggcaaaactgagcagaaggtacagagatttttcatatatcccatacccccacacgtacatagcctccttcttatcaacatcctcaaccagagaggtatattcgttttaatttataaacctacatgaatacatcattatcaccaaaagtcgtagtttacattagggttcattctcagtgtcatatattctatgggtttggacaaattcataatgacatgtatccaccattatagtatcaaacagggtactttcactgcattaaaattcttctgtgctctacctattcatatcgctcccccctcgtacccctggcaaacactgattttcttcactgtctccatacttttgttttttctaacatgtcatgtagctggaatcatatagtttgtagccttttcagactggcttatttcacttggtaaaatacattgaagttttctccgtttctttttgagacttgatagctcatttgtttttaatgttgaatgatattccattgtctagctgtaccacagttcattcattcacccactcaaggacagcttggttgcttccaagtgttgaaaattgtgaagaaagctgctataaacatccgtgtgcaggttttcagctcctttggataaatactaaggagagagattgctggattgtatggtaagaaattaccaaactgtcttccaaagtggctgtaccattttgcatctcaccagtaatgaagtagagtttctgttgatccacatccttaccagcattttgtggtttatggtcattctaacatgtgtttaatggtattcattgtggttttaatttgcatttttctgatgacatatgatgtagaacatcatttcatttgcttatttgccatttatatatctttggtgaatctgttaaggtctttggcccattttaaaatcaagttgtttattttcttattgttgagttgttgtaaatgccttttgtttattttagataatactcctttatcagttgtgtgttttgtaaatattttctcccagtctgtggcttctgtttttattctcttgacagtgtctttcatagagcagaaaatttaattttaaggaaatccagcttatcaatttattttgtgaactctgcctttggtattgtatcaaaatagtcatcaccaaaccctaggtcatctagattttctgttatgctatcttctaggagttttatagttttacttttacattgaaacgtgatcaattatggaatctttgcagttttttctgcttgtatcacttctgcttatcttgagttactttttatatgtttatctactttggttcctgtttttttatgtgggaggttttcctttattgtttggtgatcattgtctcaccattatgtctaagaatgaaacactttacgcttgggaggggtttgtgtgatgtgatggcccaaaacaaaccatcattttaactggagaatgccaaatgttgatgtccataggtcttttctctctgtagagaatcaccttccatatacgaacttccaggaatataagcctggtttctggtgacccaaagctgattagcagaggacttggggggaaggtcactactctttttttagaatgtcattttctctttttgtctttagttgggtgccttacctttgccttactttgaaatggggtccaagtgttgaatttttaaaaataatatatcttgcaatttttctatgaatgaggatgtgagaccaaggactctcaggcctaactgcttcttaaacagactagtcaatttctctacttttactttaatttacatgatttttttaaatcctcttttgtatccctctctgtaaacacttaggcttgctctcttctgttttgctaagtcattaccatttctccatctgtttcctgttcattatattgcagggtggaattacaggtgccccttttttttagcaagcatagcatgtgttattactctctttgttttttgttatatctttaccttgttgtgtttaaagcagaagttagatatgtattttttctacaatgcatttatttatagtgctcagattagtctctgaacacagaaagaatttcataatagtttcagattgaacattacaaacatgtaataatcacaatttaactcaacaaatattttactaaatctcggtaactgtgctaggcaatgggaactccattcttgtggataataaacaaataaaaactatatgagaattggagttagtggtaagtgctatgaagaaaaacataggagatatgacagagtggatgtatattttaaagagtttgttaaagcggcctcctccttgtttcttgatatttctttttaaaatattcttgtaacacaaggaccaaatgaatcactgaaaaattcactcagaaataagagtgagacttgtaacggttagtaggggttataatcaccgtacaagaagtatatctcttctcgttgctttgtctgcctttggcgaattggaaatataaacctgtttaatgaatgtgttcttaaaataccctttggaagtttaaattactattgaaaaagctgtataatgcagttatattcctttgtttatgtagctagaagagagaaggaaaagaacctgaggctaatagaaatagattacatttcactatggagcatagattaaaataatgtattttattgtggatctcccttcagaattcaaactaaatatcatttactttttctatttaagtaataacctcagggctctttaaaaaatcattatcagaagataacctaatatatcattgatatagtttcttcctatcattgacaaatatcatattagaaataccacctttttatagtcttgaaataatataatagaaaagggctccaaaaatgcaattgttccagtaaaaatagtcatggtgtattctttattttatcgaaagagaaataatattaaatccttcccttgcatttctttgaaagtgaatacttatttggtctactcgaattaataatttattttcttttgaatgttttgcagatgtttatatatcagtagtttcatttaaaagagctcttaaatgtcagtacttttctactaaaattagtaaacataaacatttaaagtattctaatatcattttaacctattttttaaagaacagtgtaattgatttttaaatcatgacattttaaatcatggtatacagaaagagtgtgattttagagtaaagagtatttttaatttgagaattaaatcaaatggctataaaattgtatctataaaactaggtacacagtgaaattcccattgtcagcatggtcctgtctccacccaggtaccatactccacctgcaagtaaccatttaatatattttttcgtatccttcggaggattcatttatatgcaaacaagcttgaacatacattcttatttgcccttatgtacctaaaatttagcttattttaaggttgctttgaacattgtttttatcacttacgtctaaagttctttctaaattggcatagaaagaacttcatatctacattgtagtattacgttgtataatataccaagattcatttaatctgtttccaattggtacatatcagccttttgtccaatattctgctactgcaatcaatgacctatatttaaattgttttggacataaaactttacagggaaaagccccagaagaggaattactgaatgcaagggtcaagttcttgtaattttggtgaatattaatattgccagatttccactattgtatcatttttacatttttaattattttatattacccccaccaaaaaattgatagtttatttccttacagctttttttttcggggacggagtttcgctctgtcgccaggttggagtgcagtggcgcgatcttggcgcactacaacctctgcctcccaggttcacgccgttctcctgcctcagcctcgcgggtagctgggactacaggcgcccaccaccatgcccggctaatttttgtatttttagtagagacggggtttcaccatgttggccaggatagtctcagtatcttgacctcgtgatctgcccgcctcggccttccaaagtgctgggattataggcgtaagccactgcgcccgacccttacagcattttttcaagattttcggtttctatctatatgataggtgcgtaatcaaatactcacgacagtttttagtttcagttatcttattataaatgagattgagaatgattttaaaagctactatttgtgctttctgttctgtagattttctgttcatatgttttctccatttttcttttgatgtggttatttcagtttctatgagcccttttttgtatgagataatttatttttgtatggtataaactttaaatattttcccatttgtcattatctttcgagtttgcttatagtctataattcttaagttttgaataaaaaattataaaaactgttttcatgcaaacttttgaagggctactcccgtgtttgatagttttatgattgtatattttatattttaatataaatgcatttgtcctggcttgtcatataaagcgtgaatgccactttattttttttccagatgacactgttttgttccaataaaacttttataattattcttttctcgttatatttaagatgtcaccttcatgatatgccatatacttgaatgctttttctttctacctgtggtctatggaactcaaaatggaactcaattttaatatgaccaattttgtttgtaatcctatttatttcttttctgttttaaaatgttattcttcaaaaagacctataatataacattcaaataggaatttttacattatagattttaaataattttcctatgatctatttaaaaattttctcttatattattttctctaaaatattaaattacagattttatttgatgcattattaataaaagttcaaatttatgagtttctaaaggtattttaatagttaattttgacagctatctcatcaacatgtctaaaattttattattttctcttactcctattcctttgtcaaggctcaaatcaggagtcacctctgtttcttacttctcactctgcagtcctattgattctgactactaaaaatatcttagtttcttcacttctctccaacagcaacttggttgtctctatcttagacaaaattgccatcaccactcatttgtgttagtccaacattctccatgtggaagctaaacagatctcctaaagaaatgaaagtaatcttgccccatcccttactaccaacttcaaaaacttgaaaggcttcttaccttgcagtagtagtgtttgaagtactcatatctcaatatctgctaatatgcattaaaaacaaaatagaacaaaacctcatcagttaaatattttaaaaaggcattttaattgtatgtatatgtctgtatttgtgttcattttatttatagtaaggttaaaaaatttgtgctttacttggatatttgttatttgagggaggtgacatatctcttcatataatttgttcatattattttgtcttattttttgtaataatttaattaaaaattttaaaccttattatgccacttagggtctgaatatttttatagttgtatttgacaaaaagatgcttttaagtttttacatttattcacatctatcaatacctttatgagtttgggtgtgtatgtgggtgtgttcactggcaaatatttacttattttattctaacaccatatttatgttacttccttacttttacaattttatctgtaatttgtttttatataatttgaattaggaatatcacagacttttttttttcagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacagttttcttcatgttccaaaaattaagctactgaaagctttggtcgtttgagagactcctctgaagctccttctggctccaagtccagaaatcattcagaaggcttttctcccaacttttggaccaagtagtctggaccaagataaatgtgtttcattgcacaatatggcttatcttgtagtgatatgtgatttttcactggcattagggggcatttcccaagaaaagtactggcaggtggtcttcatttcaagaactctgcagtattttacttgttgagtgctatttgcatttatagtgtaaatgagattagtcaatgggatttttaaaatttactatcagtattatttttaggttttggtatcagagtatcagaaatgttctggcctgataaaatgaagttgggacacttctgtcatctcataattctgtcaaaatctgtgcaggtttctattcagatctttagatacttagaagtgggcaaagtttctatttcctatagtgttattctgttaagttgggtttcagatagccataggaatagagagagttccttagaaggcatctgagttgaagggacactcactttttgctgaccactttcttttctgtggttgtaaaagcagtctgaatttttcaacagtgacgtccccactccacttctatatttgacctgaataccattttgaagaactagctgaaataatgccagaaccttgcctatcatgtcaaatctgtcaggtaatagatgaagatgaatacagtttttagagtctcccttgactatgcccagtagcaattcccaagatctttataggcttgggaattctatgccatattttgcacttgtctaaatctgcctccattcatgctactccaagtttgggcatactcccttcacctttatttggtcttcatatcagttgtttgtaagaaataggaagtaggaaataaggaaggtgtgcagagatatttggtcctatcagaagcttatttttcctttgtctcctccttattttttgttttaggtcaaagctagtttagccattcttatctgcctttcttgaatttgctccctgctttagtatacagacactctgcgccccataaatcatggaaatgagcattaattttacattttgaattgtggactctgcaggtttctaaaattgcttgatttccctaccctccaccaaccaacaacaaatatctactttcttcccgagccctgcttcttcatgctatggacatttctgcagaaactgctagaattctatcactaaccttcctggtggggctctccttagcatatgctctggttttacatgattctttattttctcaactctagttttatatgattcttcattttctcaactcaactgtttctgtgttgaaatatttatatattgataagctgtgttttccagagctgatataatttattcatttcaaaaacatattctcaaacagtgatatcatcaagatagtggagtaggattgtgatgtttaatattgagtgtcaacttgattggaggatgcaaagtattattcctgggtgtgtctgtgagggtgttgtcaaagaagattaacatttgagtcagtggactaggagaggcagacccaccctcaatctgggtgggcaccatttaatcagctgctagcgtggctaggatgaaagcaggcagaggaacgtggaaggactagactggctaagtcttctggcctccatctttctcccatgctggatgcttcttgccctcaaatgtcaaacatcaaattctttggcttttggactcttggacctacaccagtggtttgccaggggctctcaggccttcagccacagactgaaggctgcactgtcagcttccctgcttttgaggttttgggacttggactggcttccttgctcctcagcttgaagacagcctattgtgggacttcaccttcaccttgtgatcgtgtgagtcaatacaccttaataaactccccttcatatatacatctatgctattagtcctgtccctccagagaaccttgactaatacaaggagacactagccttcatctgtccatacacaaaaaatatggacaactatttacaaaccaaaataccccagaagcagcccacagtcacattaaagaatctgcagcaacccagtggagcaaaaatatggagaatatccacatagaatcactggtaagaacagcatacccaagtacctgagatgccagaagaaagctaggagtaaagaagaatggtataggctatcagcatggttcattgacaggaaccgctgtggttaccagtatcctggtccacagagaacacaggcatctcttgccactgaggtaaccaatagcctcaaccactttaacaatcctctgttaaaagaggggctgcacgctcctccccttcaagaagtggccactgttgaaagtagaggtgctcctttctcaaaatgtatacccatctcttccaaccctgagtatatgcactgaccctggaactgtggctacttcacgagtgaccataccccagacctgggctctgtgactacaataggcgtgatcatgtttcatataccacagccattgccatagtgagctagattgtattgcaagacccagagccaagtcctctctgtggatgcccatcctctagacacaagctcagctactctataaagagctaggttctgctctaacctcagggccattttaactctgcatacacctgtgcactcctgcagactcctctgctgctttacaaacaccctttctttgaatactgttacagacttggcagtgggggagtcagtgccccaggtaccagttctattatcaccctgggttccagagccatagccccttcatgtttgcccatgcttcaggcctaacctcacctctctggcctctccatcagataccagtaccaccaccactacaaatgagtacacaagacagatacagttccaggacagattccccttagtaacaacttctctggtatgagaaaaggaggtcatgaggacattaaaaagtatcaccatcaaagactctaacaacacttgctgccactgtggacatatacagtgttggttgctgaggatcccctgaaatcttcatcaacactgacctcagttaccacagcagcacagagactacatttctggcattctcactggtaccagaaaagctgcactttatccagtaagttcccttgcaacaaccctagacaaaggtctttccacatggaaactaacttataaagtctgcaagaggtccaacaaatgtgcagacatcaatgtaaaagcaacaagaaacatagaaagccaataagatttagcattatgaaaagaacaccatgatcacccagtagctaatccctctaaaaatggagatacgagaacagcatgacaaagaattcaaaataattgttttatggaagttcggtgaacttcaataaaatacagataaataattcaattaaataagaaaaataataagcaacaaaaatgatagagaaatcaaaattataaaaaataacaaacaaaacttctagagctgaaaaaatacgatgcaatggaaagtgtcaaagcagaattagtcaagcagaaaaaaaaatctgtgaatttgaagacaggctattttaaaacacaaaggagaacaaagaaaaaaagaaaaaaaattaatgaagaaagcttatgggctttattggatagcatcaaatacaaatattcaagttataagagtttaagaaggtgaggaaagagaccagaggtagaaagctcatctaaagaaatgatagcacaaaactttccaaacccgagaaagataaaaattattcaggtacaagaaggtccaaaatctgtagtcagattaaatccaaaaaagactacaccaagacataatcaaattatcaaaaaacaaataaaaagaggggaccccaaaagcaccaagagaaaagaagcaaataaggtagttccaataagactagcagtgcacttctcagcagaaaccttatagtccatgactaaatggtatgatatattcaaaatgctgaagggaaaaacaacctgccaaccaaaaataagttttatccagtgatatggttgggctttgtgttcccactcaaatcttaaattgtaatccctataatcctcacacatcaagggcaggagtaggtggaggtaattggatcatgggggcagcttccgacacactgttctcatgatagtaagtgagtctcacaaggtgtcatggttgtataagtgtctggcatttcccctgcttgcactcagtccatcctgccaccctgtaaagaaggtgcctacttctcctttgccttccaccatgattgaaagtttcctgaaacttcctcagctatgaagaactgtgagtcaattaaacctcttccctttataaattacccagtctcaggtatttcttcatatcagtgtaagaacagacaaatacatccagcaaagctgtcttttacatatgagacaagatacatacattcccagatgaataaaacctgagggagttcatcatcaccagacttttccaagaaatgctaaagggagctgaaaggatactaatgagtcacacaaaaaccctgaaaatataaaacccactggtaaaagtaagtaaacaatcaaattcagaatactctaataatgtaataatactgtgtgaatcacttgtatctttagtataacggttgaaagacaaaactattaaaataataatagctaaaataatttttaaggggtaaaataaaaatatgtaaattgtgacatcaaaaacataaaatggggggtggaatgaaagcatagatttattttatgcaatcaaagtttttgtctgcttaaaatggcctgtaataactgtaaactgttttatgtaagaattttggtaagcaaaatgcaaaacctatagtagatactcaaaagattaaaagcaaggaaccaaaacatatcactggagaaaatcaccaaatcagtaaagaagacagctaaaaaatgaagaaaggaacaaaggacctaaaaaacaacagcaacaataacaaaatggcagtagtaagtccttacatattaataatgatcctcaatataaatgattacatcttccagtcaaaagatgtaagggggctgaatgggtcaaaaaaaaaaaaaccaaaaaaaaaaaaaaacaagatctaactatatgctgcctacaagagcctcactttacttctaaaaaccatgtataaaagtgaaaggttgggaaaacatattctatacaaacagaaaccaaaagatagcggggatagctaaacttatatcagatacagtagatcttaagtcaaaaactacaaaaagagaaaaagaatatcattatatgataaaggaataacttcattatgaagatacaaaaattataaatgtgcacctaacatcagaatacctaagcatataaaccaaatattaatagatctggagagaaagaggctgcaatacaataatggaaggggacttcaatatccaactttcaacaaagaatacatcatccagactagaaaaataataaggaaacactggacttgaactatactctttagaccaaatggacaaaacagacatatgcaaaccattccatccaacagcagaacaatacattttcttctcaagggaacatggaacattccccaggatagatcatatgctaggctacaaaataagtcttaacacatgtaagaagattaaaatgatcaagtatcttttttttgaagatgttctttcttcacttctctattcatgtatctgccagatttccaaaataatatcagtcatgatagttttatatcaaaagtcaagaaagtatttcactgacataaaatatttaagactaagcatcatgcttggaatatgctcaaattagtatagcataatataaaaattaagcatatgttatttgtgggtttttttctcagtaaataagttgtattttccagtcaggtgattgagtaatggaccatgtcagacaagcactgcctttagatctctgaaatctgccagctaatggctatctctataataatgagttacctatcacctttttaaatctcttaccagccctttccttgcttagtctttgttattgttttattgtaagcacatacacatgcacaacatatgctctgtttcctgcaattttatatacatgtaatattttgagacagctttgaaagttggaaaattgtaaacctttcaaatattttggcttattgactacattttcatgatggataattatatctaattataattatatgtgtatatataattatatgtataccattaagaatagagtattctgaaaacgttttaaattgctgagtctttccagggaatagtatatgaaaaaaattagaatgaaaagtaaaggcaagaaaagttataaatggtaaaataaaaagcagtagtttatactttttaaataagtttacattaaaaaaaattgagttgaagtctcactctgctgcctaggctggtctagaattcctgggctcaagcaatcctcccacctcatcttcctgagtagctgggattacaggcatgtgccatggtgcccagcttgagtttacattttgaaaatacttcttttttcagattcaacaaaatctgcctattgacttgtttaatcctatcaaattaattttcttctctatatttacatttaaaatgcattcttatgtgattatatatttgcagcataatcctattctttctaaagggattttttaaaaaacaaggaagtcatcagaactagagtaaaatgttcattataggcattttgtgagttttcatttctgaacgatatttattttttctacttggcatgtaagcaatttttttaaaaacagcatttcagaggaacagattagatagtgatccaatgaatgaatactttataaatcttgtttttgtacattttattagttccttataaacatattagtgcttgaatgaatgtaaacatattaggacctgataaagtaactatgtgaaaattagccccatagccacattcccctttcatcttccacagagcatcatactaacaggttctaaaaattttaaaaatgaaacagatgaactcattataatatatttaagcttaagatgtcttttgaaaatcactcaaaatttggtaagaaatcatatgtttctaagataaagagaacaagttggaagctttttattccataaatattattaaatgcttataataaaatatgaataaaatgttttaactacttctaattattgatttagccttatttattacatgagaattttttttttgtgttagtcatgtacagggactgtagagataaaatcaaagtaaaagataaagtctttatgtatctgctcaattttgttgtgaacctaaccacttaaaagataaagtatatttttaaaaaagaaactttatcctcaagaggtttataatctaattaagaatattcactatacaagatagttctgtcataaagatataaatcagatggtataatacttttggtcctaatttggctatttttggaaattcctttttagttaattttacctttttattatggaaaatttcaaacacccacaaaagtggaatggtacaatgagcctccatgtaccatactcagcttcaaaaatcattcgttttatattatttacttttttgctcttctctcctctctcatctttcctgagatgtttcaatgcatgtcgtgacatcatgtcatttcactcataattacttcaatatgtatctttaatagggaaaaactttataaagcacataatcataatggcataattacatgaaaaaatagatagtaatttcttgatattatctaatacctaggcctcattcaaattccttcagctgtatagaattcattttagccatacaagctctgaaggaaatatttaagatataaaattaattttattcttttgacgcaataagaagacaattatgagtgctagttttctatgcctgtctcttctaaagcaaaataacaactgtcatcctgaaccgtctctgaattatctacacattccaaacggagtggcagtgtttattctcattttaactgagagatgtcagcaggtgcatgagcttctaaccttgtgatggcaatgtgatgtcatgaagcttttcagcaaaagaatacaattattgtcacgagcatcaatgcactactggtaattgcaatcatttttaaggagaaacaagaggaaggagaaatcttaccgaatgaaaaaaattaacagctctagaccatttttacataaattgcataaaattatgcttgcttatctaacttacctacagatttaatcaaaccacaaattatgttttagactttgaatatttgttacattataaaacattttctcaatatacttgtaaaattatagtgcatatattttaattttagttactcttacaataagaaatgtataacatggctaaaaatgtacaaaaccttaagaaattttttactggctgtttttccctaaagatataatttcccagtggggtaatagtttaaggtttcatagagacaatcttattctagttaaaaatatataaatacatgttattatttcatagaacaaaaattgcctcattttcaacaaaggtacacttaataaattattctacattacttttaatgattgacaatcaatattttaaacacggcattctgataatatgcttttaatttatataggtattttcttgcatgtttatgctattaggccattaattttgcatacataaaaattttgagagattcaaagataaaaatgcaacctgttccctaccccacccagcctggatatggatacatatggctcatatattgtttatatattataaatattgaatgcattcactcaggaaatgcaaatgtttaaaactatatcaagtccattctgattatcctcttatttccaatttttcttttattaagaagcctccatagaagaaaaggaatgcttaataggtttgtggatctcagcaaaattctagggcataataaagtatttgggatatagaggattataaaaaatgtggaatatttcttatttgggaaaagataaagctagaaactatgtttagaaagtttgtaactccttgaactaacaaaagtcacaatgagtcatttttttccttcataggaaggaaatccacatgcatttcaagcaattctaacttgatgaagagaatccattcagatataaagtaatatcaatggaacaagttttagcaaacctccaaaatataattttataattttaatatagggacatggaaataaaagttcaaaatgcattgaagaagaaaaatgaataatgaaagattctctaaatttatattctcagatccctttcttacatatagctatttttgacaatctctgtttttagtttttctggtgatataagttgtatgttttcgtatttcttaatatgtcacctctaagaaaaatccattgtttctccacaatgtgagttaagaattacttttctttccttgttccacttcctactccttaagagtttattttctttttataaatttagttagtaaaagttcagctttatttcagtctccaactattttaaactactatctttcaactacacacaatgaatgacgaagttagcaaccattaactttttttgtgggggagatggagtcttgctctgtcgcctaggctggagtgcagtggcacgatctcggctcactgcaacctctgcattccaggttcaagagaatctcctgtctcagcctcccgagtaactgggattacaggcctctgcctctacatatagttaatttttgtatttttggtagagatgaggtttcaatatgttggcaaggctggtctcgaactcctgacctcaagtgatctgcctgccttggtctcccaaagtgttgggatcacaggcgtgagccactgtgccaggccagcaaccattagcttttgtccagtttcctccatcttcccaaattctatctgatatgctagtactttaataatttcagttattaaaatgtatattagttagaattacctttaattttttactatagattcattctgaaagttgatttcaatgaatagactttataatattatgattatttaactactattgactacatattctggttggatttgtgcataaaaatataatttcttacatttaaaataactaagagtatattggaatgtttacatcaccaagaaatagtaaatgcttgagtggatagatattctatttaccttgatataatcactcattgtatgcctgtaccaaaatatctcttgtaccccataaatgtatacacctactatgtacccacaaaagttaatatgcatataattctttacctctagcaaaattttgctccctgaagtggtatatgcacacatgaagagcaataggattctactcttaaatgtaatgtcttttttagaatcaagtcatatttttgtttgttttatttcaacaaagacttcttaatgttctatttttacaagaatttcaaactgcctttatttttattatttttatcaaaaaatgccttttgttgtataactaatgtactccagctctgttatcacattatgtcttgaatgttccggtatgtaatgatattgtgctaggtcccttggccacctattattctgaaatttctttttgttgtattcctatctgatgtgcaatgtttcttgaattgcagtttatgctcagccaattattctgtcttgaaactgtctttcattttgctctagcgaaagtgtcttccaatcatttaaaggaaaatgcatgaaggtacattttctgaattcttacatgtctgaagtgtctttattttgctttcatattagattggtaataccaatggccagacgattgaatattcagaatcattttctgcaaatagaagacattttaccattgtctttcagaattcatagttgctaatatgaacaaatgctgacattttgcaggtaggggagaagaaagttcatgtgtttctaggctcttcttttgatttttgttctgaaatttaaccaaaattatgtaaatacgtgaaattgcttttgccctttgtggtgtatttaattctgaagactctgatctttagtagccatagaacagttcatgttatctctttaattcttccctctcctctcttaactcctctttttctggaaaatacaaatatggatattgactcttaagtttgttcaggctgccataacatatcaaaatatcataaactgggtagcttataaacaactgaaacttttttttctcacagttctggagactggaaagtccaagattagggtgctggcagatttgatgcctggtgagggccaatgtcatatttatagatggtgctatcttctctctgacctcacgtggtggaagaggcagatctggtgcctgggaaagccaatgtcatatttatagatggtgctatcttttctctgtcctcacgtggtggaaggggcagatctgatgcctggtgaggccaatgtcatatttatagatggtgctattttctctctgtactcatgtggtggaagggacagatttgatgcctggtgagggccgatttcatatttatagatggtgctatcttttctctgtcctcacgtggtggaaggggctagctagctctctgaagtctcttataaggtcactaataccattcatgagggctctgccctcatctaaacaccgcctaaaggcctcacttcctaacaccatcacgctgggcgttaggatttcaacataggaatttggcatggcgggggaacacagacatttcaaccatagcagtgaccttctgtattcatcttctatgtctctattttgttttccttttgtgttttatttttttagtttttcatctgaattggggagatagcttcatttttttactttcaacacttaacattaattttggttttatattcataattatagttttactttctgtgaactcttaatatctgattgcttcttttaaatgacagatttttttttcacatatgccatatatcttctggaatctttctgagaaagccaattataatttgttcttgaacttttgagtttttgtttcctcccttatcagtatgtgtattagtcagcttgggctgtcataacaatatactatagactaggtggctttaataacagacattaattttctcatagttctggaggctgaaagtcctaaatcagagtcccagcatggctagcttctagtcagaactctctttctggcttgcagattactgccttctttctgggctctcacatggcagacagagagaaagaagtatttcttcctcttcttaaaaggccaccaatcctattggttcaggaccccatccttatgaactcatttaaccttaattacctcataaaagccctatctccagaaacagtcacattgtcaggtagagtttcaacatgtgaattttggaggaacacaattcagtccatagcagtatatggtctttgtttttctcgtttctcttgttattgttttgttcatcttcctcagtgcttattgtttgcacatatttattaacgaaggactaaacatattaatgtacatggcttcttttggttttctctgctatcacatttctacaccctgaatgagtgtgctgattgcaggtgccatatatgtggaaaaacatggagtatggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacaccccatctctgctaaaaatataaaaataagccaggtgtggtggcaggtgcctgtaatcccagctactcgagaggctgaggcaggagaatcacttgaacctgggaggcggaggttgcagtgagccaagattgcaccactgcactccagtctgggggacagagtgggactctgtcttaaaaaaaaaaaaaaaaaagagtatgtcattaactttttaagtcataaaaatctgtgaagaaacaatatatgggtgaaatattttaaatgaaattacttgtaaattactgtggtgacaacttgtagtacatgccttgtagcacataaacaattagtgaaatagttgttgatgtaaaaaccaccaccgcctcctaacatttattgaacatgtctcatgtgtcaagcactgttttgagtacttaacgttcattaactttgttaatatgcacaagaatcctgtgagttttataccactattaactctattgactacatgttgtagattaggaaactgaacgtaaaacaattaacagacttgcccaaggtgaaacagctactaaatgacaagagccaagattaaattctgtagtctggctcctgagcctgcacatttaattacatcacattgaaaatattataatcacaaaaatgaattttatctgtaaaaattgaaaaacttactggttgttttatagtcactattattaaaatatttattttaaacaaattcagtagtaattttcttgagaagagttactcaaataagatgtgtcagtgttactttctataataagaacattaggcctagctctacccccagcactaccgccaactagttctattaatttgtttaccttctcttctcttcagttttcttttctgttccatgttcatttcattccacaaggaatatatattgactactacattacaggctctattataagagcattggagacattaatgaacagaagaaagagatactttcttcagggttcttatattccagagggagacatagtccagaagtaaatacaagctcaatatagacttttgcttccagcaatgaaaacagcttatttctaagcaattcttccattgagaactggaaacctaagcaaaacataaaatatcatttgttataaagcatgcgagagctactcaagtgagatttacagacatcaaaatctggaaagaatggaaacacctaaatagatgatcttgccagctgaagctgcttttccccttagtgtttttaattccaaagcatctattgaaaggctgggtggctgagcaggaagtggaagctgagaggttgagaacacaccaggattgtcaggaagcgaaacttagaaataaggcctgccaagagacaaactccctggctttcagttgagatgctgaagggctaggagttaagaatcaactagtaatagcccaggcctcagaaggatggaagaccagttttgaataaggtaggccttttaaatactttgtcccatagcccagatgaatgccagaagcaaaagaggacatactgatgattcaaagcaatgataacgattgttgaagacattttggtagaatagaaggcaagggaggaaaataccagtcctgctaagggttgaatgattatgaggttcatactgggttggaaaaggagtaaaagcaggagaggattcattagcccaggagaatgggaatagcttttaaactagaggtcatggtgactggatacagaaagttgtgatcaaaaagctagtttttccagctgaacagttcaaaaattgataatgataaacttcagagtatggcaaagtcaatgggttgctggagtgaaggaggaggtaattaaacaagaagaaactaagaaattgtgtggttaggtcgttggaggaattatccaaattggatagtgaaattgcaaacgatgctagcaggagtaaaaattgagggaagtgcaaagcctcttagaatcagaagtatttaaaacgttatattattagtatttatttaaggagattttaacttcaggcaaaacattcagagggaaaaaataaaaaccatttatcccttgtctaagggtcaatttgtttctctcacccccttcaatttttttattctttaatccttcatttaagaaaaaaatacaatttgaggaaaaaggatcttttaattactttaaaaatccagccaagtattgagagtcgacaaccttaaatttcatagctattattttattataagtaaattgctatgcttcacagtaatttctgaccatggaataatgacctaagctcactgtgcaacatctggtataccctatgttgactaaaaatcaattagaatttttaattatttttgcaacatctgcataacaatctaattcaaagccaaattaaatggtccttctggtgatggtgtataatgacacattcataacttaagaaaactgccctttcccagagcataagacttgaaaatattcagctcgcctttcctgatttagttgccagattatattgatatagttaatggtacacactgttatattttaatagattgtgacaccaaatataagaatcactttttaaattttctgaacacatcttttgactctagcacttaattttcttatcaaactatttttcatagttagccaacagttttaaataatcctcatataattaactgctgataatataatgttcatccttctggcttatcttgagctgttgccagtgctgtttaaatcttctcatgaggagagtcagatgcaaacagaaatataatagagtgaccagaaactccagagacaaagttggatgctcatttctaatcaacacagattcttttttttttttttttttttgacttatccctgaaattttattattaaaattacttgtttgacattgtttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatgtgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttccgaaggaatggtaccagttcctccatgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtctctatttgattcttctctctttttttctttattagtcttgctagcggtctatcaattttgttgatcctttcaaaaaaccagctcctggattcattgattttttgaagggtttttttgtgtctctatttccttcagttctgctctgattttagttatttcttgccttctgctagcttttgaatgtgtttgctcttgcttttctagttcttttaattgtaatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaagtcactgaggacttgctttatgaatctgggtgctcctgtattgggtgcataaatatttaggatagttagctcctcttgttgaattgatccctttaccattatgtaatggccttctttgtctcttttgatctttgttggtttcaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcttttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacatagatttggtcttttcacatagtcccatagttcttggaggctttgctcatttctttttattcttttttctctaaacttcccttctcgcttcatttcattcatttcatcttccattgctgataccctttcttccagttgatcacatcggctcctgaggcttctgcattcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccgtgtgaggtgtcagtatgcccctgctggggggtgcctcccagttaggctgcttgggggtcaggagtcagggacccacttgaggaggcagtcggcgggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctctacccagttcgagcttcctggctgctttgtttacctaagcaagcctgggcaatggcgggcgcccctcccccagcctcgctgctgccttgcagtttgatctcagactgctgtgctagcaatcagtgagactccgtgggcgtaggaccctccgagccaggtgtgggatgtaatctcatggttcgccgctttttaagccggtctgaaaagcgcaatattcgggtgggagtgacccgattttccaggtgcgtccatcacccctttctttgactcggaaagggaactccctgacccctcgcgcttcccaggtgaggcaatgcctcgccctgctttggctcacgcacggtgcgcgcacccactggcctgcgcccactgtctggcactccctagtgagatgaacccggtacctcagatggaaatgcagaaatcaccgtcttctgcgtcggtcacgctgggagctgtagaccggagctgttcctattcggccatcttggctcctccccttctctaatcaacacagattctaatcacctcagatttcagtttttaatccttgattaattctaattacctagaacaatcatttttatttctctgtgataatttttgacatctctctgttcttcaacaggatgctgttatttaaaaagaaaacaaaaataaaactttcaccaaaattgcattaatctgtacatgatgggtacatgtgattgatctctgttgtttgcattctacatataattgcattttggtaaacagtagctacttttcaatgctaaaagctcagccattaattttctgcagtatagaattctcttgaaatatttcactgtttctcactgctctaattgctttaggaatttcctttaatacatattttgtatatatttttatacgtattttaagtttttctaggtaaatgtaagtccatgatttcttctactatttttggagtttggaattatcttaattttgtcataaatttctgtgaatatttgttttgctggtacaaacaaagatttgataattttctaagcactcccagaagctttgaataaataattttggtaaccacatgatgatatttatgaaatacataaagctcttaaagtttagggcaacctaaaccagtgtgaatcagactttaatgtgcatacttgtcccctggggatcttgtgaaaaaatcagattcagatttagtatgaaggaggtaaggtctgagattatattaatacatttctaataagttgtcaggtgatgcctaagctgctagtacccagactataatttgagaaaaaaagaaataaataactttatgttttgatatgtttatttttatccagtaaaactgtattttagcaagtttattaattttctctacttgtaggttatatgctatcactctgtcctttcaccatagtactttgtagaaaaactgtctaatcttgtttatccagtttttcatcagccctgctgggactatatacaatcaaatttttgccccattactttccatgactgttttcttgatgttctatgtgaacttattcatctccaaatcatggctatttatgctgactggttataggaaattaaggagtagaggacaaagccaaattttaaggagacaaggagcactctacatcagagtaattgtggtaagaaaatctgtggtactagagttgttgacatttaaggagctaaacatggtgttgggcagggaggaaaatcccatgtgccaagaaggatattgtgaaatgagcaccttctgttacacatgaacatgttctcatgctgctagataatgttaaaccatactaattgagttcatgttaatccctcacccttactcactgtagttgtaactccttacgatcaccagatatatatcatatatatgatatatgatatatatatgatatatgatatatatatgatatatgatatatgatatatatatatatgagctatacctggtcatggtcatctttatttttctcttagtcaattgtgaactaggggataaggtgcaatgtgcagcatgggacagtatctatttaacagctctttataaacacacatctgtgtgtgtgtataaattgtttatatattatacacacatacaaccataataatggtttacaccagtttctgcagtttgccttcccatttgatcaccgaggacaatgtatggtcaatttctatccataaccattatccgttattttccctttcgtctacttcttatttgtcctgaaatctttctgcattgcacctaactggtgaaaagctttttcttgcttctcccacagactaaaactctatgaaacattattcatcaacacaatgctactagtatctctaaagtctttagttatgaattcttatctgtaaagtgagtgaggagatgagactagctgaatatctgataagagtatttactcctcaggaaaccgagtattcatacttatattcagagttgaatgcattagtttaaataacaagatattacttgcgaattttcattttcttgaaacaacccacagcaatactttatccttttataggattttgttttgttttggcataattatgttgatactttgaaagtaaccttaaaagcaataataaaattaaagggtatttattgatttcatttacatttttcttgacttttttattcatttgagatctattgtcttatccccatattaattaatcaaatgttaagtcttatattgggaattattgattatagcttcaaaaggaggtttgtttataatgattttgtgtatcccttttccccagtgacttccactgtaagttcaggttgtttaataaagacattgaatattattgatctatgaaatgtcatgccaatttctaattgcttgatttcagtgtaattccatattatatttttattcattcaattgttcattgaattagttgttcagcaattcatatcaacattatgtattatttccactagtcaatacaatgcaatggatatagctcaattgtaggattattatcacagaaatgtatccattttaccaatctctgttattttgtgtctcacaaatcattcttgcattgtaaaatggaatttctgataataagtatatgccacaaatctgtaagattacttaattgattcctatgtttttcatactgcattttaagtttcttttgctttttgtttggaaatccatttgctcaaagttaaaaaaagcaacacaagattgtcctgaatggtattgcctaggttgtcttccaggtttttatagttttaggttttacagttaagtctttaatccatcatgagttaatttttgcatatgatataatgaaggggtcctgtttcagtcttctgcatatggctagccagatattccagcaccatttattgaatagcgagtccattccccattgcttgtttttgtcaggtttgtcaaaaatcagatagttgtaggtgtgtggtcttatttctgggttctctattctgttccatttgtctgtgtgcctgtttttgtaccagtaccatgctgttttggttactgtagccctgtagtgtagtttgaagtcaggtagcgtgatgcctccagctttgttctttttgctttggattcagccattgaggaagacagtgtggcaactccttaaagacctaaggacagaaataacatttgacccagcaatcccattactggatatatacccaaaggaatataaatcattctgttatgaagttgtatgcacgcatatgttcattgcagcactattcacaacagcaaagacatggaatcaacccaaatttccatcaatgatagactggataaagaaaatgtggtacatatacaccatgggatactatggagccataaaaaagaatgagatcatgtcctttgcaggaagatggatggagctggaggccattatccttagcaaactaacacatgaacagaaaaccaaatagtgcttgttctcacttaatgggagaactaaatgataagtgggaactaaatgataagaacacatagacacatagaggggaacaaaacacactggggccttttggagggtggagggtgggaggaaggagaggatcaggagaaataacaaatgggtatgaggcttaatacgtgggtggcaaaataatctgtacaacaatccccattacacaagtttacataggttacataggtaaacttgtgtactgagggtttgttgtacatatttctttgctacccatgtattaagtgtcatgattatttcaggacacttgtacccctgaccttaaaatataagttaaaaacaacccacaaaatttcatttttctctttctgtctcttgtataaatacataattagttcaattaataaagggtacattttaatagaggaatcaacattatatactctttatgaaagaaaaagggaattaaatttaaaaagaaaatattctgtggcaacataatcctagataaccagaagtacatccttggtctaaatagctctgcctgacttgaacattattatctacttcctgtatcatcttacccttgagttcaaattggaccttgtttggcagatgcttatttttctcacaccacaacttacattcccttttgggatctgtgcaatttgtacttgatagctgctcttgctcaggtaaggctttatgatatttttccagtcccgtttcctaatcctcttccctccgtttcctgataagcccatctcaactgtttatttctgctcaaatacattaactattccaaagtctgtactggggcttctaaaaaatagaggtagacttataggaggatccaatcctgacacttaagataattctggtagtgacaataattatgtttttgctcctttatgttactctgatattagtcattaaaatatttaccaagcatactttatctttattttattcaaggtaaggcaagaaacagtaactcattcaaagttgctcggttatttgagaatgcaacatgttgcagaaatgaagtccagctgggcattctggagacaaatgctgagacttctgagatattgaaaaccattagggaaagaaattatgactcttgtcctcttgctctgttcctggggtcaccatcgctctgcctcatactgccttttatgtttgctctatccagcctcctctcaggaggaacttcctctgcttgcattcgatttttgctctgcaataactaaaactcttaaggaacctgattatcataacataactctgtataatcaaatgtccacctctgttccaatacattgtagcagaaggaggaaatgtgtatgttttaaaacatcaaaaaaaaattagtgaaaaagaggctgattgcagacaagtacccgaaacatgaccactgtaatctgccattttaatctatgtcttaataataaagtgatacatcagtcatgttttctttattgacaagaacataggatctcaaagatcttgatataatttcaatattgatgatttaagttgtttcagacaggacagcaattgccagtgaaaagcaaacaacaataagttgtttaaagtgtgagaaaactactttgtaaattaatgtcaactgaaaaaagctaagatgctaaggtgtgtattctttgaaattatattggttgtacaaaaaataaactttgtattaaggctattttaatattttcttatattttccacattattgtaaaagttgaatattagagattattaaatgatgtaagcatctcgtgaacaatatttagtaaatccttattttatgaactacaaataaaatctaggacttaagacatgggttgtttaaattgaaaatgctacttgaatgaaatcagaatgactcaaggcatcgcttctacactttttggctaaaatcaagtgtaaaatgactcagggatagagtcaaggttgcaagagttttcctacattaatatggagacagatgaaaaagacaactattttttttctgcttatattgttgtaaagattttaagttttgaaaaaatattaaggtaacaaatatcagctttgttttttccttgtaaattttttttttacataggtgaccagagtttcatgccattccttttgtaagaactgttaatatagctaaggaaaaattataacagtttctcaagtaacttcttgtgtgttttatcataaaaacccatttaagtgtttctcagcataaggcaattttaagaacttgcattgttttaagataatacagtagccgaatcagtgttatattgtgtaaattttagagtatttttatcttcaagttatttttaatatatgtattgaattttaggtatttaacattgtactttcttctacaatatccctgtagatcattttcatttgagcacactttgagtttgtttattgtataaattcatctctttataacttttgtaatgtaataagggattctttggtattaagagaaactctggatctgagcagggctgatgtggaaaatggggcttgattccaaagggtgatggcagctatttcactgctctctctacagaagggcagttgcccagatagggtgtgtgtcttcaggtctcagcagcttggtagcaagaaactttctctcctgttttataacaatagttacttctaatatatactttgatattggtcttattaaaactcttttaaaaagaaatgtacctaataattgacaattctcattaattttcatttgatctaaaataagtgcactctccttgatattttatgctggcaaaacaaaataggttgtagataggatccattaaaaatgatctcttcatacatatatctaaataaagaaggagtaattctcatttgtgtttcatttatgatttatctttagtgttcttttttgtataatcaatttcgatgtccctttacattgatttgacttaaaagtctataattgtatgtgcaacttttcaataacatgtttattttgttagccaaagcaataaagattagagatgaggtaatccctcccaattctcccctggtattcctcaccaacaattttgtatcatgatctaatattaatcaagatgacattgtgatcaacaatcatatcaaaataaaaagcacagttgtgctgctgatagtgattatacataaataaatatcaggagattaacattgtttatctaaatactgatggggttcaaaacatactataccccaaatatggcaccttgccatttgagaaaacagtagaagtaggaaggtcactctcaccttccccccaacttcgttccccctgaagcaagctttaaaatctagctgacctttccctgaagtaggtcctaagacccttattccagaggtgcttaccctatacccagagaggaatatccttatccctgaaatgcaggagacaaagaagaatctacacaaacaggcctatggcattcccccattagtttattaccattagatcatgaccccttgtccatcatacttctccacaaatacccacttattcatcaaactaagaataatatacagattattttatatctttggatcttcatttctgaagccttctgtgtcatgtaaaacttaaatttgtatgcttttatcttgataatttgtcttttgttataggtgcctcaaccatgaatctacctatgagcaaataaaagataatactttttctcctcacaataccattaaatattgtattacataattctatgggaaagtatatctaagatttgtttgcagctggtgttggtagattatttcccaaaagattgtcatgattcacaaccccaacaacaatggatacagtgctatctttttaatccttgcctgagtgcatgttgtttttctttataacttttctctactcagaagaataaaaaagtcatctcattgttgtcttaacttgtctcttactaacagtgagatagattatctttagatgagtatatggatgatatataatttctgttctgtgaaaatcttattcatattccttacaattttttatttatcattttaatacaaatttataggtacttcttgtcagacatttatttacatgccagaagttttgcacatgtatctcccagcctatcattgttttgtgtgtgtgtgtgtttttttactatttagaaattagacttttgtaattaagtaagcctatattttgtttatggatttgttcctgttttgcttaataagatcccttctaattcaagtttacttttttgaagttttttacattgaaatgtaaaatagtacccagtcttacaagttaaaacccagagacacagagagtttaataatttgttgggtaactctatagctctttttagttactagtaactatgctataatgatcataactattaataatatctggcatctcttctgaacatctgctattaggtactggcaaccttttatactctatttcttttttgagacagagtcttgctctgttgcaccacctggagtacagtggtacaatcatggttcattgtagcctcaagctcctgggctcaagtgattctccaccttagcctcccaagtagctggaaccacagttatgtaccaccatagttagctaattttaaaattttttttgtagagacagggtcttgctatatttctcaggctggtcttgaactgggttcaaccagtcctcccatctcagcctcctaaaatgctaggattatatttatggccactgctcccagccctctatttaaaggccctaaatgttcttcagaaaaccacccttgatagccatgaattgttgctctcactctcaggtccaagctgattttgactggattaagctagtctccacatctcattcccagtacaattagagccagtggatctctagggaaattgagatgaaggtagctaaaaaggagcctttcactattcctcttgatttggtgatgttaagctgcaacacttagaatgtctgccactgtatgcctatgattatggaagccagctgaagatagctaatacccagaagaagcatggcccaaacagagatgctgtgatttataagatgtgaatcaagggtgctttgcttgatgccttgcttcaaaggcaacttgccctttcatttaaaagagccacaagatttccttttttgcagtaagccattttcagatggttcctctttccttctccctgtacatcatagagagtcatcagagacattggttaattatgaaatgcaaactatggaatggaggaagaatctcatccttaaatgtcctgatgcaatctcaagtcaacttaacctaaattatattattatatttaatttacaatataaacacttaccttttactcttggagagtaaaaggagagaataggtacaatgaagaatctacatgtggtaactttgatactatccaaaactttttctaagccttttaactttgtagtgtaagtaatatgacatttttttccctatactgtgtccttcctaagttattttgtaacatcatcatggatcttacttttatgcataaccttttagtttttaacagccaggtgtggtaaggaataaaagttatttttaacattgacctcaggttctttcttatacaaaagcattctgtaattggaaggtagctgagtagacagctttagccatgaaacatgaggccttgaggtcatgggctgaaagagatagttgaactctgtggcatcagaagttatagtgattagagattggggcaagaacgaagatagaaatagaaaatgagggactttaaaaagaggagtttttgatattcagtttaagttattttttgtgctagagaaatatttttagaaagggcactctgtgcgtaggatggcatgttgttcaatgtattgaagcaaatttagctgcagtaggtcacaggtgattcctgataatgcttgaaaattacttttttcagtggaagagaaggaacttaggttactgtctttggtccagtctgcttgcattttggtaggagagaatgctattctgcaataaatagaatgttcatttttatttggaagttatctttttaggcaccagtgactaattatataatcaacagaacctcattttctgaagcagtactgtgcatgttatttcactaaattttttaaaaggtgataatacaaccataacacaaatgtaaaaatgaaagaggcacattaaggtttattgaatgctatgtcattttttatttaaaggtaagttaacagctatattcattttagcaaattaggccattgtttcttttttctattttgcttcaggtatgactactgtatatgccacataaagtagagcatcttaaaagaaaaagtatatatagtatattgatgtataaattaaattgactgctctatttcagataatttttgccaataatgcattttccatggaaaaaacaggctcctttccaaatggaatgaaacacatatcaacttgccagtgcatgaacagtctgtacctagtttggaaaattataagtaacgctggatccaaaacaaaagtatatgatataatgtttaatattttctcaattttttgacattggttggcaattttcctttaaatagtcattgttactgttcttggagaaaacatcagttgtggtaaagcacttttccaaattttgttaactagcttgaccttctttagaaatgacagaaggtagaagatgatactgcatttttccactcacatgtgtgtataatgcttcatatactgctaaatctttatagaagactaaacataaagagattgtgttagaggcaaataacagagtagatattgacatttgggggggtggtaactgagttagaaaaacaccattttgtctgaggtttcagtaactaactgtttaaacatcttctcagctgccttttgtaaagaaaaaaagcaatagtttttcctatgattttttctcccatatttgatcttcattatgatatcttgactactttttaaaataatataattgacaatgaaagacaattttgttggaaaatctggatttctatgatttcttttaaaacaatttgagattgtagtacctgtgaagattgatgttaaaaataattttatgtttcaaaaggtagcaataaattacgaacaacgtgagtgcagtttctttcacctaccatttggctcattaaagaaaaaaagtacctgacattcagtcattttatgaaaaatcatggactaacctttgtagaaatgtaaactttaacaagattatagtatctttgaaactaggagttatgtgacaaccaagttctgatgtccttataagcactctactggatgaccccctaacatgtagtattggccaaatttgtttacaatgtgtttattttgcatttcttcattggatttttttttatactagtccaactagcatgcctggtggtgtgttggaggaagcatggctaaatgtactcttatcgtttttaaaatgtcttgaatgaggcccagcatttgaagccaacttttgggaaatgcagttgggttactgacattggagccttacaactgcagtggaaatatatgatgacttgaaaagaaaatgggaaaacaatggtgacatttagaagaaaattaagtttggggttcagtgttgcttaggaaagtattgttctaatatatagtaaaaatgggagagatcaaagaatctcagtgaaaaaaaatcatagaattttgtgctcactatttgattgaggtagtattttctattcaagaaaatgtgtcagaaactagatagggaaagaaaaagaaataaaggaaaggaaaaaggaaggaaagaaggaaggagggaaggaaggaaggaaggatgaacggacagacggacggatggacgggaggaagtgagggaaactagacagagttatagggcaggctctcgacttttggaaaagggaacttaaccatttctaaaactcattcatcaatattgttcactgatgtcttcactttaaaaatttattggtggctaggaaatatattgtaatagtagtgagtccaactagcatgcctggtggtgtgttggaggaagcatggctaaaatgtactcttatcgtttttaaaatgtcttgaatgaggcccagcaaggtggctcacgccagtaatcctagcactttgggagggtgaggtgggtagatcacctgaggttaggagttcaagatcagcctggccaacatggcgaaaccccatctctactaaaaatacaaaagttagccaggcatggtggcatacacctgtaatcccagctgctcaggaggctgaggaaggagaattgcttgaacctgggaggtagaggttgtagtgagctgagatcgtgccactgtactccagcctgcacaatgagagtgagactccatctcaaaaaaaaaaaaaaagtcttgaatatttaacaataccttttgaaggatccttaaaatagatttcctgacttttacatatgaatgatgaaagatttttttttttttgaaatggagtctcactctattgcccaggttggagtgcagtggtgcgatcttggctcactggaacctctgcctcctaggttcaagcaattcttgtgcctcagcctcctgagtatctgggactacaggtacgtgccaccatgcctggctaatttttatattcttagtagagatggggtttcaccatgttgaccaggctggtctcaagctcctgacctcaggtgatctgctcaccatggcctcccaaagttctgggattatgatgtaagtaaccagcctggcagaaagattttttagaagtataaaggctttgttttaagacaaccaaagatgatcatacgtctcttgctaaacatattaatttcatccatgcatctcatagcaagcattttttttgcatttaaattcactcactctaaaatatatcaaagttcttattcttggagaggtgaaatataagcactgtcaaatcaataaattaatttgtaaacacttatatttgcataagttaacctcaacaaatcatttttgaaagtgacagaattgtcagaattggtttgatttatgactcttgcccatgataaggaaatagtaccaaaaagattaaaagggactgcttttgaaacatttattaccctcctccttctttttttttccaaatgaaagcatttaatctaatcatctccataacatatgatgtatacagtggtgatgaatatactgacgtataccatgcattcagattcctatttttagagattacataagaaagaagtagtacattcaacttaaattcttcttagccataacaattattatttgaaatcttacccctagaatagttttcggtggaaaactggctatatgaaataaaacattaccttttcaatcatttctatgatgagccagtatcttagttcattcaggtggctataacagaataccataaactgggtagcttataagcaacagaaatttgtttctcacagttctaaaggattggaccatgagcaaggtgttgacacattccatgtctagtgaggcccacctgctttctgtttgatagatagtgccttttggcacggtagaagggaacaagacagctatctagcactaatcccattcatgacctaatgaccacccaaaggcaccacctcctaacactatcaccttaagagttaggatttcaaaatacagattttggggaggacccaagcattcagaccacagcgtttcaccccgacactctcaaattcatgttcttcttacatgcaaaatacatttgttctactccaacagccccaaaaatcttaactcatttcagaatctaccttaaagtccaagttcaatgtctcatctaaacatgatctaaatcagatatgggtgagactcaaggtacaattcattctgaggcaaatttctctccacctgtgaatctgtgaaatcagacctgttgtgtgtttacaaattacaatgatggggtagacacgtaacattagcattctagaagggagaaacattgaagaagaactggggcaataggatccaagtaagtccagaataataaagcttgagaataatctttgacttgaggatctgccctctgggccctctggggtcatagccctgcccacatggctttgggaagccccacccttgtagtgtcttcagtgtctctgtgcctgagcctccttgccatgctattgtgattgtctgtgatggcccccacctctgcagcagctctgtgcctgggtcttagcgctcatggcttttctgggcttgaatcttgcgctggtgatgatcagtagtctccgagcagccctgtccttatagttccatggagcatttccctagtggaatgtctctgtggagactctgacaatgaggcaattttctttctgggccctacatttctccagggagtccttctaaatctagatagaagcagccacattcccacaactttgctgggtacagtgcatgctgtacctgggtcagctggagccatcctaggtcagatgagctggtacttgggtcagctggagccatacctgggtcagccatacctgggtcagccccatacctgggtcaattgaggagtacagcaacagagtgcaggaagcagagcccatgatctgaggtggtgctgggcagccctggcccctcctttgaagttgttctgccctaagacccagtactctggccctgtgataggaggggcagctcctgatgatctttgaaatgccttaggggccattctttcattgtcctgatgaatagcacctgactattcataccaatttctttatcaaatagtcacttggccacaccttagtattctttccagaacacactttcttattccttttaatatggataggctgagaattttccaatttttaaagtgttgctttccttcagattaaaatattttaaattctctctttttactgtaagcaaaaataaatcatatttttttcaaatgtagttcactcacaagttctaccttccacaaaatactgggactcaaagacaattcggccaagttgtatgccactttataacacttttaggaggacacaaatattcgaattagcgtacccattatatgattaaaactaaaattctctttgggtcatatgccccttagaaatctttaaagaaatatatggatgaaaagtttagaatgattgatcaagaggaacctagattacaataagataaactcatactatttcactaattatactgtaacatgtatttttcataatggtttgttattcaatcacaaaataatctttttagtatggttcctatataaaatgaaatgtaacatttatcctgtgatatttaaaattgtcacctgagtagtatgtgaaagggatttttttctttaagcaatatattaagcatcaaagacacatgcataatttgaaatagtttcagttcatttcctcctttttatcttttctaacagagcatttatatgttgttcattactaatcattcaagaagaaaacattctcatattcttatattaacaggaaattgaatatggaccattacaatgagggtctatagtaatttaatatgacaaagaccgttagaaagcttcaaaattatttttaaggaaaacactaaccacctcatttatttgtgattttttttttttttgtaagggaatccaaaagtacaatatagtgatattgtgataagactccctatccatggccgggcgcggtggctcacgcctgtaatcccagcactttgggaggccgaggcgggtggatcacgaggtcaggagatcgagaccatcctggctaacaaggtgaaaccccgtctctactaaaaatacaaaaaatcagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaaaagactccctatccattttgagaaactacaattgagtagcaaggtgtcagaaagtacaatcagttcttatatcaagattcttacatggtagaattgctggtttagaaaaatcagttcaaatttaaacgataatctgatcaactccttcttggaaaaataaaccttattattcataactttttaaaatttatattagtcaatcattatttattaggttttacaaaaaacataagcaaaaagtatagtaaactgttgattacattttacaatactctcttgtgaacaaagaagaaataataatatagaatgcttacatgcttatgttcatgtatgaagtttcctcagttgtgttgggctaatgtaaattgcccaaacttcttctaaatggcagaaaattagatcacaatgtggatgaacaaacagaaatatctctacatcattactttatataaccagaagtataagcatatattcccgtttgaagtattttgttaacaattaactttgctaaatatttgtaggtattttattgataaatggaaagtgctaatttttcaaatcaattagaatatttcaataaacaataaaagttgatttctaatttctcccaatattacacctggtaaattgctccagattttataatacaaattggagcagatgggactgtgagagtggctctgactgtggcaaatcaattttctttaaacatttcctgtgccagggtagggcccactcccatcatgtcttccctagagaacgccaccgcagcttcacccttccttaaaaataattttgggctgggcgtgatggctcacacctgtaatcccggcactttgggaggctgaagcaggtggatcacctgaggtcaggagttcaagaccaggctggacaacatggtgaaatcccgtctgtactaaaaatataaaaattagctgagcatagtggtgcacacctgtaatcccacctattcgggtggctgaggctggggaattgcttctacttgggtggcagaggtttcagtgagccgagatcgcgccattgcactccagcccgggcaacagaacgaaactccatctcaaaaaaaaaaaaaaaatcctttgaacactggggactctgtgtgcttttctgagtttacattttgtcatctaacctcaggaataataatattccctcccattcttcttcagtttgcataattatgactgtattaatgtttctatcctaattctcaaccaacttggcagtcaaaaaatatatattaaaaagctcagagcgtttgctatgaaaatcaggctagaaaatggccaaattcctataaaagctgtaacacctaaattctaactgtttttacacgtaattgcacttgtttaaaattttaggttcagtgggtacacatgtatgtttgttacatgggtatattgcataatgctgaggtttgggcttctaatgctctcattgcccaagtagtgaatatagtacatgatagatagtttttcaaccctttccctccattcaccctccccatttttggaatccccaatgtttgcatctgacaaaggactgatatccagagtctataaagaacttcaacaaaacaacaagaaaaaaaaaaaaacaaataaccccattaaaaagtgggcaaaggacataaacagacatttctcaaaagaagatgtataaccagccaaggaacttatgaaacactagcatcatcactagcatcatcagaaagatgctaatcagagtcacaatgagatgccatctcatacaagttaagatggctattattaaaaagtcagaaaataacagatgttgctaaggttgtggagaaaatggaacgcttatgtgctgttggtgggaatgcaaattagttcagcccctgtgaaagcagtttggagatttctcaaagtactaaaattagaattactgttcaacccagtaatcctattagtggatattcaactaaaggaaaataaatcattttaccaaaaagacacctacactcatatgtttatcacagcactattcacaatagcaaatacatggaatcaactcagctactcatcagtgatggattggttaaagaaaatatgttatctatacaccatagaatattacacagccataaaagagaacaaaacctttacagcaacatggatgcagctggaggccactatcctaagcaaattaacatagtaacagaaaaccaaataccacacattatcacttataagtggaaaccattgggtacacatgaacataattgtacatttttgtacatttttattctatattcttgccatctttatcttctaggttataggaagcattatgatctgtcacttaagctatattagattttggagtatgtgttttaaagtaattcaatttcctgtatatgtcaagggaagatcacctaattctgacccttaaaaagccctgttttgaaaaattttaatagtcattcacacttctagaaacacttcttcacaaactctagtttctttgttcttgctaacatcaattagtagtaagaattatataatattttatcaatgtattctaagagaagacaatgcctccaagatagtaaagacatgtggatcaaaattaggggtaaaattccaatatgtattataaattttaataactatttgaaatcattttatgtttatcatgtcatttaaaaatactaccagtgtttataaaattattcagtgatattaaagaatgataaggcaggcattaatcaggatcatcatgataggtatagaaaccactgcaatgaggttttgtggtggggagagagattgggctcgactccaaatataacaaggaaaaatgataatttatagccaaggaacagtgtgtgtggcaaggggtcagcggatggaaaattgctaagaagaaacatgaggagtaaggaggaattctggctaaactgacataaaaggattcttgctgaagacaggccaggagatcagacaacacctgtgggatggggtatggtggaggatgaggaacccgattagattttgagagtgaccagatactagcatgaagcagtattcttgctagaattaaacaatgcagaaataaacatggaagctcaaaagtcaaagcctggttgagcaaagagttcagaggaggctgagtaggttcagtcgggagagaatattgtcatcatgtttaaaattcattgctctgtatatctcaattatgtttgaaattttattcatatttttaaaagtaatgcaaagaaacagctttcaccattacaaaatttggctttcagcatataaaaaacaaaagaagacctctaataccagcagaactataacagaaaaacagctttactctgaatattaaagtgcaattataaaaatttaaaaacaatcacatgcacacacataatgataaagtagatctacctgctttactcgtgtaaaataaatatctttatgtctcagattgaatcgctctagtgtttattatatctgtcttgtattttagatttttattaggaaaaattaaataaagggtttgtaagtctacatactaatattctgaagtatttgcttaaaaaagaaatactttataaaagctttatagttagtaaatcaaactattggttgaaaagtgcaagtatttttaaaactaaatatatatgtttacaatcctgccctactgcctgatatttaatatctaaaaaacatcccgcaatcttaacaatctagtaatagactagatgactccttagtcccttttagcagttccttggggacctgtgggaagtctctcttcacaggaacatcttcatttgaagataagagctgttatccatgtgtgctctccatgaagggaggaggttcagagtttgaatggtgctaatgaagttccttgctgtgcaacacagagcacatgcaatttgacgttgatgcaaatgaccctaaatggtgtgatcacttcgtcagactgaatatactgttcctatagcaggtggctattctgcactggcagaaaccgttttaacactttcttcccatttgaacgcagctcttctaacagacaagtataacatattgtaatgtattttaatgatttaaaaacttatattaatctccactttagtaaataccacccccaccccaccaacaccaccatgttttcctgaaatttctatattcttgcttttatctgattagggaaaaactcaatccgtatgtatatatatatttttacttgtagagaaacacctaatatactgatttctcattcaaagattagccaatgtcttttcctggaagctgcctgagaagtaagaaaaaccgaggtgatacattggagttctatttcaatatgcttcttgatattttcctgtgtggcttctaatacccctgtcagattgaacagtgcatttttctgtaagtccatgctctttcctggaacctgactagatcctgcatgctaagattctgtatagaccttgatcaaattcatggacttatcatcacaattttgatttggaaaatgcttttatccttctctttttagtttccatcccatcatctatgtctcatttctgcttatgagctcttaatattacttgccttataagttaaaagtatacctttttaggtgctttcatttgcaaaattttagatatatttaattttgaaattcaaataatgtggtttgtattatttatatttgtatgtttcctgaagatttctgtcaatgttgtaagtcatctggtttgccagtttgattgctaatatttttctctgaaattcttgagaattattccttctcttttctaggtcatcatcctctttcctatttaataatggttaactggagaatcaaagtagatttctcataccccatcatccccaccacatcttttttttttttttttttttttttttttttttttttttttttttttgggacggagtctggctctgtcgcccaggctggagtgcagtgtagagatctcggctcactgcaagctccgcctccccggttcccgctattctcctgcctcagcctccagagtagctgggagtacaggcgcccaccaccacgcccggctaatttttttctatttttagtagaggcgggttttcaccacgttagccaggatggtctcgatatcctgacctcctgatcggcctgcctcggcctcccaaagtgctgggattacaggcgtgagccaccgcgcccggccatccctgccacatcttattaaacttcaactctttagctttgagtcacacatatttttcaatgcatcacattctttccatctctactggcactgatgtaggtcagaccctcatcatacctagcacagattttaggagtcttttatctccttgtcttcaactcttcgcttcctcttcaatctaacctttgttttccacccagtggtagctctttcaaagaaattttcttctaaataaaacctctcagagatacccatgacctacagatttagtttcaaatttttcagcatggtagataaggtcctctgtgacgttaagttgggctaacataatagctcctctttatactttaagtttcattgcaagcctcatgaagagtacttggagttcttccttatgactgttgtttcatgcatttgtgatttttgcggggagaatgggggtgtgctcactcttttttctctttctatacctggcaagcctctgttcatcttttaaatctcaaatatcattgccccctgaaaatttcccatttctctttgggtttcactaagtgattactcctgtgggttcccagtaaatgttatcgcaattcatcatttacgtttctggctgcctcagttcttgaagcagggacttggctgatgtataaccaggacgtgataagggatagacacacaggagacaattaacagatgtttgcgaactgacacaaactttttcattctttttaaatccttcgtcttgaacatatgttcttttaaaatgtattctccaatgtttcaaagtacatttttttgtgtgtctgaatagaattaggattataatgattttggaattaacttacttttgcattgtccatatccttatctgtctgtctgtctgcctgcctgtctatttatgtatctacattagctcaaggttttatatttattttagagggcttccttgaccttctgtaattaatgttttacacattatgaatgtaaccgtagcattcaataggtatactagataagctttctcaaggagaaaaaaataatattcaaattttaaatgataatttagaagcatgatataatttaacttttgaagtatgcaaatgataggctgctattccatcaaaataaaaataacacattcaaaagaattcacattctaacctatgaacttttccttttatttcaatgtaactctcatgcaattaattaaaactcagtggggtattgtggtgaaaattttaatatcatgcagttactttcattaataatatcatttctttggctaagtagaataacaattgagtttatccagctggaaaaagttagacaaagacacataggcaggtaactattgtctattaggtaagaagaaatgcagcttttcttttaacatatatcaaacgacatattctgcattttctaggattcctttaaactgttttatgtggtaactgtcagaagtttagataatttaggtagttatggagttaatagttttagaatatttctgttacaaaacataaatatctttgcgtaccacctataatgtcataaaaccctagactagaaatatctgtttggagacattaaataaattaaattgctaccttaagtaatatggtggattttaagttccaaacaagtcaacaaaaattagaattaaaacattctgaggttttttttactttatactttggaaatattaatcatgtagtctttgtatgtaaatgacagaaatcactatcatgaaaattagatagcagtttttttattaaaatagagtatttattctgcaagttattgcattcattatccaacagtatattaaaatgtactttgatcaccattgtatacttcatcaatgtgcttttgtgcttcattaattagtaactgactgaaagttaatgttcatcctgtgtcagtctgctctagatacatcattttgctattcaaggccaaatcacaaaatgattataaattaccagcagcatttatttgttttacttctcattatgacaaattcaaagatcaaactgatagcatatcacatacatagaataatacattttaatttaataagcaataggccaggcacatttctctatggggaataataaatgaattgattgaaagcagaaggaggttgtaagctttttgataatggtgcagagcttttacatgttgatttgaactttgaaaaaatatgtaatatccttgtctttctcatgaaatatgatgtattttagattttggtttcttgagggtactttaagggttatcttttcttgaaataacatttatttaggcctttagttacacagatttgcattgttggtagtcttcattcagatcacactaattttatttcaaaccatactcacttttgattatgaaacataaaggttgaaatccttcaaatctgaggcatctctctgacctaaatttcagatgacatttaagaatatgattaaacaaattttcaaataaaaacagctggagtgcaacagttttcgtacttttagatactttattttgccactggggaaattatagtaaattaagattaaggattctaagtgaaactctataatcctagtgggttgtttggtattggaaggtaaggaaaagattgttgaaagtcaaagacaaagattgagctctcagatcagtatacaccaattgtagagacaatgtagctggctatccaagttaatggcattagacctctgaaattaaacacgttgccttcagtatgaatctgtagtcaccaagcaaacttctgattatttgaccccctcctagtttttttttcttgcaaggagaaaatatagggtcagttatacaaacagctataattacttttctctttataaaaagggtggaggttacaaaagcattttgcggagacttatgaaataaaatggtgagaatgcaagtgaaaaagacattacaagacaccaaagactggctttttaaacaggcacaatctgaaataaaattgatatgagaatatgcctcagcagaagtgaccttgtcacaaagttttccaacagagctttgcaattcagtagaggtgactcactgaagaagatgcctaaatctaatttatttttaataaaatttattcattcattcacatgttgattggtaattcaacacatatttactacatttttattcaaagtattttgctggtcactggagctacagtattagccatacattccagaactttcttctcaagttgcttatagtcttcctacagcattgtagaatatagtcaatatatatttttatgacttctttccatccttaatttaccttaagtcctcgttcttgccaaccacagttctacaaacaacaacatttcaaaataatttatttaacagttatcataaatataatgaatcatatgtgcttaaataaaacacacatccagtaatttctaaattctagaaatttactgaaacaagattttaattcaaaacttcatcttgctatattataatttctttttttgctcaagttaatttacataagtgtcacttttggccaatgaaatatagtagctaaagtctatgcgccttgtttctccaaaatctttacaaatgccgctatttcatttaagaaaaaaaaattttgttacatattttgcaaaaagcttgaaggaaataaaaactttaaatcttttgcccccccaaaaacttctctgacatattttaagatggctattcagagggcctgcaaacagaagtatgcaaagctatattttatgggggagatttgcatctgtcgagaaaatctgccttgatgcagccaggctttctctgaggctctccctttttcaattttggaaagattaactgagaatctggcacatttaaaagtctgaaacatttaccatttattctctctgagggctgctatctttgaggtttcatctacataaaaagaccacctttgctagccaggcttcctctctcttcctcccataacctgtcttaccatcatcatctgtttttggccatgctctgagccccaattatttctgtaatctcaagatgttatataaacttctgtaccccattaagtggttggagtaattattctgtggttctcccctgtacacattaataaatttgtataccatttcttctattaatctgcctttgtcagtttacttttcagagaaccttcagagggtgaaggggaagttctcccttggcctctataggttccatcatagtttccaaataccaaaattaataatgatattttacctatacagtgagtagttttaagatgccttttgaggtatcaaattaatatttattattaatgtgtcaagcaatgtgttatttgtcacagaggcaagattgccagatgccagcttcattagagtgtaaaatttagggtactaaacattgatgatcactgggaagaattccagatgattgaagactgtgaagccaattgagttttgagcattaaatgaagtgttattaagaatgatctgacctcctctcatgaattgtttcttatgttttctctgttgtctctattgtaatttttgttcagtggaaattaaagtcactcaaggtctcaaattaaataataaaattgaaattgcacatattttctccttttgtggggaaagaggtactgagacaggaataatacatggtggttgcaggagaacagaaaattccaggcagcagtttcacatgacatattttggtaatgggtcctagagatgaaacataactaattttagtatgtttcatcatgttacataggcttcagtgggaaaacaaactctgtggacaacctagttacttattgcctttgaatatgaaatatttgactcagaaagttgacctttaaaaagtattagctttatatcatctaaattgagcaaatgtgtataggaaaggttatgtctcctcatggtcattctttatattattaaattttaatgatatgtttatttgttctcttaggagaaatagtcacaactaaaatattctttccagaatttaaagacttgaaaaacaaatatagttttaaaactcagtttacttgtaataatctaaaaacacaaatagcctaatgattacagagtgaagaagaaggacaattcttaaggcagtatttctggagggttatctgagaattatatgctgcttcttgcttgctttcttgatacgaactacaaattacttacaattccaaactattcccaagctcaactgacataaactacagttgtcccttgaaaaaacatggcattaaactgcgcaggtccacttatacttggaccttcttccacctctgccagccctgggacaacatggccagtatcctcctcttcctcggcctactcaacatggtgatgacaaggatgaagacctttatgataatccactgccacttaatggatagtaaatgtaatctctcttctgatttttagaataacattttcttttctatagagcttactttattgtaagaatacagtatataatacacgtaacatacaaaatatgtgttaaccgacttgttgatgttatcagtaaggcttcttgtccgcaagaaggctattagtagtttgttgttggttttttgttttgttttgttttgtttttgagatggagtcttgctctgtcacccatactagagtgcagtggcacaatatcggctcactgcaacttctgcctcctgggttcaagcaattctcctgcctcagcatcccgagtagctgggtttacaggtgcctgccaccatgaccggctaatttttgtatttttagtagagacggggtttcaccatcttggtcaggctgacctcccgatccacccgccttggcctctcacagtgctgggattacaggcatgagccgctgcgcctggcctattagtagttgtgttttatgagtcaaaggttgtatgcagattttctgctgtgtaggaattggcacttctaatccccatattgttccagggtcaactgtattggtttaaagttcatacttaaaatttttttctctttatattttttaatttaatttggctttatataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagttaatgaaaactcagggaagggaccagaggtaattgttttcttctttggtggatctgaactttaaccagaaaagggaatttcagagaccaacttcatccagtgttttggaagagatggaggggagagagaccttgaggcttctttttcagttcatcatgttaaaatgccatattttggagtatcagtttctgagccctaacattgtgtacatgcatgtatatgtgtgtttacgtgttcatcataaatttagaggctaaatacaactttaaggtgaaacgctagggtgtatgcctatgatgaattactatggagcaattagaaatagatatctacaaaccaacatgaatggttcccattaacacagttttaagtaaaaaagtatgatcaactcaccttaaatctgaaatgaataaagtcaggtgctgcataaaaatatttaggtcaacaatcagctgtacaaatgtatatgacagtggtcccataatattgcaacatcatattttactgtaccttttctatgtttaaatgtttagatacataaatacttaccattgtgttacaattgcctatagcattcagtacagtaacatgctatacaggtttgcagtctgggaacaataggctataccatataccatcagtcctcaacctttttggcactggggactagttttgtggaagacaatttttccatgaaccagggtcagggtgggggatggtttctggatgaaactgttctacctgaagtcatcaggcattggttagagtctcataagaggcacacaagctagattcctcgcatgtgcagttcacaaaaaggtttgcacacctgtgagaatctaatgccactactgatctgacaggaagcggagctcaggcagtaatgctcacccttgcctgccacttacctcagcccagtttctaacaggccacggaccagcaccggtctgtggactggggttgggacccctgccataggtgtgtaataggctgtatcatctggctttgtgtttggtacactctatgatgtctgcacaatgacaaaatcacctaataatacattttgtagaacaaatccccattaagtgacccagatctataatttaaaataacagtgggaaaccaaactagtataataaactcatttccaggccgggcacagtggggctctcgcctgtaatcccagcccgttgggaggctgaggcgggcagatcacgaggtcaagagatcaagaccatcctggccaacatggtggaaccccgtctctacaaaaactacaaaaaaattagccgggcgtggtggtgcacgcctgtaatcccagctactcgggaggctgagacaggagactctcttgaacctggaaggcagaggttgcagtgagccaagatcgtgccactgtgctccagcctggcaacagagcgagactccgtctcacaaaacaaaaaagcaacaacaacaacaaaaagaaacttgtttcccacccaaaagctggcagaaaataatttttaataatttcctgcatattatttatctgttttttgttttgaatgttgtatatttttctcaaatgattaccaatttcttagttttatatattgaactctttattgaataaaatctttgatctcattttatttatttttcccacttgggtaattgattaagaatgtattctctgctaggttacaataatattctcctgcacatccttttaactttatggctttatatattgcattcaggtgtttaattcacttacagtgcatatttgcaattggtgctagttggttcagcttttttcgcaataacaaataacttcaaaagctcatagacttaaaacagcaaaaatatatttctcattcatttgcgtgaaaagtgcaggtcaacactcatgggctctgccatcatgttttcatgttgtaactagactgaagaggcagaggcagcctctatcttagaaatataacagctgttttatcaaaatctgtccacctctagtctttaaacttcataaggtaagggacagagtctgtattttctactttctgtgaaacccttgtttatatctttcgctcatttttctatgtattgcttctgttttatcacaaatttgaaaggaaattttaaaaatgtttctatgccaatcttctgatgcttatacgcattttccgtatcttgccaactgtggctggttttctcactttgattatgccatgttttgatgaaaagttgtttatatttaaatggagttgagtttattaattattttcttcatagttataatttttgtctcactgagggaattcacgctattcaaaaataacaaaaattatctaatattcactaaaagagatttaaaactttgctttttacacttagatcttatatccacatagaaccatttattatttagctgttttaatttgttttgggaatatttgtgtggggaatgagatagaaatcgaataaactatttaaaagactaaatggatgagatctattcataaaatgattcagtgctatcttatgatgtatagaataaaatccaaactctttttctttcctacaagcgctgaatcctctggcctaccattcacactccagttcattccattaattcccttgcttattttgtcactatctgtggctttaattcagtttttcaagtattaaccactttcttttctctttccgtattatccatctcttacccaaagacttcctggttttttttttttttttgagatagagtctcactaagttggccaggctgaagagcaatggcacgatcttggctcactgtatcctctgcctcctgagtagctgggattacaggcatgcaccaccacacctggctaatttttgtatttttagtagagacagggtttcaccatgttggccaggctggtcttgaactcctgacctcaggtgatctgcccgcctcggcctcccaaagtgctgggattacaggcatgagccaccgtgccctgcctgacttcctgtttatttttgtgtgtcagtttaaatgctgtgtttttagggaggccttttctgcgccatctatttaaattgtcatttcccttcaatttctgaagctagttctgttttttacagaactcttatttttttcctttattttttgttcatttcattattactgatttctcttcattgtactcaagcttcatgaggcagaaaccatatacatgtatattttttacttttgctccttgaagcccatcaaattcctggcatttataggtgctgaacaaatgaacaattgaattatgtgtcctcatttccttcttactttcatctaattaatcatcatattgcctaggttcagtatcttccatattctcacattagtccatttttgttaaaaacttatgggcactgtcttattatataaatctatgctatttcttattgctactgccatattatagatctacattatttattaaattgtaagctgtttttttctcttttacctttcccttctacagttctatttctacacaatagatcttcctaattttctaactgcatggcttttctggttataattctttaactcttcttcatttgcttcaagaaaaaaacctaaatttgtaatatgtacacaatattctgttgattcaacattctattccagctaccttctcatttcttccactttttactgcataattttgtaaacgtttttgtaaatatttattttatttatattatatataaaatatttatattaaatacaaaactttatgttttgtataaataaacattgagttctattatctttttcgcatcaccaaatctcttttcctttctctctgtgtgtgcatatatgtgtatatatagtttttattgattgattgatttgtggaatatttcatgtatacatgaaaatgtaaagaataataagatgaacttcttgtacccatcaagaattagtgacttgtagccaatcacactttatatatgtccacccaactatctcaaaatactggataattttgaagcaaaatcagacactttatttcatctataaatactttggaatgcattttttttttttttttgagatggagtctcgcactgtcacccaggctggagtgcagtggtgcgatctcagctcactgcaggctctgccttctgggttcacaccattctctggcctcagcctgtctgtaatctcagcactttgggaggccaaagtggaaggatcccttgaggccaggagtttgacaccagtctgagcaatatagcaagaccccatctttacaaaaatatattttttttttgagacagagtttcactcttgttccctgggctagtgtgcaatggcccggtctcggctcactgcaacctccacctcctgggttcaagcgattctcctgcctcagcttgcagagtagctgggactacaggcgcctgccaccacacctggctaattttttatgtttttagcagagatggggtttcactgtgttagccaggatggtctgcatctcctgacttcgtgatcggcctgcctcggcctcccaaagtgctgggattacaggtgtgagccaccgcacccagcctggaatgcatttctgaaagagaacttttagggcataatttacatatacatagtaaagtacacaaatcttaagcagcttgatgcatttttacatatgtatacaattatataaacaacttacatcaggatatataatagaccatttacaccatactgcaatttttttcatggttctttccagatggcatcctctatgggtaaccactattctaacttcaatgaacattggttaattttgcctttattaagactttattaaccttagaggaatgtaatctaatggcatctctatggtgtctggtttcttccattaacataatattgctgagatgtatccaagtagtgggtgttagtgatttattcctttttggtgttgagtagcattccattatatacatatgccacaattatggtgaaaggcatttatattcttcctaatgtttgctttttatgaataaagctgatgtgcacattcgtgtatgagtcttttggtggatgtatgctcaacaaagtggggacatgttcaggcatattatatattacaaaaccattttccaaaatggttgaaaaattcacgctcccacaagcaatggatcaaagttctagctgattcacattttcgacaacattattagtcctctcaattatagctattttactgatttatattgatatctcattgtgttttgattgaaacttttctaataaattgtttgaccatgatacatatgcttctctgacattacttctggatttgtgctaattacaaataatgtggcatgcacattcttgtacatctttttacttggtgcagttaccaaatatccacctgatcctagtgattaatttgcagctatgcctactacagatcataatttctattcttatctttagcctggattttattatctacacttggccctaagactctctactttagcttgctgatttcagcagatttctgtgtctctcaatctgtatttagcaatgaacctttccctaattctagcatcatccataccttcggcaaaatgcaaagcttcatctgcactacagtcctaccatctcaccatcttggcatcagaaacaatggcgaataatctacagaatattatgagaatcattgggtaaaaataaaaggatggagaaggttttaatagagaaggcaaaatattatcatggaagaaaacagcagagacacgtaatagagtagaaatcagctggagaagtttatattgcatgtgttgagctcatcagaaagatgatatgtttggtagatgaaagaagagactagttggtaaaatgtcttgaaaattgatcagtttcgttttgatttaatagcaaatagtaatcagccatgaaagttctcaaattcagtttcttccatgaacatattttacatgatagtttttcttatttcacaaaagcataatcaattattaaaatttaaatgtaactatgaatacatactgtagtaaaatatttctttccttgtataaagcaaatcaataatttttagaattaaatattttctattgcacctttcttaaaaaaagaagtcttgatccatattttctcagtgcctaagtaatatattaggtgtgtgaattaactttctagattaatattggtagatgctctgtacctcctcctgtgaaatttatgaagattaagtccattcactcacagcacctgtgttagtaagaacattttaaaattttctcatgcactgtttaatttaatgatttactttttataaaggagagtgctagtaggtattattgtcattttatatctgatgaagaaattactgaaattaacttagccattgaggacaaggcttagatgcacaccggaatctactgattcaaaacccatacctctgtctaatgtgagttatctgccctcttcactgcatgatttccactcatgtgcattctaaaatacatctaagatacaattgggattctatctaggagggtttcattttatttttcctgcagattgcagggaatacttgttttcttctctggagaaagttgataatttgtcaggtgcaactgcctccgattttaggaagtcatttaagtaatttcccttccattaaggctaataagaaccttccctacttgtttaattttgtgctttctggacttcaatccatttacaatactttagaaagtactaaatttaactgtgatcctttatagtgtgaagtataattttttttataatgttatctattaagaattcttgagacaacaggttcaaatctatgcccatcaactctttctggttttgttttttctgagtgtgtgtgtgcgtgttaggaggggagcagggaggtggtgttcacaaccatgatagatattatactttccattttttattctattattattatactttaagttttagggtacatgtgcacaacgtgcaggtttgttacatatgtatacatgtgccatgttggtgtgctgcacccattaactcgtcatttagcattaggtatatctcctaatgctatcgctccctcctccccccaccccacaacagtccccggtgtgtgatgttcccttcctgtgtccatgtgttctcattgttcaattcccacctatgagtgagaacatgcggtgtttggttttttgtccttgtgatagttttctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccacaagaaacattcgtgtgtatgtgtctttatagcagcatgatttataatcctttgggtatatacccagtaatgggatgggaggtggagtctcgctctgtccccccaggctggagtgcagcagtcgggatctcggctcactgccaactccgcctcctgcgttcacgccattctcctgcctcagcctcccgagtagctggggactacaggctcccaccacacccagctaatttttttgcattttcagtagagacgggtttcaccgtgttagccgggatggtctcgatctcctgaccttgtgatctgcccgcctcggcctcccaaagtactgggattacaggcgtgagccatcgcacccagctgggtattgtactttcaaagagaaaagcaataaaaataaaagaaaaataaaagcagacgatcttttaaaagatctctataaaaattacataagtcattttgcagaaattattgtaaaactggttattcatctcagagacttgacttcaaaacaaaaatgaagagcctgaacattatccactgaatttttccattctgaaaattaaagccagaaaaatcccagatcactggaagcctttttgcagctatcagcttgattctatgttctaaattactggaacagtgatttatagtgactatttctaaccatttcacttacttttggctaaattgtctttgctttagagcaatggtaacctctttgactgtacatctaaaattctgttttaagtatatcccaattcttctgtgcctctgttgccatctcagttttccaagcttttgttttctctccctgttttcctcttcgtggtcttttaaatttattttgaatgctatatcttctggatgctaagttggttttcttacataccacagtgactagccagtcaccctcttgcactcatgaacagcaatctattgagttccatgtatcactaaacatctttcctagtgctgtttcaatcatattcatgttatattgctttctattatataggagctgtcccctctgggcattttctgcccatctcccccactatttccttttcactccaaactgccactttatatgtctctcatcattaaatgtgtagattgatcttactttctttcagaatttcttgactcagcaaattgagttttgatctttaattcagcttttaatgatggtagtgatggtggtgttctggtgatgtgtatgcaggtgtattttattcatagcttcttcaggttttaattctctaaacaaaatcccctctgcctattcataatccagccaatgtaatccccaggggcacagagaaagcagccttcaattagggattagtcaggccaggtcatggttggctaaggctcctggctgagcctcctactagatcccgctgtcactctcctactgttgtaattatggccacttttatttaaatacccctgccattttatttcaaagttattggctgattttttattttccctttcttccctatattaataatatttttaaatattttactgttaagtattgagggaaatcaaagtatttcactgcaaaatatacttctttgacaaattttgagaagtttgttaagaggacctgcaaacagaagtagccctgcaaagctgtccttttgcagggagatttgcatctgtagagaaaatctggcttgatgtagccaggttttctctaaggtcttcccttttcttaatgtaggaaagattgactgaaagtttaacacttttgaaaatctgaaagaaacacttaccatctattctctccgagggctgctttctgtgagatttcgtctacataaccagaccacttttgctggccagacctcctgttctccccatcccataacctttttatcaccataacctgttttgccatggtccaagcttttttctgtaaccttgctacaggaaaagggtcccaatccagaccccaaaagagagttcttggatcttgcgcaagaaagaattcagcgcaagtctgcagtgcaaagcaaaagcatgtttattaaaaaagtaaagtggtgaaagtacagattctccatagacaaagtaggacattcctgaaagtaagaggaagaacgcgtctaccctaggtacaatgcttgtatatatataggattaaaaaaaggtcatgaggagatgtgctctgttacaaggttttgtggtgaagaattagttttcttaattactatattttgcaagaatcaatattattatctttaaagtaaaattaggaatctctttgttctcaagatatcgggatatctggacactcccaagtctgggtctattcagtaaacattatcaatcggtttccttaaccataaacatctagaggccaggaacacctttcttccagggaatgcagcccagcaagtcccagcctcattgtcctagctcccactcaagatggagtcactctggttcgaacgtctctgacaacctcatgatgatagatacatttctgtaccccactaggggttgggggtagtcatgctgtggttctccctcatgtgttgtccctcccaccttaataaatttgtgtgccatttctcccattaatttccttttgtaacttgatttttcagtgacccttcagagggcaaaggggaagttttcccttggctcctatggcatgttttttgtttaaaataaaagtcaaaaacattgattaagttgacagtccattggtaagcatgtattaatagcatgtttttttctatgtgattttatatttaggaatctggatgaataccatactatttgaaaaaataaatttaatggttaccaaattgaagaataaagaaggttaaatcttggtaagctatattagatatactgtaggggatttcaatccatttttatgggtttgtttggtttaaatggagtgtttagttaataatactttgaatcgtgccttctattttatttactcacagatagctacaccattaaatgctctatttttaggagatttgctatttagactagtaataaaatgtccagggtaaatggagttttccactaggaaacatatttttatccacttatacatatcaagttattagctaataagctaataataggtgataacatattgaagaatgtaaatgagaaacactaggtttcattttggagaagtaaagacatctcttgtttcatattgttttacaattgaaaccacagatttatttacttaaaaaaaattaatagccattttccctatggcgcttcacagaaagttacccatttgtaacacttctttcagaatgttctccacaatcaatattttttatgggtggaactatgaaaaccaagaatcaatagttgattataataataatgacattagtaataaaagttgcaatgctttatgtaaatacagtgacttttttattgatctcaaaactgcttgtgtgtgtaattataatattggctgattcattcatattaaatacctatagcaaaaatagaatgagggcttgaagtcattggcgaatatttccatatgaaatgttatgtctcttatctttagtttagatatggatatttatgtttaattttttttgaattagcaaacatgtagtaaaactaacaggtgttcaaataacattcagaggggaaatgtcactattaatatgttttacacataaaatacaaatatctacatgtttaagtgccctaggataagttattataatttttcttttttctctctcagaattatatcttctttaaattattgatttccaaatatttctcttgagccaagacaccacgctgaattccacctgcctactttgtgtcatcacttagatatctaatagatattttaaacttaacatgtgcagatataaccttctgaacctgtttcttttttgcctcagtaaatgacaactccattttcccagttaacttggttcaaaaatcataaaatcaaccaccaattgatcacaacctgttacagatttctttgttccttcttcgcgctcactgctccacttgactagccttgaaaaataaaaattaaaataattttttttgagacgcagtttcgctcttgttgcccaggctggatggagtgccaaggccccgtttcagctcactgcaacctctgcctcccaggttcaagcgattctcctgccttagcctcccgagtagctgggattacaggtgcctgccaccacgcctggctaatttttgtatttttagtagagatgtgttggtcaggctggtctcgaactcctgacctccggcaatccgctcgccttgacctcccaaagtgctgggattacaggcgtgaaccaccgtgcccggcccgaataattttttaaaatgatggaatcattattggattttatttttctccaataccaaatattctaatatttagggaaacctattgggtttcttcagagtgtatgcagtatctgaccacttctcaccattttcatttttaaccacttatagtccaagctattattccatatcacctagattattacagtgatctccaaactggtttgcctgcttatccctgtgttccccttcacccccagccaaatctattctcaatacaaaagccagagtaattctattaaaatatatggagatcattgtactccttggctcacaaaactcattggctctttatttaacttaaaataaaagctgaagtccttctaattaccaacaagaccttacatgacttggagccctgttgctctctgaccttatctcctaatgctctgcctccttgctcactccaccccttactggtttccttgacttgattttaatagactaggtaattccattctcagggcctttgcacttgccattcctgccacctggaataatcttccctcaaatatctataggcattttttcctcacctgcttaagttcttgttcatatgttagtttcttagtgagctctttcctatctaaatattgtaaacatctctgacacctcctatctacattttgtgcttttttctccttagcacatattttttagttaggtttattgttctctgcctcttctctagaatgcatttttttctgtgaaggcagaacttttttctttttcttttcattactgtagctccagttcttgatgcataatagatgctaagcagtatcttgtgaatgcatggatggttcttcctattcctctccctataggaataaaaaatttggaagtaggcgagagaacactgcttagtgaatataaactaagaatggaagtacttatctcaaaggtttcaaatagaaactgatgttatgatgaatcattctttcaatctctttgtcacacagtgtggtcagggagcaagagctcctctaggtttgggaacaggatagcaatccactctaaaatcccatcctcctgttgtgttgggagaacattttgaattgagggtatggtaaaatactgtttcccaaacaacttactcattgaaacattgttggctggggtgtgtgtatgtaagggagagtagaacattctggaattatatgaaactaagtctgttttgctaaaacaaaatgaaagttctcagcattcactaggatttttaacgtcctgcaagtgattgattaagcttttccaacaactgatttttgtaacaaatttcatttaaagggatacaaatggcataataagatacatgatatatctttttattttcctgtattactttgtatctctcagtgctacccagaagacagtcactgatggtaatcaacaggcttctgtcactctgagagatagaaagagtggatgcaatttactttaaattctttttaaaccaacccttgatgcctggcttattgcagatacctggcccttttggctatcagtccttcagaggcatcagagaataaatacccatcacaacagctcctggtgttgtcctgggatagtggatgccgctttcttgaaaactgggtattccatctgttgataaggttgaccacaaatgttagcaatagtcccacataggtcattataatatttgtatcttaagtgtgattaatcttcttctttcagtttatctgtgaaactctcttatgcttttataagatattaatgggacattagtataatcttaaattaagattggttaatactgcactgttggtacataatttatgcttttagcaaagatggcttgtgatgtaaatattgcttaaaaacatcaatacaggacttcctggaagttccataacattttacccaatgatggggtagaggttaaaaggagtaatcaatgatttctttgatttttctcactgctgaggactatcctaagtgctttatatacatttacattaattcttaaaacaatctctcaagattggtattattagaaccactttattgataactaatctgagagtctcagagtggttaagttgatttacccaaggtcaagttgacagacggttaatctgcaaatacttactgaacatatactatgggtacagttattctactgagatgatacagacaacaaacagagttgcaatcctcatgtcttgccagatgataaaaacccacctacaggagtaccaaaattgttattatgaattaataatgtattcgtattcttgagattttgctcattgtagctgtcatttaaaacaaactttaggctgggtacggtggctcacgcctgtaatcccagcactgggaggctgaggcgggcagatcacctgaggccaggaattcgagaccagcctggccaagatggtgagaccctgtctctactaaaaatgcaaaaattacctgggtgggatggcatgcacctgaaatcccagctactcgggaggctgaggcaggaaaatcgcttgaacctgagaggcggaggttgcagcgagctgagatcatgccactgcactccagcataggcgacaaagcaagactatctaaaaaaatgaacaaacaaaaacaattaaaaaaaacccaaaaaactttattttgcaagtgtagacatgacaatgtattaacttaaattaacctgataactttagccaaatgtttattgtgttgtgttatttaacgttagataatattagtttgttttgtgtaaatagctgcaattacacattaaacaagaatgcaggaccagcctataactgtagctaatagcatatatatattatgttatagggtttacaaaatgattgttactttttgcagtatcacaataatcctatgaaattagtccattttgggggtgggggcaaggggagggatagcattaggacaaatacctaatgtatgcgaggcttaaaacatagatgatgggttgatgggtacagcaaaccaccatggcacatgtatacctacgtaacaaacctgcatgttctgcacatgtatcccagaacttaaagtatgataataataacaaaagaaattaatccattttaccgattaggaaactggagatcaacttggttaacaaatgctcaaagccatgtaccattaagtggaagagggggattcaaacccaagccctctgtgccatttttctagctcttttcaagataacaatggaagatgtgaactcactttctgatgttctatgattgaaaagaaacatgcttccacaaattgttctaattttactgcataattgagcagattatactataaattaatgtgttggcacagttaactatttcttgtttacttttctttccctaaggagtctgctactctgcaggaggccttttaaacagaaacatcccattaactttcttaacacagaggcgagaaaacaaacaacaacaagcatagctacaatcgctgttattaggcaccctgaaaagatgtaaccctgagcattggatagcagtaaatcatagaaggggggtgtcaggatggggaagccagaaagtctagcttactttttctcaaaatatgatctgctttagaatcctgagggagttgattaaacatgcagattcctgatctctggcccaaactactgaatctcagtctaacggcagagttcctaatgggcctgttttcataaagattcctggatgatggtttttgtttttcactcttgtacattaaatattaggactttgagaatctagttcattctgagtcatatgcttcagttaaggtactctgtctgcatagggtactctggctaatttaaacaaacaggaatttactaagagcacccaaaagttactgagacaagaagcagtattgggaataggaaggaatggagttaccttggggtctaggaagcaagaaccacaacatgaaaaatctgttcaggctattgtagctcagtctggatggatgctcgccgtttgtagtgtctttgtttgcatgcacaggtcatgtgttggtcccgtgtgtaatgggtaggtgggcccctgcagatgaaactggattgaatagggaaaagataagtccaaaaaggaaagggaaagaagggaaattaatactgagtagtccaaacatagcttttctacagtacaaaataatctagtttcactattgattgaagctaattgctattcctaagtaccctcctaataagacctagtctggaagggcccttcactcataaaaacaatgaggcatttaaatgctgatgatgggcctggcaccatagcttatgtctgtaatctcagcactttgggaggccgaagtggagaagtggaaggatcccttgaggccaggagtttgacacttgttccctaggctaatatgcaatggcctggtctcagctcactgcaacctctgcctcctgggttaaagcgatttttctgcctcagcctcccgactggctgggattacaggcgcccaccaccatgttcagctagtttttgtatttttagtagaggccaggtttcaccatgttggtcaggctggtgttgaactcctgacctcaggcaatctgcccaccttggcctacaaagtgctgagattacaggcgtgagccactatgcccggcccaaaataattttttttttaaaaatgagcaaggcatagtggcatgtgcctgtagtcctagctactggggaggctgagtcaggaggatcccatgggcctaggagtttgaggctgcagtgagccatgatcaggccactgcactccaggcaggatgacagtgcaagatactatctcaaaaaaataaaatgaataagtaaatgcctcttatgaaccctattgacatcaagtaggaatgagcactagagctttaagaggcctcagctcagcctatccagccctttggtggtgctgtgtgtctacaaaactttcctttgtacacagctactttttcccctacactcacctcaaaagggcttgtcaaggttgaggttgtagcccctagttattgaattgtttaattcaataacttgttttgtgaaaacgtagcagagataaataactttttctatgtaatagaacccacttaggatagttagctgattaaagtttatcatataactatagtgtccataccattaggtttccattgtctgcccttggccttaacatttcctcaacatagaacactcctccaaatcatatttctgactctttctcagcatttgtatttccgctcaaatggcattttctcaaagggaaatctttatgaacttcctcacaatgcccctgccttctactctatcctcactgcctgatcactccctagtctattatgatatttttccttcatagcagtcattatctgattaataagcatttttacttgtttaagattagtctctttatgctgcctcccaacatacaaacagtccccccaaactgtaaagtatctgctttcctcaacaggttatgaataagattgccatttatttaaagtaggacttgaatagatatttgttacttaaatccaaagctatcataatgccaatctctttaacaggggcacagaaggcccttcctttccattctatctttaaacacattatcatttatcctatgccttaaacagaatcgtgtttatagtttgctgaatatgctatatgctctttcatttttcatgaggatttctgttttttttttttctttgcatgcacagaatttaaaaaaaatttaaaaaaaggaaaagtcacaaggtggattaggttgctagaccttaaaacactccatgatttctttgtcttagtcatttcctttttttaattgctaaattttctttccagattccctgcttttcttttagtaagagtttaactgtaccttatacaaatcagtaattattctcttaataactagttatactacagggttagatagttggctcattcattaacaaagttaaacattttattttaaaacaagttttattttgtaaatataaccatttagcaataacttaaatttaagtttaagccataaatggaaaaattactacaacggtaaagcaacatgtaagtcagtctcaagagtgtttaaattttatgcaatgattaggaaggatgataggtatcagatctgaaactttataaactgtggacccttccctctcagcctatacaaaaatcaactcaaaatggattaaacacttaaatataggatctgaaactgtggaactactagaggaaagcataggggaaatggttcaggacagtcaacaaaaccaaaaatagacaatgaggttacataaaactgaaaagcttctgcacagcaaaggaaacaataagcaaggtgaatagacagcctgtagaataagagagaatatttgcaaattattcatctgaaaaggggctaatatccagactatataaggaattcaaacaagtcaacagcaaaacaacccccaaattattcaactaaaaaacgggcaaagcgtatgaatagacattcctcaaaagaagatattcagataaccaataatataaaatgatcaacatcactaatcatccagaaaatgcaaatcaaaaccacagtgagatatcatctcactccagttagaatagctaatataaaaaaagacaaaaaataataaatactagaaaagatgtggagaagaggcaactcttgtacaaggttgatgaaaatgtaaattagtgcagttattatggaagtcagtatggaacttcctcaaaaaactaacaataaaactcccatatgatccagcaatcctaccactggatatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatgctaagtaaagtaaggcacagaaagataaaataccacatgttctcactcaggtgggagctaaaaaaaaagtgagctcttagaagaataaagtagaattatggttattagaggctgagaagtttagggaagagggaaagaaaaaaaggttggtccatgggtacaaaattatagcttgataggaggaataagttctagtgttcacagcattgcagagtaaatgtagttaacaataatttattgagtttttttttttttttttttttttttttttgagacggagtctcactctgtcacccaggctggagtgcagtggcacgatctccgctcactgcaagctctgcctcccaagttcacgccattctcctgcctcagactcctgagtagctgggactacaggcacccgccaccacgcccggctaattttttgtatttttagtagagatagggtttcaccgtgttagccaggatggtctcgatctcttgacctcgtgatccacctgtctcagcctcctaaagtgctgggattacaggcatgagccactgcgcctggctgtattgtgtattttcaaaaagctagaagagatgattttgaatgttcccaacataaaggtttgataaatgtttgaggttatggatatgctaattactctgatttgatcattacacattgtatatatatactgaaatatcactctgtaaccataaatacatacaatgattctatataaagataaaatgaaaagtaatgtttatgcttttattgtcaaatgtaattatatatatttaatttttgcttatgataagactattagagtctgcagataaatttaagtgcttaagaaattgaaacacatcagagttttacattgaaatgtgtggatctttcttcaagagtctcaagctcatgcttaactggacaattgaaaaatatcactctttactgatttatatcaagttttatttgtactaaaaactagttttagtacttacctttaattttctagtactaaaactaaaaactagttttagtacttacctttaattttctaaggaaagctagtaagatgctttggctaactttattgaagaataacttggtatgaaattatgatttgtgatagaaaaaagaacttagattttattatttattttcaaaaatcaaattaatgaaatatttagattgatcttttttgttagtcaataaattctgactgtggttgatcatggttttccagggcagacactatattaattttagtgtcatttgaaagaaaaatatgttacaactgagaatatactcatgaaaagataagtaacaatttaaacaatacacatcacaaataaagcagaacctattttttggaaagacttgctgtattattaaaagaggctactattggtttgattagtgtgacaaacttcatgatggagtgggaatttttaatggtcatggaaaattatttaatttcaggaggcgaaatattgatggatgagacattcaacaaagggttgatagagggagataggaaaggaaatagaaatgtacctggagacagatattgtcaatatgaccagggagaattaattgtgtatggaacagtgagatacatttgaaaatgtggtataggatagattatacagaattctgaggagtttaatactgcatttgtatccattagcaatggtgagctgtttaaaagaagtttttgaatctttagaatatttatttgaaaggtttgatatatttgttttccaagtgtgatctaaagatagatcacataataaaattgtctagagagttgctaaaaatgcatcaagctcccaaaccctaaccttctgatgtagtatgtttgggtgggaaccaggactacattttttagcaagatctcttattatttatcacttcacaataagtcttagaaccattggaggaggaactatagcctgtggagctcccttctctaaggttgctggagcccagtctctcatgcctctctcagcttattttcaaatataaaccatctcaaacattgtgactcaacaatacacctgaacaattaaagatgagtgcattttttttcctatgctaaacctcaaatgagtgaaatggaccacccaatagtcccatagctagctttttaaaatttttattttataaacatagaaattgactcttacggtcttaaagtttcaaagttatatttgttttatctgagttccttcctgaggaaaggaccttcaggcctctcaaaaaacgtgtcaaagaactgaaactcatcagatcaccatgtccagacaatgaaatactgaaccccctcattcatcatgattactttcttgccgctccctagttcctgttttcttacacattgtttcatttctttcctgctgtataaactcctagttttagtgtgtcaaggagatggatttgagaatgagctcccatggcctctgctgcagcacccaattaaaacctccttccttgacaatactcattgtcttagtggttggctttctgtgcggtgagcagcaggacctagaccaaacccttggtgtttcagtaacatgatcagaaattgtgatttgcttccaacctgtgttcaaagccaaggctctcagagaacatcattggtcacctttattagactgtcaccatattaagtaggactcttctgattgcatgatataaaatccagagactatgcaaacttagcaatatattttatagaagaataactttttggtagaaaaaattaggagtgccacttgggccttgttttgttttgtgtgtgtgtctgtgtatttttaaagtataagtctaaagtgacattcagaagagaaatgtaactctatacctttcattattgatgcatcgatttgaataatttgtgtaagttcttgggttaggcacacatggagtgtgtgtgaagagtaacgaagccttccatttgttcttcacaaatttttaaatgtgtctcctttattctttccattttgaaaaattaaatcattctcacgcctccatttgctaggtgtagatattcatatttggaaatctttgtatcctctgattgatgggtataagtctgtcatggaggttgccatgtaaagctaaatgcagaatttgttttctctatgaattgattgctcatgtaaaatcactttttactgctgctggtatttaacacataaatctatcatttactttttttttaagtgaaggagctactggtttatcatgtgtaggaaactttttttcactatgtcatcactaaatcgaaggtaaaattatgtttttttcctgaactatgaattctatgctttccttgaaatagataaaatagataaacaagtaaggtattagaggagtctggaaaatattcattagtatccacctttaggtttacctgaagtagtcaggattttctttttagtattccatttttatatgaagtaccattttatatcaacttcttttgttccattgtcagaatctaaagaaatattatctttctacctggcatttaaactggttctctatttttaatggatgatgtgcattgatttgaaataccttgataaataattatttaaatggatgaagagacaaattgttccagtaataaatatttaacctaggagtaggttaggcactttaaaaagctgtagtaatacatgcaaggcattttggttaatattcaaaaactgacctctgaaaataataaaaaatgtgttaattataatccaagacataccagagtaaacaccaatgaatcctcctttattttaccttgtctctcaatattctaattctgtaacaataaatatactcttaaaggtgaattttagacattatcaatttatctattagaaaattatatgatgctaattccatcatgatacatatttaacaatgtaataaattaattaagttaaacacaatttattagattaattacatggggcttaattagtaattaaataaactacactataacatatttacaccaatttatggaaaatgcttttctctttatctttattttttaattcctgacaacctggtagaagttaaactacagaaaaaacatctgcattctagattttgattattagtattctaaattacaaatgcttgtacttgaacaaattatattatggtaatttttttcctttaaagggagaatatcaatggttgaagatcaggctatttatcatcatctttgaaaaagcaaagtaacaatacagcccatttaggagacacattaatctcccatgtgactccagaagcaaacagaattttaaaaagcatcttcagaaattatttggaatatacttctgttctctaagaatatatctctaactttcttttaacaatttaagacataaaggcaacactagatactgatgcttcaggaagtgtcacagtagaaaagttttaacagagtttatagccctggggccttggaaggaaaagctaaaaactataagtagggtagtagtgaattacaatgataaaaactaaatgtcttccttttgcacattaagttatgttaaaacactgactggtaagttacagagctgcggtttgaacctacatttgtctgaaccaagtttccacacttttgaccacaataccttgatgcagtgattaagaaggtattttgttgaagcagataataggaattcatacacttcctctgtacttgctgaatgcatgatcttggacaagatacttaaggcctttgtctcaggtttttgttttttttgagatggagtcttgatctgttgcccaggctggagtgcaatggcgtgatctcagctcactgcaacctctgcctcccaagttcaagcgattctactgcctcagcctctcaagtagctgggattacaggcacctgccaccatgcccagctaatttttgtatttttagtagaggcggggtttcaccatgttggccagtctggtctcaaactcctgacccctcaggtcatctgcttacctcggcctcccaaagtgctggaatttcaggcttgagccaccacacccggcctcagttttttaattctaaatggagtgataatactataaaagtacttacttcatgtattagtccgttctcacaaagctataaagacatacctgagattgggtaattgacaaagaaaagatgtttaatcagctcacagttctgtgagctatacaggcttctgcttctgaagaggcctcaggaaacttacaatcatggcagaaggggaaggggaagtaagcacatcttcacatgagagcaaagtgggaggtgctacaatggataccccattctccatgatatgcttgtttcacattgcatgcctgtatcaaaacacctcgtgtaccccccgtaaatatatataccgactatgtacccacaacaatttaaaaaaataaaataaaatgacttctccccatctgtagattatctttaatttctttaaggtttattttacaggtcaaattccaacataaccatatttatcaatcttctattttatacttagtttttttatgtcttatttaagaaatcctacctttcccaagactttcacctttaatatttgactaaaagtctttttgttgttgttactgttcttttttttgtttgtttttgtttttgtttttgttttagacagagtcttgctctgttgcccaggctggagtgcagtggcacaatctgggctcactgcaacctccacctcctaggtgagttcgagtgattctcctgcctcagcctccggagtagctggaattacaggcgcccaccaccacacccagctaatttttttgtattttcaatagagacggggtttcatcaggtgagccaggctggtctcaaactcctgacctcaggttatccacccgcctcggtctcccaaagtgctgagattacaggcatgagccaccacacccggcctctactaaaaatcttaagttttgttattgacatttcattcctaggatcttctggagtttgtccttttatatggagtgagaagaggtcaaatttcatattttgttgttatcattgttcatatggaacattttgtgagtctctgtgaggcagaagttccatacaaaaaagtgtgtttggaagtaaaaagaaaaatcagaaaccagaagattctgaaaatgaaagattatcatgataaggaatcatattagcagtccagcatattaaatggaaggaatgtctgaaagcaccaagcaaagataacaagagatggacatcaaggaaaagatatgagttccaagagttaaaccatgaaaaacaaaactgtaaatacccggatttttaggggaaaaaaatagctgcagtaaaggcagtaatgaaacaataaagaaaatttcatttgcttaaaaaaatggagtctcaacactgaaagattcagcaatgaaagtataataatgaaaaatatatataacattagtttaacagttgaactcaacatctgtttacaaatttaaatttagacagtcttgctctagaatcactgctgtgtgaatctgtatgatttgacaattacaagtttgcatgacacactagatattattactatcgggctcaatttttttttttttttttttttttttgaagatggagtctctttgttgcccaggctggagtgcagtcatgtcatcttggctctgtgcaacctccgcctcctgagttcaagcaattctgctgcctcagcctcctgagtagctgtgactacaggtgcatgccaccacacctggctactttttgtaattttaatagagacggtgtttcaccatgttggccaggctggtctcgaactcctgacctcaggtgatcctcccaccttggcttcccaaagtgctggtattacaggcatgagacactgagcccaccctgaattttttctttttagaccaaagtactatagacaaaagcacacaaaagtcacactgatctctgtattccaactcctatctttggcatttcctatgaagttacagcgagactattttactcagcaaactatgtaccatgcaccatctgtggatggcagtggggaaaaagataacacaggaactcataatttaatacagtgtcagtacagtattatgagacaagataggatagaagcgggatcctcactattgaagagtctgcaagtgctataagatcctgcatggcagagagcgttcctcacgtggttagggagagaattacagtggagcaaaagaggcaataaattacaatcagcctatgtgactcagtgtcttcaaagttaataattgctaagaatctgaaatctaaaacaaatactgattattattaaactacagtgtaacacatactttcttcttggctatcaggtctttcttctttcaatacctggaggaaaaatactcaccatttaagccacttgcggaaagcccctttttgctttctaaaatttgcttcacaaaatgtatcattttctccttcctgtattcaaagcagttttagtcctattttagcaatttcaatgtgcattattttagttgtctgtctcctttaccacactatgaactcctgaagcatgatgtcaatatatttcttgtgtctaaaaagaaaaggaactcaacaattgactgttgaaagaatgagaatgaataaattgacaaataaatgaatgaactgaatgatcagcttgagaactcaaacatacaaaccaaaacagtatgccaatgggtattcatattttaaataacttaagcctcaaaaattgcatctcttgtgtttacattgaagtcaaggtctttggtccagctatcataccacaaaatagcgtgagtgcttcgcagcatcactgttactattctttcctccagttctccaatcccatcatccaaagtagtatttctctttctttcaatatagaaatgtcactattgaaaacctatcacatgttttattctattcaaagagaaagtaagacatgagccttagcattgcctcacccatattctcatgccctgcattgttaaagaagccactcagcagagctgtgctcttttaacactagcttgaaatttcatctctcagtgttgtcacagccaaatttttacaaatttgtgaatatccagttagagttcaattgtgagatcaacctttctcagcaactagatttccagccttttcttatgaggtcaggaaattcttgagtgttttccaagatgcacatgtttccagtttcacaaatagtaccaagacctaaatgaagctcctgattcctcccaggagtctagtaaagcacaaagcaaattctatccatttatggcccttctgtgcactaaaattacagctggtcctttgcaatttttatgtagagggaatttagtctctttattatctttgtacttgaaattatgaagagtcttattcaaagcaccgtacagtttcaaccaaagaacaggtatgtgccagatttaaaaatttggacaagaaattattaagtgactaatgtctgatcatagaacattgcacaatggacccgtttattttacatatcatcacaacttggattcgcacaacttgtgttttgcttgtaacttctatttcttgacttgattgctttgaaaagtttgcattctttaactagccttaattatttgtgtgtatgtgacatcacttttctctaaatggtcaaagttactttgaattttgttaatatccacttttaaatcaatgccaattgtcaaaatattaaatatataatttatctcaccaataaggaaactgaaattacctaaccaaggtactcattttatttaccattaattccctttattcagtcagtttgtgtctgttaagcgtgttgtttgtattaagcactatggtagatgctaaaaatgaagatatatatagcactgaacctaccctcaaaatacctaagaaaaagagcaaaagaaaaatcaaggtgaatggcctattacaatacagtgttttaagagctctgacagaggtaaggcaacaactttttcagaggaagaaactcataagcaaaggactggagaaaaagtagaaaggaattattaaaacatcaacgaagttaaaagactataggttttggagtcagaaacccagacttgtaacacaaacttacttagtatgtgactatttttgacttgtcccttcaacagcctcatcaataagagcaataaagtggtcagaatgacagccccaggaatcactgtagccatttcttcttagccattgcaaccaaggactacacgtgttaccaacccacagttctagctgaagcacctagccaactaactagcaacatttagggaattaaaatgtgaataatagtgaaattcaatatatattccgtcagtctcttgtgtatgatcccaaaagaaagacacaaaattgactttatgttcttcagaatccaacacaaggagagaatcctgattggtggcataatttagagcctgttacatataaacaaatcaattgctgcgaagagtcaaatctatttcccatcctgaggaatgagtacaatttgcactcatgcttcctcatggaatgatgtggcagtcctgggtcagcttgccttcagatctattcctcatgcctcttttgctctgctcaatgcttcagggtgctgatatgaaagctacttttttccagggttccctaatagttgacttctggctgggtataggcaatgggaagtgctgattgaattattggaagggagtagccaggctatttctccttcagcctcgctgtctaatgtaaagtctctagaagctgctgtgtctccttcctgggtctggctctcactctcagtgcacaggcacagcctcctttttccagggacctctgaccctctggcttcagaaactccatcttcttatattttccctccagcctaggcgtgttaactagtctgtcactattttctcatttgcttcattgtctcatttgacttctcaatgttcccatcatccatataaccattgccctgcattaaattccctctattttggcaacttaaagatgtttctggctgggcacagtggctcacacctgtaatcccagcactttgggaggctgaggtgggtggatcacatcaggtcaggagttggagaccagcctagcgaacatggtgaaacctcacctctactaaaagcacaaaaattagctgggcatggtggcagatgcctgcaatccgagctactcgggaggctgaggcaggagaatcgcttgaacctgggaggcagaggttgcagtgagccgagattgcaccactgcactccggcctgggtgacagagcaagactccatctcaaaaaaaaaaaaaaagatgtttctgtcttcacagatgaactgatattgagggcataagtttcatcatcaattatatcatgtctataataaaaatggtaagtttgtaagttatatttcttctaacatttatcagtgtgggctgggatataatgtaaaaacacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctccaaaacatatttttccccaactatcaagttttatataagtagtaaggtagtaagggcagagagtacttgtttctgactagtacctggaagaacaattaagagcactaccatactcctcaaaattcagctgagttggagataagataggcaacggtctacctgggacataaataaacaaatgttaatatagtttaggaataaatgatatcagaggaaaataatacataacaacatggtagtgacttgagatggggttgttgtggtggtggcacaatataaacactgaataatcagggaaggttactcttaggaggtgccctggaggaaagacctaaacgatctgatggtgccgaccttaatgaaaatccagggaaaacactaccggcaaaactacagcaaatgacaaggcccaaagtagaacaaatttggcatgacttgtttctgaatcagaaacttatacttgctagtttctcaggtgtcaaaaagtacaaaaaagagaagtacccccccaaaaaaagaccaatttgaaaatgtttttaagtggcaataaattcatttcaaaacaaacaaacaaacaaaccatggactatgtagttgtgaacagtgtaaactcccagaaaacactcggtggtaaacatatgttagtctaacttgctaaattagttgagcatgtattatgttccattgaccattctgagtactttaaatgtattaattcgtttaattcttatcacattatgaagtgatatggtttggctctgtgtccccacccaaatatcatgttgaattgtaattcccaatgttggaggtagagtctcgtgggaagtgattgaatcatgggggtgaaattcccccttgctgttctcatgatggagttctcatgagatctagttttttgaaagtttgtaggacttccataacttgaggtcttagatttaagtatttaatccattttgatttgatttttgtatatggtgaaagataggggactagtttgattcttctgcttacggatatctggttttcccagcaccatttattgaggagactttcttttccccagggtatgttcttggcacctttgtcaaaatcgacttcactataggtgtgtagatttgtttctaggttttctattttgttctatgggcctatgtgtgtggttttatgccagtatcatgctgtttggttacagtagctctgtagtatcatttgatgacaggtaatgtgattcctccagttttgttctttttgtttggaatagctttggctattctgagtcttttatggtgccatataaatattaggattttttttctatttctgtgaagaatgtaattggtattttcgtagggattgcattgaatctgtagattgttttactagaattgacattttaaaaatactgattcttctaatctatcaacatggaatatttttctattttttgttgtccttttcaatttgtttcatcagttttttacagttttcattatagggatcttttacttctttggttatcctaggtatttaattttatgtgtggctacagtgaatgggattcctttttaaattttttttcacattcttcactgttggcatataaaaatgctattgatatttgtctgttgattttgtatcctgtaactttactgaatttatcagttctaatagttttcttgtggaatctttaggtttttccaaacatcagatcatatcatctgaaaacaaggataatttgacttcttcctttccaacttggatgacctttatatctttcttttgtctgattgctctagctaggacttccactatcatgttgaataacaaggatgacagtgggcatacttgttgtgctctagatcttagaggaaaagctttcagttttctcctattcagtatgatactggctgtaagactgtcatatatggcttttattatgttgaggtatattccttctatctccagtttttttagtgtttttattatgaaggaatgttgaattttatcaaatacttttacagcatcaattgaaatgatcatatggtttttatccttcattcttttgatatgatgtattacattgattgattggcgtaagttaaaccatccttgcattctagggataaatcccacttggtcatgatgaataatcttcttaatgtattgttgaattcagtttgctattactttgttcaggctgtttgcatcaatattcatcagagatattcacctgtagttttcttctatttgttgtatctttgtctggttttggcatcaggctaatactggccttgtagaaggagtttggaagtactcccacctttgttttttagaatattttgagtaggattggtattagttcttctttgaatgtttggtagaattcagcagtgaagccatcaggtcctggacttttcttcactgagagactttttattatggcttcaatcttgttacttgttattggtcagttcaggttttggatttcttcctggttcattcctggtaggttgtacgtatttaggaatttgaccatttcttccagattttccaatatgttggcatatagttgctcacacgagccactaatgatcttttgaatttctgcagtatcagttgtaatgtttcctttttcatttctctttcaaaaatttctctttttaatttctagtttcataccattgtggtcagagaagatgcttgatattatttcaattttttgaacgttttaagacttgttttatgctctaatatatagtctatcattgagaatgatccatttgctgagtaaaataatatgtattctgtagctcttagatgaaatgttttgtaaatatctatgagatccatttggtctatagtgctgattaagtctgatgtttctttattgatatagtgccagtaagatctgtccaatgctgaaagtggggtgttgatatctccagctattattgtattgggactatctctctctttagctctaataatagttcctttatatatttgggtgctccactgttgggtgcatatatatttaacattgttatattatcttgctgaattaacccctttataattatatgatgactttatttgtctcttcttatagtttttgtcttgaaatctattttgtctgatagaagtatcacagctgctgctcttttttggcttccatcagcatggaatatctttttttatccctttattttcagtttatgtgtgtctttgtaggttaagtgtgtttcttaggaatagatccattaagattttgttttgtcatccattcagccagtctatgtcttttcattggtgagtttagtgcatttacattcaatgttattattgataagtaaggaattacttctgccattttgttatttgtttttgggttgttttgtggtcttctcttctttctttctttcctgtcttcttatagtgaaggtgattttccctggagatatgattattttcttgctttatattttttgtgtgtccattgtatattttttggttaccctgaggcttgcaaatactatcttataacccattattttaacctgataaaatcactgtttgcataaacaaacaaacaaaatgaacactaataaaaactatatgcattaactttgtctccctcactttttaactttttattgtttctatttatatcttattgtactgattatgtcttgacaagttgtggtagttactattttttattggttcattgtttaatctttctacttaggattaaagaagttcacatgccacagttacagtgttataatactgtgtgttttcctgtgtacttactattaccagtgagtttcatacattcatgtgattatttattgcttgttggtgtccctttcttactgcttgaagcactccctttagcattactttttatttatttgtttattatttcgatagttttaggggaacaggtattatttggttacatggataagttctttagtggtgatttttgaaattttggtgcacctataacccgagcagtgtacactgtacccaagatgtagacttttatctgtcatccctctcccaaccttcctcccgaaccctcaaagtccactatatcattcttatgcctttacatcttcataccttacctcccacttataagtgagaatgtaagaggcttggttttccgctcctgagtaacttcacttggaataatggtctccaactccatccaaattgctgtgaatgccattatttcactcatatatatatatattccatggtacatatatatatactccacattttctttatcctcttgttgatttatgtgcattgggctggtttcatatttctttttctttctttttttttttttgagacagagtctcgctttgttgcccaggctggggtgcagtgatgggatctcgactcactgcaagctccacctcccagttcatgccattctcctgcctcagcctcctgagtagctgggaatacaggtgcccgccaccatgcctggctaatttttttgtatttgtaatagagatggggtttcaccatgctagccaggatggtctcgatctcctgaccttgtgatctgcctgccttaggctcccaaagtgctcggattacaggcgtgagccaccatgcccagccctggtttcatatttttgcaatcgtgaattgtgctgctgtaagcatgtgcaagtgtctttttcatttaatgacttcttttcctctaggtagatactcagtagtgggattgctggatcaaattatagatttacttttagttttttcaggaatctccatactgttttccatactggttgtactggttcacattcccaccagcagtgtaaaagtgttcacttttcacaacacccatgccaacatctattatattttgttttttaataatggccattctttcagcagtagggtggtattgcattgcggttttgatttgcattttcctgatgattagtgatgttaagaatttttttataattgtgattatgaaaaaaattagtgactgaagcactcccttgtttcttgaccatttgtatatcttcttttgagaattttatattcatgtcctttccctactttttgatgggattagtttttcatgctgatttgtttgagttccttgtagattctgaatattattcctttgtcagatgtatagtttgcaaaaattttcttccactctgtgggttgtctgctggctctgctgattatttcttgctgtgcagaagcattttagtttaattaagtaccgtctatttgtctttccttttgttgcatttgcttttgggtacttggtcatgaactcttagcctaagccaatgtctaaaagagtttttccaatgttgtcttctgaaatttttatggtttctggtcttatatttaagtctttgattcatcttgagttgattttttgtataaggtgagagatgaggatctagttttattcttctacatgtggcttgccaattttcccagtaccatttgttgaatagggtgtattttccccgctttatatttttgtttgctttgtcaaagatcagttggctgtaagtatttgggtttatttgggggttctttattctgttccattggtctgtgtgcctatttttatgccagtaccttgctgttttcatgactatagccttgtagtatagtttgaagttgggtaatattatgcccccagatttgtgctttttgattagtcttgttttgatcatgtgtgtgcactcatttttggttccatgtgaattttaggattattttttctagttctgtaaagaatgatgttggtattttgatgggaattgcattgaatttgtagattgcttttggcagtatggtcatatttacaatattgattctacctgtccatgagcatgggatgtgtatccatttgtttgtttcatctatgatttctttcagcagtgttttgtagttctccttgtacagatctttcacctccttggttaggtggattcctaagctttttgtttgttttgcagctattgtaaaaggggttcagttcttgatttgattctcagcttggtcactgttcgtgtataacaatgctactgatttgtgtacattgattttatatcttaaaactttacagaattcatttatcatatcttggagctttttggatgagtgtttaggggtttctaggtgtatgaacctaaattggcaaaaagtgacaatttgacttcctttttatcaatttggttgccctttatttctttcttctgtctcattgctctagccaggacttccagtactatgttgaatagagatggtgaaagtgggcatccttgtcatgttccagttctcagggggaatgctttcaacatttccttgttcaatataatgttggctgtgggtttgtcatagatgacttttattaccttaagttatgtcccttctatgctgattttgctgagggtttaaatcataaaggcatgctggattttgtcgaatgctttttctgtatctattgagataatcatgtgatttttgttttaaattctgtttatatgacatgtcacatttattgacttgcatattttgaaccattcctgcatccctgtaagaaacccacttgatctttttgatatgctgttagattcagctagttagtattttgtcgaggatttttgcatctatgtttatcaggcatattggtctgtagttttctttctttgttatgtccttttcttgttttggtgttagggtgatactggcttcatagaatgatttagggaggattttctctttctgtatcttttggagtagcttcagtaggattggtaccaattcttctttgaatgtcggatagaattcagttgtgcattcatctggtcctggacttttgttgttgttggcaattttttaattatcatttcaatctgctgcttgttattggtctgttgagagtttccttttttttcctagtttaatctaggagggttgtatttttccaggaattatccatcttctctgggttttctagtttgtgcatttaaatgtattcatagtagccttgaatgaccttttgtatttctgtttttgagatgaagtctcactctgttgcccaggctggagtgtagtggctaatctcggctcacggcaagctctgactcccgggttcatgccattctcctggctcagcctcctgagtagctgggactacaggcacctgccaccacgcccagctaattttttgtattttttagtagagacggggtttcactgtgttagccaggatggtctcgatttcctgacctcgtgatccgcccgtcttggcctcccagagtgctgggattacaggcgtgagccatcgtgcccggctgatcttttgtatttctattgtattggttatagtatctcccatttcatttctgattgagcttctttggatcgtctatcttcctttctttattaatctcactaatagtctatcaattgtgtttatcttttcaataaactagctttttgtttcatttatcttttgcattttgtttgtttcaatttcttttagttctgctctgatctcgcttatgtcttttcttctgctgggtttgggtttggtttgttcttgtttctctaattctttgaggtgtaaccttagattatctattcatgctctttcaaactttttgatgtaggcatttaatgctactaactattttcttagcagggattttgctgtttcccagaggttgtgtcatgtttgataggttgtatcattcagttcaaatcaatttttaatttccatcttgatttcattgttgacccaaagaccattcaggagcagattatttaatttttatgtattttcatgattttgagggttccttttggagttgatttccaattttgtcccattgtggtctgagagagtacttgatataattttattttcttaaatttattgagacttgttttgtggcctatgatatgtcctatcttggagaatgttccttgtgcttatgaatagaatgtatattctacagttgctaggtagaatgttctgtaggtatttgttaagcccatttgttctagggtatagtttaagtctgttgtttatttgttaactttctgtcttgatgacctgtctagcgctgtctgtggaatattgaagttcctcaatattattgtgttatctatctcatttcttaggtctagtagtaactattttataaatttgggagctccaatgttaggtgcatatatatttaggattgtgatattttcctgttgcatttatctctttatcatttttatataatgttcctctttgtcttttttaactgctgtcactttaaagtctgttttgtctaagaatagttgactccttcttgcttttggtgtccattgcatacaatatctttcttccatcttttcaccttaagtttatatgagtccttatgtgttagatgagtcttttgaagacagaggatacttgattggtgaattctgtccattctgccattctgtagcttttaagtggagcatttagaccatttacattcaaagttagtattgagatatgaggtactattctattcaccatgccatttgttgcctgaataccttgggatttttgtattgtgttgttgttttataggtcctatgagatttatgctttaaagagattctattttggtatattttgaggatttgtttcaagatttagagctccttttagcagttcttgtagtgctggcttcgtagtgctgaattctctcagcatttgtttgtgtgaaaaagactttatctccccttcgtttatgaaacttagttttgctggcaaaaaaatcttagctgataattgtttttttaaggaggctaaagataggatcccatccctgctagcttacagggtttctgctgagaaatctgctgtaaatctgatacattttcctttgtagattatttgatgattttacctcatagctctttagattctttcctttgtcttgactttaagtaacctgataagtatgtgcctaagctataatctttttgcaatgaatttcctgggtgttctttgagcttcttgtacttggatgtctatatttctagctaggccagggatgttttccttgattattccctcaaataagttttccaaacttttagatttctcttcttcctcaggaacatcaattattcttaagtttgttcaataatcccaaacttcttggagaatttgttcattttcttaaattctttttttctttatctgtgttggattgggttaatttgaaagccttgtctttgagctctgaaggtcttccttttactttttctagtttattgttgaaattttccagggtattttgtatttatctaagtgtgtctttcatttccagaagttgtgattcttttttatttatgatgtctattctctggagatttttttcatccatattctgtttttaagttttggttgttttaatttaagtttgttttctcctttctttggtgcctccttgagtagcttaataattgaccttctgaattctttttctgacaattcagatatttcttcttggtttggatccattgctagtgaactagtgtgatcttctggaggtgttatagaaccttgttttttaatattaccagaattgtttttctggttccttctcatttgggtagactatgtcagtggaaagatctggagcacaggagctgctgttcagattatttttttctcattgggtgctcccttgatgtggtgttctcccccttttcctagggatgcagcttcctgagagctggactgccgtgattgttatttgtcttctgggtctagccacccagtggggctacagggctctggtctgatactggggagtgtctgctaagagttctgtgatgtgatctgtcttcagatctcccagctgtaagtaccagaacctgctctcatggaggtagcaggagagcgaatttgaggctgtgagagtccttggttgtagttgtttagtccactgtcttttttgaatgctgggtatgctagcagtaaagttgtcatatggacagactcaggacttctggttagcaagggtgttaaagttagtagaattagctgttattttctccttccttggagcagggttgttctgttatgacttgctgtaatggcttgagttggttggccttcatccatgaggtaatgctttcaagagatcaccagctgcagtagtatagaggggatacaccttgccctgaggccaccaggataagtatttgggtttctctggtaatggatagggctatagagcttccaagagtttgtgtcttttgtgttcagctaccagggtttgtagagacaaaccatcaggtcggggcagggttaagtgggtctgacctcagactctccttgggtggggcttgctgcaaccactgtggggaatgtgggggttgttctcaagccaatggagttacgttctgaagggaattaaggctgcctctgatgtgtcatacaggttgtcagggaagtggaggaaagctggcagtgacaggcctcacccagctcccaggaagccagcaaggccagtctcacttctgctgtgctctgtcaacaacaaacagtgccaagtttatatccaggcctccggcacacagggctacaagactccctgctgagaaagaaagcagggcttttaggctttgcccttccctgtctgccacagcttctgtgcttatgtctgcactttgcatttgctccccagactctgcccaggaaaattcactctctcttgaatttactacaaagtttagtggaagccttcttctccctgtggcccttccctgattccactggctgcgttccccaaaggcccctgtgaaattaaagtcagaaatggcttccttggggttccctgaagattgggcatgcctacaaggctcttcccattgctcattctacttttgtattttacttggctctctaattttgtttcagctcttggtaagggtaaattattctcttgtgatccttattttcattttcctgagtgtattagtccattgtcacactgctataaagatactacctgagactgggtaatttataaacaaagaaggtttaattgcctcacagttccacatggctggggaggcctcaggaaatttacaatcatggtggaaagggaagcaagaactttcctcacaaggcagcaggagatagtgtgaacatgtgaaggaggaattgtcacatacttgcaaaaccatcagatgtcatgataagtcactcactatcatgagaacagcatggggaaaccatccacttgatccaatcacctccttcttttgacacatggggattacaggtccctccttgaggattacaattcaagatgagatttgggtggggacacagagccaaaccatattactcagtgaggatgtgtgtttgggggcagactttccacctctcgcactttgggaacgcacaatgtttcagctgtttcatggaggttgcagcagcaagccacttcttccaaagggtttgtgaattattttggttttcctgttgtgttccctgcagtggttcttggagcaaaagttcacaatgtgaatctccacatgctagttctgtccatctgagtgggagctacaagttagtcttgtctcctatcggcaagttttttcatcaccaacttcctttagtatttcttataggacaggtgtgatggttaatactgagtgtcagcttgattgcattgaaggatacaaaatattgatcctgggtgtgtctgtgagggtgttaccaaaggagataaacatttgagtcagtgggttgggaaaggcagacccactcttaatctgagtgggcaccatctaatcagctgccagcatggctagaatataagcaggcagaaaaatgtgaaaagagagactggtctaccccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagactggtctaacctcccagcctacatctcttttccatgctggatgctttctgccctcaaacatcgaactccacgttcttcagttttggaactcagactggctttccttgctcctcagcctgcagatggcttattgtgggaccttgtgatcatgtgagttaatacttaataaactcccctttatatgtatgtgtgtgtgtatgtgtgtgtgtgtatatatatatatatatccattagttttgtcccgctagagaactctggctaatacaacaggtctgatattgatgaaatgcctcagctttttgtctggggaagtctttatttctctatgtttaaagagtattttcactggatatgctattctagggtaaaacttgtttttgtttgtttgtttgtttgtttttattcagcactctaaatatgtcatggcactccctcctggcctataaaggtttccactgaaaagtttgctgccagatgtattggatcttaattttatatatatatatatatatatatatatatatatatatatatatatatatatatatatatatattttatctcttgctgctgttatgatcctttctttatctttcatctttgggagtttgattattaaatgacttgaggtattctttgtattaaatctgcttggtgttctacaaccttcttgtacttggatatcggtatttttctctatgtatagaaagttctccgttattatcccattgaataaactttctacccctatctctttttctacttcctctttatggccaataactcttagatttgccctttggaggctattttctagatcctgtaggcgcccttcattattttttattcttttatcttttgtgtcttacgattgtgtgttttcaaatagcctgtcttcaagctcactacttctttttttttttttttttttttttttttttgagacgcagtttcagtctttgttgtcaaggctggagtgcagtggtgcaatcttggctcactgcaacctccacctccccagttcaagcaattctccagtctcagcctcctgagaagctgggattacaggcgcacaccaccatgcctggctaatttttgtatttttagtagagatggagtttcaccatgttggccaggctggtcttgaactcctaacctcaggtgatccaccctcctcagcctcccaaaatgctgggattacaggcatgagacaccacgcccggcccaagctcacgaattctttcttctgcttgataaattctgttatgaaagggctctgatgcacccttcagtatgctaattgcatttttcagctatagaatttgtgctcaattctttttaattatttcaatctctttgttaaatttatctgacagaattctgaattccttctctgtgttgtcttgaatttctttgtgtttcttcagcacagctattttgaattctctgtctgaaatgtcacatttctctgtttttccaggattggttcctggtgacttatttagtttatttggtgaggtcatgttttcctggatagtgttgatgctagtagacattcttcagtgtctgggcattaaagatttaggtatttattttagtcctcactgtctgggcttagttgtagacatccttcttgggaaagctttccagatacttggaaggattgggtattgtgatctaagctgtatctactttagggggctccccaaacccagtaatgctgtgtttcttacagacttgcagaggcacctccttcacagtcttggacaaggtccaggagaatcctctggattcccagggagacactcttgttctcttcccttcctttctctcagtcagtctctttctctctttctctctctctctgttctgaaccacctaaatctgtagttggagtaacataagcaccactgtggctgccaccactatgatggtactgggtcagacctaaagacagcacagtgctgcatctcacccaaggcctgctgtaactacttcctggccactgcttatgttcactcaaggccttgtggctctacactcagcagggggcaaaaccagccaggcctgtgtccttttcttcagggtggcgatgtccctcaggccctgggtggttccaaaggcactgtccaggagtctgggactagagtcaaaaaccttagacgtctgcctggtattgtattcggctgagctagctctcaaatcacttgatgcagttcttcccacttttctcttccctttccaaaggcagaggagcctcactcctgcagccacaaccaccgcaggccatgaggagtactgccagactacaagccaatgtttccttaaggcccaagggctcttaaggcagctgtggtgaatgaggaactggactggaactcagcttttagggcagtgggctcccttctggcccagggcaggtccagaaacatcatccaagagtcaggtcctggaattagggaccccaagagtctgcttggtgctctgccttcctgtggctgtgctggtacctgaggccagcaagtctcagtgtctcacccaaagcccttgatgcagtacctgggtatcgctgctggttattcagggactaaggaatcttagttagcaggtgatgaatgctgtcaggactgagtcccttccttcaaggcagtgggttcttttctggcccagggtgtttgtctaaaaatgtcatttgatagctagggcctgtaacagggacctcaggactctgttgccctatcctattgtgtctgacctggtatccaagaggcaaggcaaagtcctctcccttcttctctctcctcttctcaagcaaaatggaggggtctcttggagctggaagctctgcaacttggggattaggggaggggtgatgccagctctcccttggctgtcccagctggtgtctcagtagtcacgtggcccccccagtcaactgtctgtgagcctagttcagcattaagtgtcacctaagatttgtagtccttatgacccagactgcctttcaaatttacctggagacaagagcgctgtagccatctgtgctgaggtttgaaggcactcaagttctgatggctgtgatccaggattctcctcaggctggggctggtttaaaggttccctcagtgggccagtgtcagttgagtttggttcagttttcttttctgttctaacaggacaccactgagtttagtgcctcacaattgctgtgctctccccactactctgcctagagatgctctgggcacccctccaaacctgccccaggtcagggaggggtggcatcatgattcaaaactgtttttcctatcccttcagtgcctctttcgacgatacaaagttacaaccaggtactatgagtgctcacctgatttctggttcttgtgaaggtgtttcttcagtgtagatagctgttaacttggtgtccttatgggggcggggttgggggatgatggagtcttctattccaccattttgctctgcctcttctctagaaggcatttttattatatacaatgaagaaagtattatcaacaatatataaataaatgctaagtcaattaaaaagcaccagcaatttcatagataaatggccacaaatcatgattagcactttacagaacaggaattatatattgctagtaaacatatatgaagacatattttggacttaatagtgattagagaattacatatcataccatggtgagttctcttttaaattcatttgattggaaaaataaaataaaaaggtcattatatcaagtgattaaaaagacgtgagtcctctgagtcttttatatatcatttctttaaacataagttgataccaatgctttggaaagcagttagatattattgtgtataattttgtatactgtgtgatgaagtaattttggctgtagatccaggggataatctctcctgtgtactctggaaacagcaggttcacagcagctctcttcacaatagcacatctgtagaatcaaatcaaatgcttccacattagtcaagtggctgaatatcatgtaatatgctgttataaatccacaaaatgaatataccacaatgacacacaacagcatgcatgaatcttagcaatataaacataaatacttagcaatttaaacataaaacaattaaaatgaaattaaaaattttggaaagaaacatagatgagtaaaaagaatatgaaaagaaaagaaatggaatagcaaacaggcttcagaagggttgttctcttgggagagggaacagaggaaatgaggtgaaggaagagaaaataaatacatattaatgattggtgagattctactctttgtattgtgtggtgggccctcagttgcttattacactactcaagagggatgactgcataaataaaaacagacagccatgcatgaatcagttatgacagtatcatgcatatacgtacagttgagcaattctatacaccagggttggaaccaaaaattgccatctacctacttcacaacagtaatctactgccattattccagagccagttctgagtcttctgcttctttcacctttcttttgagcttcattaggagcatgctattattttattttgctcattctttaagactcaggtcccgctgctggcatacagtgattcacagagtaggggatggtgtgtttcctctgctccattcggtctttgttttcacaacaggcagattagaagtttcttattgaagccccagaaggaaaccatctctgctcgcccatctttttgtagtctcccagcctcagtcatgcagagaaacttgaagcttctcttcaagctctgaaggtcagccagaccagaaactaatgtgacatagagtctcttttccaatctctgtaggtcaggctcttgccaggatctgtctcagcctaatctaaaccatggaccctatatcaccaggccccaggcactgtcttctctgaagggtgcaagacatacctcaaatattttttattcttcaggactaaacgagacttgaaggctcagttgcctccttcaattcattggctcccttacgtccacagcagcttcttggctcataggaggtagatgtgttaggtttgatagcaaagtgtagccaggatgtttaaaatttgctattttcccagaaatgtctactctcttaaatattcttttaattttaataaagttttcatttttataggattatccgctcaaaattataagaactttgtatttatctattcattaaccccctttataatcatttcttttccttcatttgcaagacgtaaccattttttatattttactttgcaaagtaaaggaaagatgaaactctaggaatagcaagcaaagttttaacatttacagatggcagagcaggtttgagaataatctaactttgggaatgactacaaagggtgttaattaagtagcaggtgttttatcacctatgtctattcaaaaaaaaatgtagcacagatgtagaaagcttaagtacatctatagtttgtataacaaaactctatattcattgggttccatctgccacactaacctcaaaccacacttagtgccaaccaattaacaccttgattaagctatagaccacctgcagcttcagcaatgtaatgaattcactgacttttatacaaattcattgtaaaacctagactgaaactgcatagcaaaaagagaaaaaatgataaatgattcatgcatcagccttggtgtaggcacacacagacacacacacacacacacacacacatttactaaggcatgcacatcaattgtctcatctctgctgctctcttcattttttaaattttctttaacaaaggagacttggctaaaggcatttcaggcttataaacccacaaactataagcagaaaagaatatcatatcctcctccatcaactcaaattttaaaaattccaggaaagtactccaatttgcttaactcaggtcacatgctagttctgaataggattgggcattctggttgacacagtttaaattggttgcctaatcctgtggccacaatgaaaggatatggctgacagaccctaccataaccatgcggcaaaagcaggtgaccaaaatatatttagtctgaaaaaaaataatctaaatgaataatgtaagataattgatacatgtatgtgttgttagaagtatattaaattctctgtcttcactttttttggtgaaatcttcattgctcacttatgaattatggaacagcttttctttccatactgagaaaaaaatagttacttcctatcagagaaaactaagagataagttaaaataatttaaagaagaaaagagacattttgaataatgaattttgtgacacctgacctactaacagttggcaggattgattagagaggagagagctggaaaaaatagtagacttttatgatcatctttatgtaatgttgtaaatggaggaaagttaaactggaaagataggtctgtgtttctggagaaaggttatacaatgaggaggtagctgggtgatgactgttctactcacgctgtcgcaatgtttgcagtagttatgaattatttttttctcaacttatcatggcagaatgccacttataatttaaaaaaataacccagaatccaggaaagatgaaaaacagcaacaacagtataaactagggtaaaaatatattttatttagcacagctcattttgttttactttattttgtttatttatttattttgagacaggatctcactgtcatccaggcggtagtgcagtggcctgatcactgctcactgcagcctcaaccttctgagctcaattgatactcctacctcagcctcctgagtagctgggaccacaggtacacaccaccatggtgggctaatttaaaataaaatattttttgtaaagaaaggttcttgtttggttgcccaggctggtcacgaactcctgcctcagcctctgaaacatgagccactgtgtccggagcacagctcattttattaagaagctcattgcagagctagttatccaaaactatgagaagagattcatccagttattcaggatttagcatcagggtgtattctaaataaaggggctcagaggctgtcatgactttaagtgtcatcattccataccaatcctttttatgaaaaggaagaaaaagaagttctcgaattttatttgttctcaaggagaactctcaaggagaagaatggcagtttttagtttacattattatattcatatggctgatgttttacttctgccctcaaaatcctctctgaaaaaatatcttttgtagcctaccctaattggaaatatacagagaaggaaattctgggaatcacagttcaatctgatccagtggacacattatagtcactacagttcatgcattttgaacctgaaagctccacacttctttttaagccatatgtaatctacaagtaaacaaagccatactcctgcctcatatgaaaatatgacatatctctcctgccttataactgaacatagacttagtcttcattctaacggttacaaagtcccatttcaaaaagcagttttcttctttcatctgattcacactccttctttaatatcctataacttacttagtgagatatgcactgatagctactattaatgcattgtgtgtttggcgataggggaataggaaggggaaaaacaatacttgttatatgtgtgtgcatgtatttgtgtgtgtgttcatataactaaggaagaaaaaactattgtagtcttaatttctgcaatcagtcatgtggttgcagcagatacttctatctgcccttttccactgcccattccattttctcagcagtggtcaactacctcaagtgagactattacaggttctacagacaagggaaagctagctttctcaggcaggaatggaaagaaaagtaggcttagtggaattcagggattcaatcttgtcatttcatctaaatttgcctatatgtccccatcctaattttcagggttccatttatttccaattaatgccccaaatttgagaaaaatgattctgtgagttaggaaattcaatttgtattgtaattcagccattatgattagattttgggtttggtttcagatctttcagacctgaggttataggagataaggatttattttagggaaggcttagaacttacccaggttcttactgagattcaatctgagaatttaaagccatgagattattttcctttgataactactaaatactgtatcaataagaagcagaatcactatgaacattatacacacacaaacacacacaacttgttacaaggatttgagtatatacaattatgtgagctggttgcaacagtctctgtaaatttgctgattttggatttgatactggtgcttgaagactctagggcaggatcagtcaggaaggaaaaagaaggatgtaaagtgggagagaggaaagccaagtttaaacccacaaatatgagctgaagcccctgaggacaaactggagcacatgttcattctacaacattggtgataggggttccctacaggagaaaccggtacttcctttttggcagtaagcagaaacctctcccaagagtttgggaagctgcaggaaggtccatgggtagcctagccactgcaccatggtaatcagttgagcaagcagatgagtgacatgtattaacaacaaaagctctcttgactgtctcaatctctttccaaacataagaaaccatatgactactgcttggcttcttccctctaaattgcacacgaaaatgtctctgtggttcactctaatctgaaatatcaagggaaggaatttctggaaatgtaatttagtctaggcaagtctacacattactaagccaccacatggtatctttaggttgtttcgatattgtttgggtattgtgtgtatacaattgattaatatttctaagttttgttttataaattgactttcattgagatctatttcttgtaaattcaatcatgtggaaaatacaaatagtaaatcaaatataattttatataggtttgagaaatttctgcatttctattggcagtaataccccagactactctctgattagtcttacgtgcatgtaatgtactttttggtctttgacattccaaggcagctcagtttaatgattttgtcccccttatttcattagtactcatattttatagtaattaaaagcacaggctctggatatagcctaaaatcaaatgtcagcatcaccacttattagctgtgaccccaggtatactacttaactgctctttgcctagttttttcttgtgtaaaatagtctaggattaaattagctgatatttataaagtgttcagaatagtgcttgtctcattatgttctgtattttccccatatggtatatactaggggagggattaggctttttgttgaattttttcttgtttttttaatgaatattcaccaataatcattcacccaaaattgtcacaaacactcatgttggccatatggatcaagctctcctaaaatgtggtaatcatgtataattttttgaacatgctttaatacacacacatacacatacatgcacaactatttccagaattattgtgtctttttttatatttccagcagcaaggtataagaaatccagtttctctgcatcccttgcgagcatttcatattgtctatattgtattattttatctgttctaacaggtagtgatatattgtcatggttataatttgcattttcgtaaagctaattatatcagacatttttttcatgtgtttatttgtctgttaatgtcttttgtattattatgaattggctttctttaccattgaatttttcaggattctttaaatattctagatacaagttctttgtgagatatatggtttacaaatacacactctcaatctataggttgcctttttatcctctgaatatggtctttttaatcttgattaagtacagtttatctgtgttttacttttaccgatcatgattctgtgtcatgtctaaaaattctttgcctagctcttggtcccaaagattatctcccgtgtttcttctaaaagttttattgtgttgcattttacatttcaatctgttatacctgggccatcttttgacaacttctatggttcactgcccggcatcttctatctagttgttcatagtctcctatccttttataaagaaatgttagtggcatcactgggtcaaagaagtctttttttacagctccgggatatggataggtgtttcaaacaccattctaaatttctgattagcttcatgtgcaaacgactattctaagcaaatcttggataacctctacctttggttaacgatattttgaaatactgatgtaattattcttccttatcctaatagtaaaaaggatgaatgaacttttttcttcagtagtctcaatataagctgtgggactaatacttgtcataggccctttgaaatagcaaacacagtgactttcatactatttccacatccccctaagctcttgagctcacatttgcatttctcttcccacttttcccttctatatacagatagtaaatacctttgaagatatcattcaagtgagataatttgttgcaatttttcaatgtttcattctagtttatacaggtcaatgcctttgctatgattttaaggcttaagcaaaaccttggtgttttatgaatttctacttattgagcaaaacctatatttgagaaaacaatgtgtatagtggcaaattgtaagaaaatatatccatctctcaaaattgtataaaagtatagtagctttgaattctaaaatagatccaattcctcaaattgactatcattatttttttcctttggaactataaacaatcaccatttctgattaatttctgtcatataaatcacaatccttgctttgtattattttacttgatatattctatatataaaacatacagttcacatatagttaccatttcttttccatacaacagctaaagatgtatttgactattgaaatgcttaagccttacttaaaaaattttacatttttataatactaatttttaatagcacttttgaagataatttgaaacaaaatttgagaataataaaatttgtcattttataaatatagaaattgatagactacagagttgatgattgcaggtttgtagtttaaattggaaagattttgtacaaatctctctgatagtcaatactaaatcagtaatggagtaataaaaacctcttaaattgctttaattcatatattcacttatctaaataccactggcctgtatcttaaattattgagaacacaactgaaactcagtatgtcaatacaaagggttctgaacatctaaataacaaatttcaaaacccatcaaataataattctcaagaaaatctttcaggtaactttcaattctaatggacgcttgaacatctattgtttttgtttgtttgtttgtttgtttgtttgttttaatgttagcatattagaagttgcaatgtggctgggtgcaagtggctcatgcctgcaatcccagcactttgggaggccagggcgggtggatcacaaggtcagaagatcgagaccaacctggctaacacggtgaaaccccgtctctactaaaaatacaaaaaaaaaaaaaaaaaaaaaaaaaaattagccgggtgtggtggtgggcgcctgtagtcccagctactcgggaggctgaggcaggagaatggcatgaacccaggaggcggagcttgaattgagccgagattgcgccactgcactccaccctgggtaacagagtgagactccatctcaaaaaaaaaaataaagaagaagtttcaatgtaaaggaaaaagaggctttaaaaacagcagttctcctacaactagaaatggcaccactatcaatattatattaaatgtcaatggagaaaaaaggaataatgccaatactatcaaaaataatttaaaaattttagcagttaagggatgtttaaacggtgaatgatactttgaaaggaccactgtagagtaaaatatttgatgttcatagtgattactctgagttattagaaaatatacatcgagcattacattctgattttaaaagggtagtgaaactactccatatgatactacaatggtgggtacatgtcatcataaatttgtccaaacccatagaatgcataacaccaagggtgaactctaatgtgaaagtgtgaactttgatgataatgatgtgttcatgtaggttcatcaattgtaacaaatgtaccattctggtgaccaatattgatgacgagggaggctgtgcgtatataggatcacgaggcatataggaagtctctgtaccttctgttccgtttttctgtgaacccagagctaatctgaaaattaatgtctatttttaaaaaactctttgagctggatattggagggaagaagaaaaataaaacgatttgtatggaaaccctgggctctggaccctagattatacatatctgaaaacaaaagagaactttagcttgttaggctgaaatatctgcattcaaaatactccactgttttacctagtgacaatggatgaaaaaaattgatttacatatgtataactaaaacacatgttggggtggtatggtatgctatgctgttggaagttaggataacggtaatccttgcaggggtagtaactgaataaggggcttctgggatgaagataatattgtttctttgatcctggggctggtcacataggtgtattcagttttgagatgagccttacctccaaatctgtccttgaataaatttcttgttggttccccttggttgatcaaatcctatcatctgctttataataatacaacttaatgattaaaattttaaatgtacctaatccctaatcaaatataagaaaaatgaatagaacttaattgcattgcagctaagttccaatttcataagtgaaaaggaaattgttttcgtttattttagctttatattaaaaaatacacgaacaattgtttggagactgttatggaatttcctagtcatttccatgaactatttctggtgggttttgaaactaaatgtagttacagggcaattgtttttgctgtgtaattctttatgtctaataattggtagtcttcattcaagataaaatgtcttagatattataaattttcttctctgcccgaatatgctgctatagactaaagtgagtatctttaggaaaatacatttgtttcaaaagtacatcctgctattatgcacaagtattaattgttttgatgtgtgcctttttttgtttttgggacggagtctcgctctgtcgcccaggcgacctcggctcactgcaagctctgtctcccaggttctcctgcctcagcctccggagtagctgggactgcaggcgcctgccaccacgcccagctaattttttgtatttttagtggagacggggtttcaccgtgttagccatgatggtctcgatctcctccgcccgcctcggcctcccaaagtgctgggattacaggcgtgagccaccgcacccggccgatgtgtgccatttttatcatgactagaatcactcatgggatagatttgcacatttttacctcaggggttgttgaagaagtcaggccatgtagtactcatgaggccttgtagtactcatgttaatttatgtcatgttcattttgtttcactggtaggcaaggaagaaacctaggccttcagatttttggttttgctcaactatcagaaaagcctacatgaattatgtagacactgatttggttgcagttcatttataacttatgagcaaattatatttctagtaagaaaagtattctataatttgaagaatctcaatattttatatgcttcaaaattgacagtttaatttcagggatttgtactttaaatatgtatattagaaagaactttgaatagttcatggagaatctctgaagtctcagaaagaatctgttccatatcaaagaaataagtggcagctacagtttaaaattaaacttaaataagaccttttctatgcctgtctgaacgtttcatttctttagatcttgatgttaatagaatgtaaatattctccaacttcattatttcactgaaatttccaagtattcaacatgataaaattctttctttttaagtctttaaaatattttggtgacctttgctggtcttttcatttttaccaaggcagagtttattaggtttatgttttctatttccatatcaagttttattcatgttaaaaacttaaaattaatggattatgtaaagtgataagtgcatcaatgaatatataactggctggattttaaacatacataaataagtatgttttaagtccttcaatgaaggcacttaatctatttctccctcatttcccttctgtaaaatggggatataataatatacttaaaaccttagcagagtgcttgacacataagaagcgctccttgagcattaactatattattattttacagtgatattgaatatttgatgctgtatatggtacttttaaaaaattgattgtctaataagcagaaaataaggctgtggtaaatcaaataaaggataaatgatttagaggctaatttgaagtaaagtataaagtatgctcttttaaatttttatgtttttatgaaagttttgggtgcttatagcaacttttgaattcctttcagcagtgtgttctttcttacacaatttcagagttttgaatctcttccttgggaaactttttacagaaaggaagataatcatcaaaaatttgtgattttaaatatcctcttaaaaccaaagttcccctttttaatggtttactgttacaacctattctctataaagagagaaaagatatagtccacatttatactagcttcttttaaaatattttagaagaaacagaagaatgattagtagaggttttcattttccattgataaaaaatcgagaatgagtctttctacctgtagtttttcctataattgttttttcaaatgcagtctactatgtgaattaactactcagaatccattctcaatccctttctcctttgtcttttattacttttcagaatgggaagcttaaatttttgatttcacaggcttctttgcctctagggttacttggttactcatgcaacacaattctgctatgaggaggtgtttccttccagaataaaaaggcctcaaaacaccaggagaaaatcctatgccttttctccttcctctgaattaaaatcttacaagcctactccagtctcatcttaagccctcctgttcttctctcactggctggtgtgctccactttttgcttaaaaacgtaccctgtgcccagaatactctcctcagcaatcctccccttctgctatcaacttcctcataatctagcccctctttccccaactcatccaactagatcaggcttcctctctcatgtattattcctgtgtagtccttatcacatttttatgtatatatgaaatatctggatacaagccacaagcagcagggacatctatcttctttatccctgtaccttaaggagcaagcatttaatgagccagttatcatggggcaagcactgttctaagcactttacatgctgtcactcatgctctgttcattacaatatcttattttataggtgaggcaactgaggtagtgaaaggtgaagtcgtgcatgggtagcagagctggatcaaatgtaaatagcttgccccagagtctttgcacttaaccataactgccaggaactatgtctctagagaggtgctggagtgaagagtttgaggcattttatttgaaaaacaacactaggccaggcactgtggctcacgcttgtaattccagcactttaggaggccaaggtgggcggatcacgaagtcaggagatgagaccatcctggccaacatggtgaaaccctgtctctactaaaaatgcaaaaattagctgggcgtgatggcttgtgcctgtattcccagctactcaggaggctgaggcaggagaattgcttgcacccgggaggcagaggttgcagtgagctgaggttgtgccacagcactcaagcctggcaacagagcgagactctgtctcaaaaaaaaacaaaaacacaacactaatagccactctgttgtgtaatgttctaaatgacatttagaaacctttgtgcattattgtgtattcttcaatagctcttatgtctaaccatccattgcttgcacaacttccttttgccacatttctttgttgtgttatatgtgaaagcagttgttctctagtattaaagtgcatgagcaacatggcagatacctttagaaagtgtacattctcagtgcttcctctaccagtattctgattccacagatattctaaggtaggggccaatcatcttaaaaaaaaaaaaaaagaaaagagaaagaatcccaatggactcacagagtgggtttgctgaaaatgaatattcccttaatgaatatgataaaaatgaaacagattttgttttaaaaaattgcaattataaagttaggatagttacatcattttttaaaatatagcatttttaaagtgtcccagaggctagaattattttttaatattagatttcctgtggatgatacaactacaagcagcactgtaaatataaaagatcaaagtgggctaagcaacatttctaggagatgattttcgactcacaaagcaacttcctggactttttaaacacatttaagcacagtaaacaatgctatctcaaaatgaggcaaattcaactttttctattccagtaaccatattaagtcagtattttttttccattttctaattactgcacttattttatcagtgtgttgttaattatatttaatcctatgaaagagcaaaattaaacaaaactaattgttccttgctatttacttatatatttatatacatctgtatatatgtttatgtgcaggtttatttttatcatattcattaagggaatattcattttcaacaaacccactctgtgagtccattgggattctttctcttttctttcttttttttaagatgactggcccctaccttagaatatctgtggaatcagaatactggtagaggaagcactgagaatgtacactttctaaaggtatctgccatgttgctcatgcactttaatactagagaacaactgctttcacatataacacagcaaagaaatatggcaaaaggaagttgtgcaagcaatggatagttagacataagagttattgaagaatacagaataatgcacaaaggtttctaaatgtcatttagaacattacacaacagagtggctattagtgttgttgttttttttttttttctgagacagagtctcactttgttgccaggcttgagtgccgtggcgcaatctcagctcactgcaacctctgcctcctgggtgcaagcaattctcctgcctcagtgtatacatatgtatgtatgtatgtacatatgtgtgtatgatgtaggtgttggggaaaagctgagtgttgggaaaaaagctgagtcagggcttgcatgtctgacataatgtaaaagagtcttggaacatgtctgggggccaggatttaaaaccccttgtagcctttggaacagcaagctctgtgccaaagggtagaaggctgccctgctgcaccataatctaagtccagggcataaaatccctcttggcttggatggaatccagggctcaggggataaaaccccttgtggcctctggaatgcatctagacttgctggctccttgcttcaagcactcccaggatcatagatcgattgcatcttaaactagaagaacatgttttccattatttcaagtagcagaacatgttccatatgcttcaaaagaaatgctaaaccattacagctgtcgatcatgtgcttgatatactgctttctttcaacccccacatcttcaccacctgcttctttgtttgatcaccaataagtagtgctggcttccagagctcagggcctttgcagtctccatactagcatcggccccctggtcccactttatgcactcttaacttgtcttgtctcattcctttgactctgccagatttcgtagcccccactgcctggtgttgggtctggtcactccaacatataggtagccttggtccatggtggtgctaggtctctggttggtgtttcaccatgtgtttgtgtaatattacataccaccacttttatcttaaatatatgtttggtgtgcatacagtttacctaagtatgaaaataaatgttggaaaatctttgtagaatatgcctccatagactttaaaaggaagtattcacagttgttagtaaacatatcctttggttcttaatgatattatagattgctttctcactgaatagaatttttgtttcagattggataaaaactgaaaagataaatatattctaataatgattaagatacaactattttaattaacattcacatttaatttgataatcagattgtattaaagtatttgtatttttctaatatgaatggaatgctaggtgtgtactcaccagacttctctattatacctcgattatactcaaacttaaatagattgatcaatatttaatgggcttcagcatgtgaaagtgggatattttgatttgtttcttttgattttaaaacactggattttgaagacttaatgccaaagtaggcttcaggttctactgctactttaatgtaaaaatttccttcatcactcattttgtcttttgtttaaaagtttgttttaaaaagcacagcattttaatgataatgttattgtttttccctgaaagataatttaattaaaatattcaaatattctttttgtcaaaaatgtgttacttatgttcaattatcagtgaatccagataataattcctgaattaccccaccttataattatccagaagaacctggtttctatagaagtatatataccatctttcctcctcaaagactgtgctgatgttctgctaacagaatgtttatgatacttatgtattattgtgagttatgtttccaggatttctaaaatatatttctatcttttccttagcagctattttcacctataatatacagtattgataaaccttattaaaaaccttctccaggccagatactaggctaggtgccaaggtttagttgtgaacaaatggtctatcaaccttatatagttgtggggaaaggtgaggggtgagggggaggggaaaggtttggaaagatagacatcattcattacaaggttaaatatggaactcagatctgaagtatgagtagcagacaacaatttgtaggaggtgggaggggtagcttaagacttctctaagtaaaaggattagcctatgcaagaactgaaagaattcatggaaagtgaacacagaatatccaaggaactaaaagaaggccagtgtggaaaaaacgaaaggcaatagggaaagttatgagagatgaagctagagtggttgccttaggccacgccatgtagttgcaaatatattatgtttaggattttgtgtgttatcccaagagtaaatgaaagccagtaaatgttagttgacagtacaattaaaatctttgcagtatctaataggaatataatatgacatatttagccatataccaatactaagtaaggaggcatcatttgaagtttgaagataatacttaggccaaatttgtcaataactgattttttttcattgcattcagtaataattttttctcttttcaagaagcttattatttagttgggaaagcaatacagaaataatttacttactaatagttaacaaaatataataaatattatagtgtcaaaaaattatgacagattatgagttgctgagatctctaaagagatcagattgtattaaagtatttgtatttgacaaatactttgcatttgacaaatgtttgtaaatgaaggacaaaaaaatacgattcaatattccaagaggttgtaataacctgtaatgtagataggttcaagaatgtataagacatatttcttgaattatgtaattagggcaccaataataggtcatgatggtaatttgggcttagatggacatcaatctgaaatctgagaattttcaggttaatttctgtacaggagctaatatatttgcccaaaaaattaactttagtgtgactgtatgatcagatctgttgagctgtgtaggaaacatctgccagttcacagaaggtgtttattttcatgatgaaataggaaaataaaaaattctatagtgagttcttaatcccttctgtacaccatgactatggttcctctaattttaatcaaatatggccttagatttttatgcatagactcaagtttagtttacaatactaaataaacattttgttaatgtgaaagcgttcaacaatatatgcatttaaaaaaataaacagtaagcagtgtttaaaaatagtaaacaaaaaagtaaattaaattgttgtattttgtatgtaacactagcaagtatgttttttaagtgagaaccatcaaggcagttcattattttaaaacaagtgaaatggttgctttcaaacacacttagaggattataatcactaaaacttttatggacagcaatttgataacgtatacataaaacatccatcctgtttgatgcaatagttacattctgacagtcttccacaagaaacattgaaacattttgataaggatttattgagaaaaatgcattttgaattatttttgcttcctatataagatgtaacagcaactaaatatctaaaaatacaaagttggttaagagaataatggctcatacatttgatgagctattatttaatacacaaaaagggtgcatacaaaaactttaatggaataagaaaagtttcatgatattatcttagtgggaaaaagtgggaaattaaattgtatctgtggtgtgcatgatgtattagttttccattgtcactgcaataaattagtataaacttagtttaaaacagcacaaatttattatcttacagttctggaagtcagtaaaatcagtctcagcgggctaaaattgaagtgttgtcagggctagtttcttctggagactctacaggagaattagattttttgcctttaagtttttagaagctgccttcattctttggcttatagtccctgtcatattgccttttctccctctgtttccactgtcacataggcttctctgtcactgacccgttggtatccactttataggagccttatgattacattgggcccaatcagataatccaggatttatcttcccgtcttgaaatcctttacttaacacatctgaaagtcacttgtgtcatgtaaggtaacattatttataggttcctggaattaggatgtgaacatcattttggggacattattttttctaccacacatggaataactatatttgttatttaaacaaggacactgttgaaaattaaagagggcgttattaataattatttcaggataacagaggtaaagaggagctcttcttagaaaatccagatagtaacctaagtacacggctagagtgataagaaatgacaagctctctgagtttaaacagatttcctttctttgaaagtgtcatgtttttgttatcttgaaaaactagttttttcctttttctttgtagttctggaatgtcaccattatgtgcctagtcgtggatcttttaactcactatactcaaggaagctcattatactcaaggattcttggattctcagactcaagagaaacactaagaaatttctattattactctgactttttcacctcaaatattttttctctttcctctttctgaaacttcatatatgtgtgtgtctgtatgcatgcatatatatacatatatacacacacatattcatatacatattgacccttctaagtgggttctcaatttctcttaaatttttgttgtattttctatctctttttgagattctgagatttagtacactttatgttcctatttactactatactcagcttaacttgcctgctttatggatctgtggactttgattttgaaacatctcacatgtttgcccagcatttcttctgctctggtttctctttcaatattttcccttgcacatttcagcttcataaaagttattagaatttctggttctctgatggtatctttttctgttcttagtgctgatatagattaattcatttttaaacatttctgcaataatttaaatgaaatttgaggagcacatgttatgtttatattagctttccaactgaagctaaattgtggctgcatattatttcactgtacaaaaaggttataattagcttacccaggtacttaatataagttgtttctactttaatagctattatgatattaagtattccatgctggataaacacacacacacatacacacacaaacacacgtgcacataaattagggaacatatctgtgattatttccctattaagggacaaggatatgttgaattgaggttttccttttccacaagaaagattgcaaatttcaaatttctactaattggtctgagattgttcagatggtagagtttcattatctgatagtcatgttctataaagtgaaggaatactgaaccattgcttctaggagaaatgaaggctcaaattcctgaagatctctggtcacatttcatcaaccaataaatacataaccttgttttatgtgtgtttatttttaaagatgccttatttcatattttttaaattaattaacattgaattcatggccaacatcactatcactcatgcctgaatgaagcctatctaacaaacatattttctctgtgaggtacatcacaatcttctcgagcttaggaacactagctagacttcctcactatgcttgggagctgaaatcaagccacttaaaatagagaaatcaccagcagaaagcaaaatgatgcaaaacacctggcactagaaagaccatgaaaaggacacttatttacaatgtgagagttgaaccatgaaggcagagaaggccttattggaccttagttagaaacatgtgggttgggcgtgaaagcactgtgagcattgatttggagattacaaaatattttagtgagtgggcaattcataaatgtaaaatcacaaataatgagaatagattgtgtttcctttctacatattccataacatctattaacaactttggaatacaaaaattaatccccccaaaattcgagtttttcttttttttgaactagactgctttatttcagggagctctcaagcttcttgttactttgttaactaatcattgaattttccctcttggtcaatcatacaaaatttagaattaatacaatactatcattccccccttttcaataaacttactgtgtaatcttcagcttggcatatattaactgggagcaaaattttgacactgcgaaagaaaagattcagtgatatcattagttatcccacctatatgcttagtcttataaaacctaggactgcatgtatcatgttgaaaagatacttcaacctttgcctaacaccagtgtcccaatcagggatctactttcatttttcatttactggaccattactaatgtccaattgacaagtttattaagctttgccctcacccactttgatctacaaacctgctcagttcagaggagagaatacaagacccactgctattcgttttacagaaattcaaatgttctttatttataaatataaaagagggtttgattcagtttccagaagaagagaagacttgaagagttacactgaggactacctgatggctctgtaggtggagaaggaaggccagtacaaaggaaagtgcaggagttcagattagaagagacacatccatggcttaagagagtagcaattctaaaacattctaaatattctaaaatattatagaatggaaatctggatacaatggtgactctacaaatggagcaccataaaccagttgtagaatgcatttctatgaagtccagaaatgtattgatactcacttcaagatctcttgcctgttagaatgaggatggtgattgaggaggtaatggagaaaaggttaaatcatctctccaagtcatattcttctttttgagcatctaatttagatttcttatagaaaaagtgttttaaaagaataaaacatagacatgaatctggataaataatattgtttgtatcagtcacggactggaaccatgagaacatatgacatgaactacatgttggtgttaaataaaataattaatgcaatgtaatataaaatagatcactaggaaattcaggaggggaaatttttgaagcagttccatagaaacagagctactctgggagtcaggagttctgggagatgcaaaatccaaagcgggttcttgcacccactctgggatattttggccagtcaggttcttggtgctttgggttcctcaattgtaagatgacagaggtaaactaagtgatctctaaaacagtcccaatatctactattcaacaagtcacagtaatagacagagaagtaggaaaattgtgttttaagttcctgtcttagatgctgtaaagaagaaagtgatacttctacaaagtcaaagagattgacgttggagagatcctcttctgatttagcaaggacatagttattgaccacattagatatcatctgattataattaagttatggaacatttaagtggggaagataaagagagaaataaacatatttatattccaaatatagcaataactaaaaaaatcggcaagtcatatctcacatacatagacatgagaagaaatgtggtcactggacattgccctttttctatttttacaaatgctttctttagttttttccagagggtggtgaggtacatagggtagagtacatagttaattttatataattataaacgagtgtatttgaataaaaattctactatttatttatttatttatttatttatttttgagacaaagtctcattctgttgcccaggctggagtgcatgatctcggctcactgcaacctccgcctcctgagttcgagcaattctcctgcctcagcctcttgaatagctgggattacaggcatgtgccaccacgcccagctaatttttgtatttttagtagaaacggtttcaccatgttggccaggctggtctcaaactcctgacctcaggtgatccacccacctcagccttgcaaagtgttgggattacaggcatgagctatcatgcctggccaaaattctattttttaaaaagtatatcttacctatgtttagataatttttctgatgagttagtactcatatgggtgcttttttttttttgaaatacatagactattggtcttagacataacaggacacacactaaattctattaaaacaattcagggactcacccatgcatacagcaattatgattgtgaacatccaagacaaattagtatggaatgtcttaattaaagctgggtaaagtaatttttttacagatagattgaattttattaaatatttagagtggtatattttcatttcactcttatgtaattaatatttagcacagttctttgggtatcaggttgcattatttatgcacattttttgagaaatataatagtgtttttttgttttgttttgttttgttttgtttgttttgcgatggagtcttgctctgtcacccagagtacaatggctggagtgcaatggtgcaatcttggctcactgcaacctccacctcccgggttcaagcgattctcctgcctgaacctcctgagtagctgggattacaggtgtgtgccaccacgcccagctaattttttgtatttttagtaaagacggggtttcactgtgttagccaggagggtctcggtctcctgacctcttgatctgcctgcctcggcctccctaagtgctgggattacaggcatgagccactgcgcccggcctgagaaatataatagtatttctaagaagtctctggaaaatagaccataattttttttattatattcaaaatgcaaattttgccttttgctaaccagataaaaatacttatgattttcgtatttgcttagttacaggtattaactgagcaaaattgttaaaatgtgtttgattttgtttggatagggatttgttttcatgttttcaaactaaagttgagaatcttttccagtggcattcttaactcatagatatgatgtgaaaattgtagttgccttaatcctgctcttgttgtctttaggaaaactgtgactcatatcagtagcttattaccaaagttacatggctattagagtttgagccttgggatagaagagtaaacattctgcttttgtcatgagatactgtttttttggctatagtattccctctaaggcagcctctaagaaaagcatcatttatcttagtttagctatgagaagtctacagaaatcctttcctcattttaaaaaaatgagttttcagaaatatccacaaatattcaatgaatagttaagcacaaaactgtgtaatgtttagtaacactcaacagatgttttgctaagccttttttaaaaattataaatcaataaatacataaagaaaaaacaccttgaaaatctttatatcctttaatggtaaaataggacagtatgaattctcatctagtcctatggttttcacattgggagtaaaagcgcttggatttaatgagaagtgttctgttggaatgaaagaaaactgaatttcttaactctaggcagtagcttattagcacagtattgttctctggtaaatacctttgcttccattttctcacctgcttccactcgtaaattctcacctcctgcaatagaaactttgcctcttagtgactttgtggttgaaactagagaaaagctgtttactcagcaacatctagtattttgctgcttcttcctgggtgattagatttagaaatcatgaaaatggaggcttttttcttctactttttgtttggcaagcatgttctaattctttttttttttttgagacaagagtttcgctctgtcacgcaggctggaatgcagtggcacgacctcacctcactgcaaactctgcctccggggttcacgcccttctgcctcagcctcccaagtagctgagactacaggtgcctgccaccatgcccagctaattttttttgtatttttagtagagatgggatttcaccatgttagccaggatggtctcgatctcctgaccttgtgatctgcctggctcagcctcccaaagtgctgggattacaggcgtgagccaccgcgccaggccaagcatgttctaattcttaaaattgatctgccaatgactgtggaaaaggtaatcacttatttcatacagcaataatttattattaatattttttaaaaatactaaaaattaacctcatatcacaaacttttttttctcataaactgttgtgtcactagtataatctagaatttaggaggggagttattttttaaagaaatcacttatttgtgattttttttttcctaaaaggatgatttaaaaattatcttttgacttttcaaaatcaaactttttctccttgagtttaaatatttattatgtttcaaatgtcttaggaaaaataaaagataattttttcatgtactgatagtatatacattaattttccagagctctgtctaactagtgctgattgatcaccagagcactaatttcttcacattatgcatgcaaatataaaactgctctcttgtctgtgttatttctggcttttaaatgtgtttacaatattttagaaagttgcttagtttttgaatttctcaaatgccgcatatatcagtaagcaaaataaaggccattaaaaaattacagcagaattaaaatttcaaggcagaagtatgtcactctcacacgataagccaaaagaggtcagacttgtctttctaattatttccagagacctgccctacaaatcaggaaccatcacatggatacataaaagtgtctttaattgtgaaagcaactatgcaaattattcattgctatcatccctgatcaattcccagattattttcaaactgagagacccaaaatgacataattttaagggagttacatggaatagtcactttgataattgtgtactcattttaacatactagaaaaatatgatatattaaaacaaagctttgactgatattgtttaggataaagctaaataaaatttataaataagtcgatttaaataaaacattaaggagaaaattggaccctattgtaggagcttgactatggcagccattctaagggtagcatgtgattgaggttcagtaaagtgaggtccaaagcagcccttttggctctgtaggtattatttgattgaaaggagtcaagatttctctaagaactctcagagtaaggagccttgttttggggaagatgtccatgagtggcatacatagcagaactgtgagcaagatggcacttcagagccactgctgtcaccatctctctccttgaatcttggtctttttctccctctggtgcttctgctgtctcccatctcctccataagatttcttcctctaccctccttccaacttcaactattgctctaaataacttaatgactatggtgtttccctatgtatgttcccaaaagttatttcccagaccttgctctctaaatttagatggtcttgagttaagcaccgcacctttggtataatcagttatggccagggtgctgcagggatgccagatctacttagagctgtgagcagggcacgttcattcagacagtctgtgagctgaagaagacagtttgatgtcatctccaggatatcattaatgtcacccaggaggaaattgaggcctaggaatgattatacagcaaatgaatacacattcaagactagagtccattgggttcattgctaatcaaatattatccccatttatctgaaaatatttattatgcatcatcagcacatgagatattatgaagtaactaaaagtgatttagccatagagtctttcccctttagaaaactaatataggaaatagatcccagcaatgtcgagaattattatggactgtggaaatgaataggtttagactactataaagttgtgaaacaatgaaggttcatttcctgaatctactgaatttctttgattttttttttttcatttccttttctgtctttcctttccaggggcctagtactatcatgacatgtcttgttctagaattctcttcttttcctcactcagtccctatcaagctagatatatttgctccccaaagaaaaaaatgtttctttcagctcttttttcttcttttcctttcctttccttcctcccttctttcctttctttcttccctatttctatccttcctttctctttctttccaacattgccaactgacaaacaacccttctcaggtaagattttttaaaaggaagaacctctggaactatatttatttttttgtgcgtcactgattacttttttgttccattgtttacatttcccgtcatcttactgactgcctactgctgttcttcaagagctctatatttgtacctctttgcttttctattttattgagtctattgtcatgtcatatatttttgcatcccttcttcttatattatcagtttctaatcatatttccaactgcttttataatatttatatgggtatcacattattgcctcatcttaatgctttgaaaattaaagcatcacattggccctgctctgcaatagggatattcctatcctaggaattagttctaaataactaattttcatcaatgatcagtttttttttgtttgtttgttttattttgtttgtttttttttttttttttgagacggagtcttgcactgttgcttaggctggagtgcagtggcacgatcttggctcactgcaagctccgcctcctgggttcacccattgtcctgcctcagccaatgatcaggtctttaacttgatctttagtcttctctttcttgaatttcaggatgttaccactttttgcctttattaataatgtgcgtgtggatattcaaaaatttttaaatctattttcctctatattcaaacccttcctttccttcaagaacccaaaacctaccacactcataaaattatcagactgccacagcatttggtaacctctataactgtatttttctgacaccacatgaattagcaatcattaggttaaagagatattttaagaataggaattaatatttctagaaataaaacatctaaaaaatggtttataaaaagtcacttttttaggctaatcaaacataatatagtcattataatgttactataggcagagaaacttacagggctgatgtacagtattaatttttaggttcattttaacatgcagttattgggtccagatattataatagagtggaaagattcaactgtctattaataaaagactagaagcaatcatggcacctccatacagtaggctgttttatagttttgaagaagcttggcatatgtcctgcaagaccattgagtcaagggaaaaagcacattgcagaagaggatacacaatctaatatatgcatacaacaaatgttcatacaaatatgtacacacattttatatttgtacagggtcagtgttgaaaatggtgcaacaaattgtccacactggcttctactaaggtaatgtaatagttactttatacattttattatattttgaaatttcccaataagcctaaattaatattataataaaacaaatgtattacaaacaacaaaaaaaaataaagaacattggaaaaataaatgctatcactttaacggacatactcattccatttctagttgtttaataattgtgaaagtgaaaaaagtctcatgttacagtacattcattctatatgaaatattaacaactttaatacttaatagttgcaagtgtcatttataaataaagttatatttttaaattatttcattattttggtgctgtttataaggcttcaaaagatactcatattacttgagaaatatatgttgtcttttcttctaggtgttataaactttaaacaaatttaatttgctgtgtattttagttgaatatggagaccgacctgctgaagtaaaaataatagtaaaagtaactctatatcattcaaaaatggcatgctgttataattttatagtttcatttataattttacagtttgtaatttcatccagttctctacgacaacatacttgattcttttgggattagactttggagcaataagatgtgattttttttcttaaagtcattgtaatctaaaattgtccaggtctcacaaatcttgctgctctttttttttttcattattttttattattatacttttaagttttagggtacatgtgcacaatgtgcaggttaggtacatatgtatacctgtgacatgctggtgcgctgcacccactaactcgtcatctagcattaggtatatctcccaatgctatccctccccctttcccccaccccacaacagtccccagagtgtgatgttcccctttctgtgtccatgtgttctcattgttcaattcccacctatgagtgagaatatgcagtgtttggttttttgtccttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttataatcctttgggtatatacccagtaatgggatggctgagtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatgatatctcactgtggttttgatttgcatttctctgatggccagtgatggtgagcatgttttcatgcgtattttggctgcataaatgtcttcttttgagaagtgtctgttcatgtccttcgcccactttttgatgggcttgtttgctttttccttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagataccatttgtcaattttggcttttgttgccgttgcttttggtgttttagacatgaagtccttgcccatgcctatgtcctgaatggtaatgcctaggttttcttctagggattttatggttttagggctaacatttaagtctttaatccatcttgaattgatttttgtataaggtgtaaggaagggatccagtttcagctttctacatatggccagccagttttcccagcactatttattaaatagggaatcctttccccaatacttgtttttctcaggtttgtcaaagatcagatagttgtagatttgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggtagtatggccaatttcatgatattgattcttcctacccatgagcatggaatgttcttccatttgtttgtatcctcttttatttcactgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctaaagttgcttatcagcttaacgagattttgggatgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccattaatacctaatttgttgagagtttttagcatgaagggttgttgaattttgtcaaaggccttttctgcatctattgagataatcatgtggtttttgtctttgattctgcttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacatttcagctcctgttattggtctattcagagattcaacttcttcctggtttagtcttgggagagtgtatgtgtcgaggaaaggaacaaccggtaccagccgctgtaaaatcatgccaaaatgtagagaccatcgagactaggaagaaactgcatcaactaatgagcaaaataaccagctaacatcataatgacaggttcaaattcacacataacaatattaactttaaatgtaaatggactaaatgctccaattaaaagacacagactggtaaattggataaagagtcaagacccatcagtgtgttgtatttgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgatctacaaagagaattagactcccacacattaataatgggagcctttgacaccccactgtcaacgttagacagatcaacgagacaaaaggtcaacaaggatacccaggaattgaactcagctctgcaccaagcggacctaatagacatctatagaagtctccaccccaaatcaacagaatatacatttttttcagaaccacaccacaccgattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatgcaaaattgacaccctaacatcacaattaaaagaactagaaaagcaagagcaaacacattcaaaagccagcagacggcaagaaataactaaaatcagagcagaactgaaggaaatagagacacaaaaaacccttcaaaaaattaacgaatccaggagctggttttttgaaaggatcaacaaaatagatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaaatcttgctgctcttaaccactatcggtacaccttcagaatggccatgttttatgccggaaactgccttgtttactctgcaactcccttggtatttcactttcacccattatcagttctttcatgtttttctgtcctaccctcctactgcagaaagctcacttcctggcagtgcccagtcactgttcctagagcagccctagggattgctgttttctgctatctgtggaagcccaaggacagaaaggttgtacgcaggcagcacttcctttcagctttaccttaccagagacttgctgtttggaacacagaaatgggtgaggacactctactcttaccgttttgcccccatctcatcctggcaatgcttgtgttgtggttcctttacctataacttcctcctgtcaagacttgtaggaggtttaggagaggctgttctggggaatgtgcagtttgtgtctgttgctgcttccttttcttggttcctggttcccacctctcaggcatgcaccagacatcctccttagacttccttaacgaaggacaccttctctgcatgcaaatcagctcttaaaaatggatacctgggggtgaatcaatgtctaacctaattctaaatataaatttaagcttagcctgcaattctgtgacatgaaacagatttataagtttgcttaacattatctatacactatggtcatgtaaaattgctttgactggaaacctgagaaaaacatttttacttacaatttctttttaaaaatttgctttctttcagagtttgaattggtatttccaagaaccagataataattacaaatttctattcttttgcagttttgctcctttcccataattctggtactccagaaagtagaactaaccaaataaatgtgcaatttgatttaaaattgtaccactggtcctgacagtaagaacaattgtaattttgccttaacgtccttttttcacacttaccagatgccttgaaactgtaaatacattttaaaaacgtggagaaactttttttcccacttcctacttattttgttctaactgtatttcacaattccctgttgctccggtgatttatgtgtttgccattttgtctgtgatgaaaatatttgtaaagttaccttcagtaaaaagactatatccattaacttaagaatggcatgatactttaaatttttaaaatgaatttgataagggaattattttagaaaaataaagactttaagtttgatgttttggtttatttttcaataagatgacaaacgaagggtaaagtacatggaagactagatgagagggctatcacaggaagcacccatagactttagatacatatgcaaagggatttaataatctattcaccaatttggtgagggagggattcttgttttaggattatggggatagactaatacacaatattcacactagattgtacagatgaaattgatagcagattatcacatatacacactcctagcacagggaaagaggatacagcacaccaccgtgggccacatgaagttgcactcaaaagcagaaggaacaagtagaggctgtgggagagaggcttcatagtgtcaagagagcagggtgacacctgattcccatgggaggatgtggttggcttatttgaaaaattccaccactggcagaaaattgaaacctgctactcaggtatcagcaagaactccacctagtccctttgataaggagccttgtttggctgggggaccttatccacaggagcataatggagaagggagcttgtgcgtaagccatttgagtccttattggtttcaccagagggccttagttttggcattacaactcaaaatgactcctgtgttgtctttacttacgaggaacaaataccttctctagtagttaaaaaaaaaaaaaagatgttttattacaaaggcaaaaacaagggctcttatggatgtccaaggccctgcactatgggaagagttcaagaccctaaacctgtattctatgttctccaagagcagtcctctttctctcattcgtggatgatatgctcgaatatgtgtagagcatccttgcaagtagggagctacttacactttctcttcctaataattgtcaacaaaaagagtcaaactctgtaaaatattttaagagatttattctgaaccaaatatgaatgaccatggcccatgacacagcccttaggaggtcctgagaacatgtgctcaaggtggtcagggtgcagcttggttttatatatttttagggaggcatgagacatcagtcaaatacacttaagaaatacattggtttggttcagaaaggcaggacaactccaagttgggggtcttccaggctataggtaaatttagacattttctggtttacaattggctgagtttatctgaagaactaggatcaatggaaaggaatgtttaggttaagataaaggattgtggagaccaagttttatggtgcagaggaatctctcagatagctgacttcagagagagagagcaggttataaaatgtttcttatcagacctaaaagggtacctggctcttatttgattgtctcctggacctggaaagaaaggaaggaaaacaaaggggaaagaggattctctataggatgtggatttttcccacaggatactttgcagggcaatttcaaggtatggcaaggaaatatattttggggttaaatattttttccttgtcttgtaatgttatgccagagtcagactgaaaagtaagtcacaatatatagggtcaaataaaatccatctaatgcgaatttatggttgtcaggcatgactccctagaccacttaggtaggaatttgggtaagataaaaaatcagaacttagtcctcataatcttgtatgtttctcttgagagtcttgactttccagctacagtgcttgctaacaactctttctatgctttccagttccaattccaaagagatctgatgatctcttttgccattgttgcagagggattaacacatggccaggttatgaatgagctgcttctgagacaggcatccattcttattatactcagtggtagctaaaatagatgtggagacacataacaaaacatggctaaataaagaagcagaaattgagggcatgggtttcctcatcaaggaaagatgtgggaagcaagaccttctgaaatatgcatagcaaaataccccagagcctcaaaccagttctgcactgcatttttttctttcataaaataaaactttaattttttaactaccaagtcaaactagtgaatcagccttggcttttccctctttcttctttccactccccatctgtatttttgacaaactaaagatgtgaagttttctttcttaatatttctctcttcctttgaaatataaagacattacccagatccaggctcctttcccttcagcgtgaatctgttacagctgtcctctggcacctttagggatcctgtacctccagaatctctctttgtcagtccctgctgtacccagcccaaccaatcctaatgaaacaccagtttcaaataggcttatgtatctccctattcttccagaattgtcctcaaggcaataccttgaattgactcctatctttctatgtatctgccctatttcctgacaaaaggaggctaactttagggaattttacacctgcatagacaactggaattgcaggttaggatgagattaagatcaagattgttatatgttttgctgcatttgttgttttccaaaccagatcataaccccctggaggataggaattaagtcaggttctttttaccctagaacccattcaatcatatacactttgatgttgatttctttatactttgaaagcatttataggaagttatttgtgtaagagttaaagaagaaagaaacacaaaaagtggctcaacagtcaaagacaggtttattttggagaataaacctgagaggggcatctggccaattttggtcaggagcattctctcttacagactaagggtatttaagcgtttaggaagggagagcttatcacaagctcagaatgtttctgtgcacaggagagttttattgtggggtcggcatgtctctggacagagggtaggttatctcagggctggcatgtttctggttggagtggaggttatctcagggctggcatgtttctggttggatggagatttatctcagagctggaatgtttctggtcggaggtgtcacttgtagtttatggtcatgctgacattagtcattaggctaatggtttggggctggatttacgcggtttttaatcaaggggaacttaaaattgctgtgtttgtcctagatggtgatgatcctgctctgtcaatttgtattggttatttgattcaactgcttagaaaaaaataagtatggctattttgtcttatctgatgggattacatagtataaaaacagactggcttaagtatggcatctcaacatctcacagccacaaactggatattgcgtcctaataatgaattcacgttgatgatcttttcagtggtattgcaaaagaactcccttattgattaaacacagctcttgatttttctaagcatataagtaaaactcaaagaattaaaacaataaagttttcctgggagaggaaaatcaggaaatctgacataaaatgccagtttgccttaaattagtaattacttgtgtaaagtgtgcattaaaagatacatagcctgggcacagtgcctcacacctgtaattccagcactttgggaggttaagccgggcagatcacttgaggtcagaagttcaagagcagcctggccaacatggcaagaacccatctctacaaaaaatagaaaaattagctgagcatggtggcatgctcctttagtcccagcttctcaagaggctgaggcaggagaatggcttgaacacaggatgcagaggttgcagtgagccgagatcgcatcactgcattccagcctggatgatagagtgagactccatctccaaaaaaaaaaaagatacataaataccacttaactatgtgatttgttgaaattatgttctatgtatttacttttatcacattgaaatacattctgttcttatatattttttttcaagttaagggtgaatgccaaacatgcataaacctcacctatagagtctattgcctttcagccttgttatgccttaatactgattctgtatgcatatatacataatttggtagatatttagcaatgttacatttggaaaaactaggccagtgtactataatcagctttggaaaagttgttctcatttgcaatttttcttacaattgaacaaatgactgttaaatacttcatttttctaagtatatggattaaaatatagcttgtagaaatgtcagagtattctaacttgaaatgtaggaaagcgttttgtgtagttttgtaagttctttcttcaattttgtggattagtaagtacataaaaagaattcattctgactgtaggctgacaacattggattggcagctgaaaaaagttgtcagcattgcctgtcagattcaaacttagcagtgtacaaggtttataaaagcttgaagctatcctgtcaacactggcatttcattaaagattaattaacccgaatttgcttgctaataaagatcaaaatatcagtcatttctctcacaaaaaacgtgtgactaacttgtagcttatgccttgtgtatgtgcatattcatggttaagaaatgaagtactataggtcttttttaagtttatactaaaggcaatggtgtgcaaaggaaagtggaaggttttagttaaaattagatcagagcatacacatagctaaaactgacttcagtatttgctgcaaccaggaaaatagaggaaaatatctcttttctttgaagaccattccagaattgattttacacttcacttttctaatgttcacatattagaaaaaaagttaatcctatttaaaatgtgaaaatagatcacttcatatttccaactgactacaatataatacagtgaaaatgttgctaaagttctatataaactatatgtgttaaataagtaaatgaaattaccagaccctcatgacttttccgctcttatagcaataataaaaacatcatttaaagctgctgtgttacattaagtcattactgggcaacttatttaatgaaaaataagcttatccattatgtaacaaatgttttattggtaatgtattgtgttccctgaactctgcaatgtaatgaggataaatggtaagcaaaacagacacattatgtatcctcacggatttaacaatttattgggggaacaactatgggtttaagtcatactacaatgcaaaattgcagctctacatgtgctatgaaggagtggtttccaggaccataagagtctgtgataagggggtttacagaataaagcagatcaaggaagtcctctttaagaggttgccctggagtttagacctgaagaatttgtgaggaggtatcagttgaaagagtcagggaaagatctgcccagacagaagggctgaataaaagaccctttggcaagaaggagtgtaacaaacacagggactgttatgggttgcattatgtcacaccaaaaagatatgctgaagtcttaaccccaagtacctcagaatgtgactttatttggaaacaaggactttgcagattttacaaagttagaatgaggtcactggggtagaccccaatccaatatgacgcgtgttcttgtaagaaggagaaaggtgggcatggacatgcagaggaaagactatgtgaagagacacagagaataaggacatattcaagccagggaattcctgaggttaccagaagccaggaaagaggcctggaactgatccttccctagcaccttcagtgggagcatgactctgctaacaccttgagtttggccttctggcctccagaagtgtggcacaataaatttctgttgttatcagtcactcagtttgtaatactttgttacaacagccctaggaatgtaatacagggactgaaaacatatcagtgtagattgcaaaggaagaataagagcaacttgatctgaagagaggatagaacaataggcagggacaagacaataggtcctgaaggccatttttatgagtttcctttttattctaagagcaaaggatttaagaagtacaagaaaaagatgatagtagcttggacactagagtggtagtaatggttatagagagaaatcattggaaatagggaagtgaataaaaaattatgaataaaccacaaaaactcaggcttactcaaggacatcatttaagccattgtgtttgcttttgtcatcaatttttcaatctctattaaaaactggttttcgttaacagattgaggagtagttggcatgtaatataatgcatgtttaaaaagtgtgaaatttaataaattttgacatataattataaaggtatcataatcaagatagttaacatccaatcatctcatatccaataatccaataattaatgtctaaacccaaaattttcctagttcctctatgtgttactttatttatttatttattgagatggagtcttgctttgttgcctagcctagagtgcagtggtgcgatcttggctcacttcaacctctgcctccccggttcaagtgattctcctgcctcagcctcctgagcagctgggactataggtgcacaccaccatgcccagctaatttttgtatttttagtagagacggggtttcactatattggccaagctgatccaatctcctgactttgtgatccacccaccttggcctcccaaagtgctgggattacaggcatgagccaaagcgcccggctgttactttattttaatattcctttctctgaaatttatttttcttatattgtcatcccagttttttattattagcatgacgtattatttcccactattttaaaacttatttgtatctttgtattaaagggagttccctgcagacagcaaataattggattttactttcttgtttaatttgataatgtctgccatttaattggaatatttagttcacttacatttaatgtgactattggtatggttaggtattaatccaccttttttttttttttttttttttttttttttgagacagagtctcgctctgtcacccaggctggagtgtagtggtgccgtctcggctcactgcaacctccacctcctgggctcaagcgattctgcctcagcctcccaactagctgggacaacaggcgcgtgccaccacacctggctaagtttttgtatttttagcagaggtggggtttcactgttttagccagggtggtcttgatgtcctgacctcgtgatctgcccacctcggcctcccaaagtgctgggattacaggtgtgagccaccattcctggctaacccaccattttctacttgttttctatttgtttcctttgttctttgtaatttttcccttttttcctgctttctttaggattatttttattccattttatgtatattgttaccttattagtcataaccctttattttggtggttgtttcttgcttcaagtaatattaagttatgtacctcttcacatatagtatgaggaacttgtaagaaaatattactacttccaatttcttctcctggcctttctgttattattgtcatgcatattattgtatatatgttataaaagtcacagtacaagtcatttatcacttgaatgcatttaactattaaggaaaatatcttatgtatttacccaaaaaagttaattctacttgtgatcttcatttctttgagggaattttaatttttacatgattatcattttactaaattacttttttggacatttcttgtagtgtggggtttgctggtgaaaaattggttcattttctttgtctgaaagtacttattttagcattttttaaatgatattcttccaggttataaaattctagattggcgtcctattatttcttttagtatttaaaaatgttgctcaactgactgcttacttcattgttttctactagaaattggctgtcattttgatctttgtcttttgtaaaggcatatgtttttttgtctgacccctttcgagattttatcactgattctgagcaatttgaatataatgtatcttgacatagttttcttcatgtttcttgtggttgaagtttgatatgattctcggaactgagagtatatagttttcctcaaattgcaagattttggctactatttcttcataattttttgtccctttttatttctcctttcctttagagactcccattgacaaaaagattcaaactctgtaaaatatttgaagggatttattctgagccaaatataagtaaccatgacctgtgacatatccctcaggaggaactgaggacatgtgcctaaggtggtcagggtgcagcttggttttatacattttagggaggcatgagacatcaatcaaatacatttgagaaatacattggtttggtccagaaaggtggggcagtttgaacttggggggaggatttccaggctataggtggtaaatttaaacattttctagttgacaattggttgagtttgtctaaagaccttggatcaacagaaaggaaatgttcaggttaagataaagattgtggagaccaaggtattttgaattctcatagtggctgccattaaagacaatagatgacaaatgtttcctattcagacctttaaaaggtcctagactctcagttaatctcttcaggaatgggagggcctgggaaaacaaagatctagctatgttaatagagattctttacatatgcaaattttctcccacaaagtacagctttgcagggccatttcaaaatgtggcaaagaaacatgtttggattttcttctttgtcaggtaatgttacacataaaatatttggattttcttctttgtcatgtaatgttatgccagagtcagattggaaagtaagtcacgatatatagggttaaataaaacccatctaatgagaatttatggtttgtagggcatgactccccagatcccttagataggaatttgcatgagataaaaaaaatcaaagcttagtcttcaatcccattgcatttatattagttcactttaagtattccacagtttatggatgctctgttaatttttttttcagtttgtattgttttgaattctatgcctccaaattaatttttctcctgcaatctctaatctgcttccatctagtaaattatctcagatattatattaataattctatcaccagacattttatttgatcctttttaacttccctgtttcttcttaacctatttaatctttcctctcattttttgaacatatgaaatttgatgtaatgacttaaaatgttctctttttttgagccagagtctcactctgttgcccaggctggagtgcagtggctcgatcttggcccactgcaacctccaccaccctggttcaagcaattctcctgcctcagcctcctgagcagctgggatcacaggctcctgccacggtgcctggttagtgtttgtatttttagtagagtcagggtttcaccatcttggccaggctggtcttgaatgcctgacctcgtgatccacccacctcagccttgcaaagtgctggaattacaggcatgagccactgctcctggccttaaaatattcttgtctaattttatcatctgtgtcagttatggattggttttgattgacttttctcttcacatggttcagattttccaatttctttgtgtattgttaatttttgtttggatgccaaacaatgtgagttttactttttgggtactggatatttttattctatattctttagatttcttttgaaaagcagttaaatcacttagaagcagtttgatccttttggatcttgattttaaacttagaacagaatttagtgctggggctttttttttttttttttttttttttttggtctcacttcaaaagtgtgacctctctaagagcagtgcccaatagccatatgaattaataagattttttagtttgaaaacactcattattctcagccttactgagttctgaatatattgttctcactattcttttcaggtggctcttttcatatccttggttagtgtcctaacaaacatgtgctaattagtacccagctgaatattcgaggagaattgtttacagatgtctggaattttctctctgctgccctcttttctctttagtgtgcactttactatgctgctgtagagaggctatcctactccagaaagacttgtttataatttcttcacaccactcatttattcattttctcctttatacttcttccaatctggtttttacatcctctgaaattcttatcaagtcatcagaccatcattttgctaaatctagtgtttatttttggtataaatattctggcctccataatgtctgacctcatcttttattaatttctccttcaatccatcacattaaaaaaattcttcgatcacagtaggcatgattttgtcttagaacatttatactggctattttttctgcttgaaatgccctttcttcagatatttgcctcgttaacaaactcctctatttctagacttaactcttcgtcttagtcttagtccatttgtgctgctataacacagactgtggaattgataaaagacagatatttatttctaacagtctggaggctgggaagtccaaggtcaagtcaccagcagatttggctctccagcaagggctgcatcctccagagtgaaggaaactgtgtccttacactgcctccagaggcagaagggcaagagagagacactccctctatccactgctttgataaggatacctaatctcattcatgagtatgatggttaatattaggtgtcaacttgactggattgagggatgcctagatggctgatgaagcatgttaatagatgtgtctgtgagggacacatctatttgccagaggagactgatatttgagttagtagactgggagaggaaaattcatcctcaatgtgggtggcaccaaccatttgtctgccagtgcaggtagaacaaagcaggcagaagaagaggataggcagcttgttgagtctttttgctccttctcttcccatgttatgctggatgcttggcttcctctcctcgtgcccttggatattaactccaggttcttcagcctttggtctgtgaggcttgtaccagcaacctcccaggggctcttgggcctatggcctcagactgagggctgcactgttggcttccctgatattgaggcattcagatttaaactgagctatgctactggcttctctctttctctagcttgcatatagatagatacagatatagatatagatatatagatatatatatagatcctattggttctgtctctctgcagaaccctgactaatacagtgacggaggagccctgaaggcctaatcacctcttaaaggccccacctcttaatactatcacactggcaacatctgaattttggagagggcacattcaaaccatagcactcttcaataagcctaatcaccctacttaaaattccagcaacttcccaggatagccagtctctaaagataaccctcaataaaccttgtgtaaccctttcctcttgaatctgggctagccctgacttggagccaatagaatgcagcaggtgtgacaatctagatcttctgaggcagtcagaggacaacttgcaaattctgactgggtctgcttaaatgctagctgtcagggtgctcactctcagtacacatggagaggccacctttaggcaccttgatcaataacctcagctaagcctacatttgacaaccagtatcaactgctggccatgtgatggagctgtcttggacctctagcccagactaaagccctggctgatatctgtctgtaaacacatgagaaactgtaagtgagagccaactagatcagctaaaacacagtaatacaagttaataataaattgtttgaagccactaagctttgaagtggtttataggcaaggatagctagaaactctgtttgccctgcacttcaatttttaatctcttgctctttgtctttttccctcagcatttgttatcatttaacatactatatgatttgtgatttattatgtttattatttattttttgtcttgttgtccccaccagattgaaagctctaaaaggtggcaatcattgtttgttgtgctctctgatatatctcagttgtctagaacagcatggctaatacatagtggaatttcaataaatatttgtaaaagtaatgaagaaggcggtagtctatcctaaaaagttaaacaagactcattcaaaagatgatcacaaatttactcaaatgtggttcattcccaaagccaaaatgataaattaagatgtcaacaaatatctatggaacacaagctaaattacagacttgtaattattaatagcaaactggagagtaattattagaaaaaaatgaaatttgaaattactttcaaatattacaccattataagcctctgggtagtgattttagattaatataaaatttgatgaaaccaatcataatgaaaaagatacctaattattgtcactcaaaaataataatttaaacaaaatttaagggcatataaccacaatgttcaatacttggatttgttacagtaccttttttaagtgattacagggttaacataatttgagttgtgcatatttatttacattaatttcacttcacttaatggaatctgctggagattgacttgtgtttgtactaaaaatacataaaatatattaagaaaaagcagagagagagccactgatttattgtgtttggtgtccaagaacagctcaaactgctttctgtgaaagagttatgccttactgtttccttaaaaatgttttgtctgccgggcatggtggctcatgcttgtaaatcccagcactttgggaggctgaggtgggcagatcacaaggtcagcagatagagacaatcctgtctaacacggtgaaaccccgactctactaaaaatacaaaaaattagcccgccatggtggcgggtgcctgtagtcccagctatttgggaggatgaggcaggagaatgccgtgaacccgggaggcggagcttgcagtgagccgaggtcacgccactgcactccaccctgggtgaaagtgcgagactcggtctcgaaaaaaaaaaaaaaagaaaaaaaaagttttatcttgaaaactatatgtcagttcttagttgagttagtaatatgaggaatggctacaagtttttaaggaaaaaatacattttaagaatgttcactgaaaacccttttaaaacaacaggttctgaattttaaaaatattcagatagatttctttttgaacatataactggaatctttattacaaaagaatcatcaatgtttgacttctaattcatatgccaacatgcatttctaagcaaactataaccaagaaaaatgccaagcacactctgtaagcttagaatgcatgtgaatttcatattaattctttttgactcctcctgaacttgagcatcttacaggtctgattgggcaatttatcagttctcatgctcaatgaattcagtcgtagggcacatgcaacttaaagcaatgaggcctaactgccagggtgcttagaaccatcagtagggatgaatagcacagagtcagcatacaaatagaacatgaacatagagcaaaggcgaacatttagcctgactttggagcaaaaccagagttaagaccaagccctacctcagcacactgacgcttcagttttacatgtttgcttcgtagacagaactacttcacatttatttaccttccattatacaatctgcacattaaaaacaaaagaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaaccctatctaaaggaagcagtcactacttagctctaccaatagttgccatgctagattgtgagaccagggatgccaggtattttgtttctgcaagagaagccagaaatatggatttatcatgtcaactctcctaataaatactgaaatgtacttcattctttggtgctttatgcaagacaaaaaaaaaaaagaaaaaagagagggagagaaagaagaagcgaagaaaagacatggactctcatgtagattgaacttggtccacagtttactagcttgagatctgtaagaataaactaaggaggtaagagaaggaggagggcatattacttaggtgagaagtaattgtaaaatgtattataagcatttattagcacagtaaaatttatggacaaaatagaaacttcaaactacattaagccttctgtaatcgagctgtatcacctgcttctcattgatatcctttttcttactacttcctcccttattcagagaagtgttggctaattgttcacaattttactatgcactcactttccattctactctattaattaacactatcattcatttatttaatgaataaatatttttcaagttccatatgcgttgctttctagtatacgtggaaatgtggtatagccaaaaagtcacaatgatcacgtggatgctattcctaacgccttggcctctcaatatgttgacttccctgaattccaaaaggcatcatcattttgcttcagctcaacattcctaaggtcataatctggacattgctgttaccaggaagtgttccatgtctaaattcatgaattcagatttttaactcattgacccacccttccttccttccttccttcctgcttgcattcctctcttcttgccttcctttctttatccttctcttttccttctttccttccttccttccttctactctcccttgcctctcctgttctgaattctgtaagtattattgcactccatctattttttgctctcattaaattctttgaatcttgtaatttctcttatatcaacatcttctacctcccagtagtatggggtcctgttttattcaagctaatcttcatgctctttcatattagtgaatctcatgacaaaatctgtactctttggatcttgattttttatagacttgacatgtaaaattctacctttttgttaatccacttccctccactactggaggttgataccactgtgagtttaggttcatcaaatttgattagacctcaaaattctctagatttctagatcttttacatatcttttaaccatatctttttcttactcttcacagtggctattttaaacctttctcattctactcaagctccgactgcaactttttcttacttaacacatgaccatcagggcaactgttcttaaatttcttcacttacctcatctaccaacttaactaacaaggtatcatggttttaaaaagtgctatgttcaggataattccttcaactatgcttattatactatccgctaaactgtccttatttttcattcattcattttataaatcatatattaatcacctagtttgtgacaggtactgttctgggctctttggccacaccaatgagtaacacatattaggatcctgttctcagaaagacgttccactgaaaggaggtaatcagctgttagaaaaatattagtttcagctagtaataagaactgaaaaaatactaagacaaggtgatagatatatcagatagtgagtacctgggtgtgaagacacttccctgaggaagagacatttggtcagagaatgacaagaaggagccagccatgagaagacgtagaggagaagcatgtgaattcacaggaaagaataagcacatgcatcctaacttgggaaaggacttggtgtgtttcatcaatgcacatgcagttgaacaatcatgggtaatagtgggagatgagattagaaggtcaatcaggagcttaatgtaggttatgcaggaagccttttgtggttgttaagcatgggattgatgtcatccaatttagatttttaacaaaaacccataccatgctgaatgttgatggagttacgtaagggtagaagaagagatattatttagtaggtaattcaagtaatgtaggtgagagataatggtggcttgattttagggtgatactagggaaagagaatggttgacagattaagagtatatctagagggtaaagccaaaagatttgctgatctatggatatggaagttaagagaaagaaaggaacaagaataactcctagtgttttttgtttgtttgtttgtttctttgcttgactaattttgttatgtcattcattaaattgagaatgaaagaacaatatttttgagatcaaaataaagttgcaatcctgagttaagttttatgcatgctaaatttagatgctttattaggcatgcaagttaagatgtctaattgacaattggatatgtgagtttggagttcagaagagaggtcagcactggccatcaatattcagtacccgatgtcttgtgggtggtaaagccatgggactaagtgagataatctagggagaaatcagaaagagaaaaaaattcagggcacatccctggctcactctaatacttaaataataattagagaaagaggaaccaacaaaagagactgagaaatacctagcaagataggtgaaaagacaaggaagagtgatacatgctatagaagctaagaaaagaaagtacttaaagaggatgcaaatgtacatacttgccagagctaaaaaagaaaaagatgcaaatgaccaactgtttagctgagaaactagtaatgttaaaactgtgaaatagctgttgaagttggtctggaggggtgtcatttgttataagaactatttcaactgaattggagtcatttgaggagagaatgggaggtaaacaacaggagacagagacaacagacaactcttcttgtaagttttatcatgaaaggagaccaagaagagaaatagtagctggaagagaatgtgggctaaagcagggttttataaagtgggaagattctagaatatgtatgctgctaggattgattcaatagaaacaaattgatgatgtaggaggaagaggatacttgcaggaaccaagttcattagaaagtgagtcgcagatggagctagagcacaaattgagggatagaactttgacgtgagcagggacacttcatttattgtaaaagaaagaaaggggatgggtagaagtttaggtaggtaggtaaattttgtgatgaaaacaaggaagccctagattgaatctatttaacaaggtcatcatttgaaagggaagagtgggtggaaaagaggtagggctggaggccactacacaaagggagaaggtatgaatactcattttacatagtgtcagagtaaatatgcagtgcagtggagttgcagagtattagagaatgccattttgtcactcatggtcatgtatttagagtgagacaaaatagaattgctgtgcatcttgaagcctgcacaatgtgataggctgaataatggtccccaaagatattcagattccaatctctggaatctatgaatgttaccttatatgacaaaagagactttgcagatgtgaaaaaattgaagattttgagtacatgagattaccctatatttatcagatctgttctaaatgtagtcacaactgtccttataagaggaacaccatgattttagcccagtctgactcattttgtacttttgacctacataactgtaagataataaatttctgttgctttatgccactaagtttgtggtactgtgttgcagcagcaataggaaattaatacagtccactacttcattcctttcctttgtatctttatcctctctcttctttcaggccatttcctgttagcaggtaaacatgcttaagagtttccttttaaaaaacaacattaataaacaaaaaaccacagaatttcctacctctacctgctcagctctagctaccatccctttttatatagtccttttaacaactaaggcttgttatttttattatttccttctcatctctcatctactcaaatcttctgccaactctcgtcaacttcttttttccttagtaaactgctttcaatatttggcaaggtgctcttattcttaattccagtatattatttttacttctacccttttcaacctctttgttaatcagttgatttccccattctggtgatattctctccccttgggttctatgataccacatttttaaaaaattacatatttgctctctgaccgttcttctttattctcctttatgggctacatttttctcatggctttttcttggtgcaattttttaaatttattattattatgatgattattattattttgagacagggtctccctctattgcccaggctggagtgtagtggcacaatcatggttcactgcaaccctaacctcccgggctcaagtaatcctcacacctcagcctcctgagtagctgggactataggtgcatgctaccacacttggctaattttgttattttttgtacagatgaggtctcaccatgttgcccaggatggtatcaaactcctgggttcaagcaatccgccttcctcagcctcccaaaactctgagatcataggcgtgagccattgtgccttgctttattagtgttgttaacagggctctacttttttctcattctacatattcttttacagttatcttagctatttcccaaaactttctatttgacactcttagtactcacctggacaaatatactctgttctgtacaccttattgtcatgctaaggtgtcctgagttggaaagacaggctctcttgtcctgctccatggcacactcatgtccgactgcagtgattaactgtattggatttggtgtcactgaactgattttgaattctgaccttgcttttttcctacctgaaatagcaagtgatttaccacctgaatgtgtaaaacagtataaacccactaaactgtattaattaaatgagataatgcacatcaagtacaacgcatagtacctggcatatagggggttaataaatgtgggcaaatattagtatcgctagcttcttcttttcctctctaagttctgtttctgctggtaattctaccatggaacttctcttttccattgctgttgttgtagtagtttctaatgtctcctacaacgtttgatgttcacagcccaccattgccacccccactcctctttttatttttctgcttcacctttcctattactcttgtattatttttatttttcccccattttccccattattcccacattctttattttttctgttttccttacgttgttctccttctcctccaccttttattttttctgaatttgcacatctcaacaaatagtccagaccactctttgcagacttcttcattgccaggatctgcttcttagttttcatagttactgtttactttttcattatgatttatagtaaagatgggaagaaaatgactagtggcaggcctgcaggcctttcttaactaaagacagccctagaaaagaaatttaaagaaaatttctcaaaacatgttagtgacagaccacctggcaaatactaataatatgggctaatgggagagtccttatctatggactgctgcagcaggatgtctagtatgcttatggaaaacaaatctagaacctacggatttatgtgtcatggcccctggaaatgtatataccctatgtaactatcctaatataaaatttaaatgtttcataccaaaatagcttccttttgtgtaagttatgtgactatgcacattccatagcagctttgtttgttaaatctgggccactgtgtcctgatgtgataagaaaggcctgggaatttgtcattgtctttctggatctttccctgctttgtctgtgctgtttgattacatttgtccttgaagtcatcagtaaagcttgatactaagtaaggtttataatttgtgtgagtctgataggacagcttgaatccttccttgtgttttctcattggatatggtggcattccagatgattacagttgttaggaaatttctctctggatatctgaagcaatagtaggctatgattccaacatatctatctgtcatgattacagttctctttgtggtaatatattatcatatgtaattcagtaaagaaatgtgtatacatgcatgtaatacatcaatgtctatatctctgggtccatacaatgccataagagcaaatgtcaatctaagcattgatttgatgttatagagcctctagaatttttgactgctaaaaaaaaaaaacaaataatttgttaatttggtttctatttaagaaaccatttccatagaaatagatgcagttcttttactgaattacatatgaatcaaattcacaaataaagttagctcactttaaaatcatctaatctccttttaaaatgtatgacataaattatttaggtgttatttataagaggtggaaatataacacatcatatttatatcctttttttgctgtaatgatgaatattacaatttcttgagtgtgctattttccagacaaatgtgtattccattgtattgtcattagaaccataacattttctagaatgttacttacatcttaatgaagggataatcatgctatgaagcttttatattttcaacattacatttatttctcagtaattctctcactttgcagaaatgattttcattcttttacatttttaatgtgtgatgtacctaatggaaaataaagataatgctaaatgaaaatgagtgttattcattgataagaattcaattaatctatacaaaggtccctttcattacctcttttacagatttttaaaaattctctatttcttttataaggtttccttagatattctctatcattgtttttctttgtgcatttaaaaaagatgatctaggccaggcgtggtggctcacacatataatcccagcactttgggaggctgaggttggcagataacttgaggttcaggagttcaagatcagcctggtggccaggcacggtggctcatgcctgtaatcccagcactttgggaggctgaggcaggcggatcactaggtcaggagttccagaccagcctggccaacatggtgaaaccccatctctactaaaaatacaaaaattagctaggcatggtggcacctgcctgtactcccagctactcaggaggctgaggcaggagaatcgcttgaacccaagaggcagaggctgcagtgagccaggattgtgctacagcactccaacctaggcgacagagagagattccatctaaaaaaataaataaataaataaataaataagatgatcttataggaaggggatactacagtctgtaaggacgtaggagtctcaaaaatcatttgagttcaaaagaaatagcatttaataacaattacaatgtaataacaatgataacgagaggtgccaacgtgctagcagccctcactcactcttggcgcctcctcggtctcggtgtccactctggccacgcttgaggagtccttcagcccgctgctgcactgtgggagcccctctctgggctggccaaggccagagccagctccctctgcttgtggggaggtgtggagggcgctgctctgtggcgcctggtcccatcgaccttccaagggctgaggagtgcaggtgcgtggcgcgggactggtaggcagctccacccgcagccctggcgcaggatccactaggcgaagctagctgggctcctgagtcgggtagggacttggagaacttttatgtctagccggaggattgtatatgcaccaatcagcactctatgtctagctcagggattgtaaacgcaccaatcagcactctgtgtctagctcaaggtttgtaaacgtgacaatcagcactctgtgtctagctcagggattgtaaacacaccaagcagcactctgtgtctagctcaaggtttgtaaatgcaccaatcagtgctctgtgtctagctaatctagtggggacttggagaacttttgtgtctagctaaaggattataaatgcaccaatcagcactttgtgtctagctgaaggtttgtaaactcactaatcaatgctctgtgtctagctaatctagtggggacttggagaacttttatgtctagctagaggattgtaaatgcaccaatcagcgctctgtgtctagcttagggatcgtaaacactccaatcagctctctgtaaaacggaccaatcagctgtctgtaaagtggaccaatcagctctcagtaaaatggaccaatcagctctctgtaaaatggaccaatcagcaggatgtgggtggggccagataagggaataaaagcaggctgcccgagccagctgcggcaacccgcttgggtctcttttcatgctgtggaaggtttgttctttcactttttgcaataaatcttgctgctgctgtttgggtccatgcagcatttatgagctgtaacactcaccgcgaaggtctgcaccttcacttctgaggccagtgagaccacgaactcaccaaaaggaacaaacaactccagccacaccatctttaagaactgtaacgccgcgagggtccacagcttcattcttgaagttggcgagaccaagaacccaccagttccggacacaataatatttcatctttgtatagtctttttaatttttcaaaattatttcatcatatgatacttccaatatacaactatccgtaatctatgacacatagaagctgagacctcaaaatgttccagtacagtgaattacaagggagtgtaatttgacacattaaaatctcaaaatgtattttattttgactgttctttgaaaaggcctatttctagagttgatatatatcaagaagatttaagattggcatggaaaacaacaagctgctaatgggaagggaagcctaacaatagtactagcactcagacccaaggaggtgggcttctctttgggttttgccgtgactgtgttagtgttcatccacgcgctctacccttctatgtgggaggattatacctgcccacaatgtgaaactcaggtgtgctcatgtgatatggtccatgaaatgtccatagaagtggagggtgtcacttcctggaagacgttttaatggtcagtacacactttgccattctctttttccctctcctgtgataatagacatagtgggttccaaaagatgacatgacagagctgcagccaaccaataacggacatggaggaagagtgagatctaaacctgagtgttataggtctctgatatttgggaatcatttgttagtgaagcacaacctagactgtcttgactgatacaggtttgctcaaagattattaggaacttggctgtcctgttctccagcattgtcctttcctttttcatgttctcacctaaatgtggtcacaaaatactcttgttgattctccagcgcagagagagcaccaacgttttaaagactttactaaaattatgtctcagaaaactgtgaaacaaacccagggcctagtataattcactgtatttttgcagattcctcaattccatatggaaccccaagataaaaacatcttgatggaagtctagtctttcatgctcctggctaggaatcaaacggctcttaccatatgtggcagacaccacagagatgcaccaatcagctcccctttcaagaaaagactcattgtccatctgtgagggccatctgtgaacttcgcaagtccatctcagcttgagcggaggtcatgctctcctcagagtaacctcagtcagtgactaagcaagaatgtggtgcaagcacctagccatttcttttcaacaggggacttctgtaaaaggtgatctttgctctgaggctgtctgctgggctggcagatacgttgtcagatctgcattgcagtctggcagatcctcctacccaatcctgcattccccttgtttcttcacagatattaccttccaagatattttgtactcctaaattcagctcagcgtctgtttctgtgagtgggaaaagaaacttacataagatctacctacttattgagagtgttctcctagatataaagtcaaagatgagagtgccccatccccttgttcttctggctgttctcagtacctgttccctgtctgtgtttattcactgggcagccttatcatcagaaagacaatcatgcactataatagaacaatatcttataacagccatataacaatataacatacatccttaattctgtcaggattttgaaatgaaatgttctccttgataattttctcaagtgtaaagtgggaataataaaagtaattttctcacagagttgtgagaataattaatagccaaagtttattaagtgttcactttatgtcaggctttacaggcactacagtatttcattttattcaataggtgaggctattggggcaaagaaaggataagtaacatatagctaatgataggctgagtgggaactggggtctacacagagtgacatcacagcccacttacacaattactctctgctactctgtctctcaaagagatctgtcaagaccttagcaacgtgcctgcatggattaagcttaccatttgttggagtaggcaccccacaaatgttaaccactatgattacttattcattttcaaagttgaacaaataaaaaaaaaaccctgaataattcaaatacaaagaaataaaggtccttttaagctacctgttctccagcgttgtcccttcctttttcatgttctcacctaaatgtggtcataaaataagccaagtcaatgagtttggactttatcttttgggcattgaagagttattggagagtattaagaatggactgacatttagattcacagattaaaaaggtgactctatttgtagtgcagtcaatgaaaggaactgatgcataaagtggggtaagggaatggtagaatttgtccagacgaaaagcgaagtctgcctgaactacggtagtggcaacaggaattagaaaaaaaaaattaaataggctaggcgcatgggcttgcgcctgtaatcccagcactttgggaggcggaggcaggcggatcatgaggtcaggagatcgagaccatcctggctaacatggtgaaaccctgtccctactaaaaaaaaacaaaaaacaaaaattaggggggtgcctatagtcgcagctactagggaggctgaggcaggagaatcgtgtgaacctgggaggcggagcttgcagtgagccgtgatcgtgccactgcgctccagcctgggcaacagagcaagactctgtctcaaaaataagaaagaaagagagagagagggagggaggaagggagggagggaggaaggaaggaaggaaggaatcaagtagactagttaattgatttaaagtgtcacactggtttggacacttcatctggatgggcttcagttgatttatttgtgaaaatcttttggatgagatggttgctaaagtggtttttttgtttgttttgttttttccaattggcatctcttaagagggagctggaggtagaaagggtgggggaaagaaggaaacagagtaggtagaattgtaggaataaatatagtgaaaaacttttggaatgactttggtttggaaacttggtgcatttataacattattaagaaaatttttttaggcaaaaatctaaataaaatgcctttaacatccagctttatgttcccctaattttccaatttacttctaaactcccttaaagcaatacatttatctagtcttttgaaagagaatttataacatcttggagctctcaaataaaaagaggagagccaatcatggtggagggtttgttgttgttgttgttgttgttgttgttaagtataagaagcattaagcaagctcccaatgaaaccaagttttctttttaaaaatcctacaatttatgcaaatcccatatgggatttatgcaaattccatacgctttggtagtcagggcaaatagatatttgccataaagagaagtgagttgagtctatcttgcaaacaatatagataattgcagagaaagtaaggaaacaagctgcactttactattttatgctttggcaaattgtgttgcattgttatatacctggcaaaagaaagtgtatcattttggaaattgctgctgagtgtggttattgtgcacaaccacagcagagattttgaagtcatcatggagccgaggtggcagggtcactacgtgttctcactaccagggctatctgttagagtctgctgaatagctggcatcaatttcaggaggcaggaggcagaaaagtgctggactctatcctcatttggcaaagctttgaaggataatggttgagtgaataaaacttctactagcttactttcatttctagaacttcatgttatttctgtgaatattgaattaaacgagaaggctaagaaataattgaattcaaacatatttatcattctaaattttttttggaaagaatttatattttaaagtaatatcagtaaatgtaaatggagcaatgaagattaatgcaattctaaatatttaccctagtgggacaccatcacttcttgcctcaaatactgaaattgtctccttagctcccatttttgcattctgaagtttttctacacaatgtagtcagatttttctgaaatcaaaattggatcacggcactccctatttaaaaacctttggtagattaattaattaactaatgctacatcataactcactaaaacttagtttttcggaatgaaaactttttgttttttttcctcacagtttctgtgggtccacaactccagagtggcttagcttgggggttatggcttgaagtttcatgagattatactcactgtctgtagctacagatatatttgaaggcttgactgaagctagagaatctgcttctagtcattaacatggcggtcaagttgctgatgacaagttgtttttttctccacagggttgcttgagtgtcctcacaacaaggtggctagcttaccccagagtaagtgatatttaaaaagcaaggcagaattcttcactgatttttgtgactaacctcagaacttatttcatcacttctgtcatattctattggtcacataggccagtactgtttcactgtgggaggtgactatacaaggatgtgaaaaacgggaagcaaagattattaggcaccatcttgaaggcttaatatcacagttggttttcatttactttgggataaagttcaaatttttagacactgcttacaaaacctgtcatgatatgacaatttcttacctcttcaacttcatcctgcccctcatgaatcatgttcaagccattaaaaacgtatttcttcagttcttctaatgcactacactgttttcactctcttgttggatcttttttcccatcctttaaattgactcactgttactcactcttcatgtcaagttattagaaattctctttctcaaaagtttccatttgacttccaaatcatggattagtcacttggttttgtgaacccctaacatcttgtctgtcttaattatagcatttattgcacttacttttttataattattattttttcattgtgtaccctagtagattgatatgaaagtaggtgctctgcatatatgtgtgtgtatatgtatatatgtcattctgcctcattgcctatcatgtgcctaaaatgtaggaatatttattgaatgaatgattcaataaatgaatgagagactatcttgactctcactcagtaagtgatatttaccctaattttctaaggtgatggaaaaaaatctaataaactcacctataattacttttttgttagcttatatctctttataaacccaaacagaaaagaacaatctgatatactgatactggggtttggttccatgtgtgataatactggtaatttgttgaatctggagatatagatcctatatttatcttctaatgaacaatgatagagtaatgaaaatgtttttatctttctaggttacaaatcaatactatgacatatgagagtcagtgaaagtcaataaagattttctaccaaactatttttttctctcaaaactgtgaaattacaatactatggttaaaatagactgatccaaaatttttatatcattacatttagtaatgcctacatattattttccatagaccagttttaaagatgaacaaaatattacatagcaaaatatagtgttacttattaactgtacaaaacaaagatcagttgaaaagatttcaatgaattttaaatgctcccattaggtatgtcattttccccttctaacatgccacctaaaataaccagatcactattgacaataaaatatcctatactgcataccatttatagaaatagtagcacttaagaagagtatgtcagtggtaaaatttcagtcaaagatttcaatattttaaaagtattggggtggccgggcatggtggctcatgcctgtaatcccagcacgttaggaagtcgaggcgggtagatcacctgaggtcaggagttcaagaccagcctgggctgggtgtggtggctcacgcctgtaatcccagcacttttggaagccaaggtgggtggatcacaaggtcaggagttcaagatcagcctggcaaacatggtgaaacccctactaaaaatagtatttgaaatctctactaaaaatacaaaaaaattaggcaggtgttatggcacacaccgcaggagaatcacttgaacccaggaggcagaggctgcagtgagccgagaccatgccattgcactccagtctgggtgacaaagtgagactccatccaaaaaggggggaaaaaagtactggggtatctatttctcccaaaatgttaaatggcaagtgagtggagggaaacagaaggggatagttcatgtcccatcttactggtttacaactgggaaagcagagtaagatcttcatgtgggttgatgtgatatctgtatatatcagcagacataacagaatcttcttgttggcctatcctgtttagactaacattatggtattagttcctttggggctcacatttattctctgactgccctctagcaaaacttatggggcagacactttggtaaaaggtcccaaactataatgattaccttatattttgtcagtgcaccattggcattgaacaaaatttagtacattatttaataaccatggtagttcatggcaatccatggccctcttgcatattggcaaagttgaaacatcaagtaatctacattttaaaaaatgtctttgatcctttctcgtttgaaatatggatgtaacaggtgcaatggaaaaggaaggtgtgagagtcctttctataatgtttacataacgtctgtctataggagggacaagacattcccttcgagatttgggggtatttggacatagtcttgcaaattcacaaatatcttatgaaagaaaaaagaattaggaaacacttatggaatatttcaagctataattcagttaatcaaagttttaaattatgtttcatgtacctatgattaaaagagctttaattgattaaacaggggttcattttacttttgttaacttgacacatactacaaaaaattcaagatactaggagggaaaaaataaacactatcaaaagctatgttgtggaccttactctgtttttttcaagtatacaggtagaattttactaaccaataaagaaaagttataaaaaaacatggagaatatagttctttttatatacctgatgccccatcctccagtccctcttaaagagatagagtggtgacacacacttccttcaaaggctgacaaagaatatttgatttcataatgtttaaggtcatttctcagaatacacaggtttgaccattgcctaaatgctaatcattaattcaaaggctatattttattttttaaagaaagtttattatagtttgtgtattttgctattgaaatcaatgtgtaagtgcaagttactgtacacaaatttagaagttataggaggtcaggcacagtggctcacgcctgtaatcccagcactttagaaggccgaggtgggcggatcacgaggcaggcagataaggatggagatggagactctcctggctaacatggtgaaacctcgtctctactaaaaaataatacaaaaaattagctgggggtggtggcacatgcctgtagtctcagctactcgggaggctgaggcaggagaatcacttgaacccaggaggcagaggttgcagtgagccgagatcgcaccactgcgctccagcctgggtgacaaagcaaaaatctgtctttaaaaaaaaaaaaaagaagttataggaaatgacataaatcttcagaaaaatgataaaattacatgtaattcataaacaattacgtcatgctttttaaagttcattttattataactaagcgtaaggtatcttaagtctctggaacaagggtataagcatgtatctatgtattaaatagtaatgaaacatttcacaaacatatagttcaatgttcatattcaaaaacatatattaggatgggaatcacattgtatggctgtgttgtagtggtgtgttagtgtggcgactctgaaaaattactcttacaattaggcgtacataaatatgacataattctctcaacacactttagtaacatggcttttcccccaatgtgcaaggtaaaatagttttcctctgaggtactactttcgtggcaaaactttagtgaccaagaccttttaaatgaaagaaatccataccattgttgttaggagtccatattaagggcctatactggtatcgaagtaacttaagatgttgaccgtgtggtcaattttcttttctcccatcctgatataatgtaatgtggccatttaatgagttctaactcatttactaatgagcatattgtttcctcatcacatgctaggcaaacagaaagtaaacagcatctttttagcaaaaaccttttctggaattttttttttaattgtaataatataggaataaacaacgaaaacctatagcaattaccataaaagttttagtgcatttgtaatatgctaagtatttgatatattccttgtaaaagactatttaagtaaatctttagctgccggtgtttgcttgctgtacagaatcataaactatcaatattcctaaattagcatggtccagtcatccaacttattgcctcagtcactcaattttcaagtttatgtactttcctctcagttatcagatggtgacttttggataaattgttatggcaaaaattttttttaatatcatggtgaatacatgttgatgtgatctgaatatataaaatatcaatatctaaagatcatttagaaaatgtttatttttactacaaaagttatgcatgtttacataagacgttaaaagtaaagtaaaaactcatttcctgtgaccctgacaaaacatcattagcattttattaaaatttatcctagttattttctgtgtttatatatatttttgcctataataatttttatttattttttacaattttctttcctttttttttttttaaagacagagtcttgctctgttgctcaggctggagtacaatggtgcaatcttggctcactgcaattccacctcaggttcaagcaattcacctcccttagcctcctgagtagctgagattacaggtgtgcaccaccacacccagctaatttttgtatttttactagagatgggatttcaccatgttggccagggtggtctcgaactcctgacctcaggtgatctgcctgccttggcctcccaaagtgctgggattataggtgtgagccaccacgcccgacccgttcttacaattttctatttttatttatctctgtagacatctaacactatgtattctaacatcaagcttagtacacagtagacatttaataaatgtgattagttaagtatgttaaatatcagatgctagaatatttatacatatatataatgtatatttttaagggtttacacaattccaggaggcaccattctcattatctacacaaatggcattctcaggagggcacatttatttacatagactgcaatataaatggcctaggaaaatggtgtcttctagatgtacaatgatatggccatggatgtatatttgtgtgtatgtatacatgtatatgtatatacatacatataagtatacgtgtaatagccgcaggtatttcagtccatctataaaaccaaggcaaatgtcctcaaaattaaatgcattttcactcatttattatttattcaacaaatatttatgttcactgaaactgagctgagggctagggaaataatatatcagcaagatagacattgttctatatcctttgaaaatatcataggtgacagtgtacaagagtgttaaaaagagacttctacccatataagatacttaatagctctaacactgcagacagtagtcaggaaataccactgcacttcaaattagagtgccgcaccatctaagccagacttgtaaaagatgacaagagaaattattctggcagtatcacaccctctacacgtagtaagacaaggctgaaaattcatttgaatctggtatttgaaagatataatttcattgaaagaagtcagcatcctgtggcatttgcccttctttctctctagggaagaagaaagcttcttctttccttccatatcaagtgaagctgtctcaaaaaagaccatactgagaacttacttgagtcctcagaaattggaaaagtatcaaagctagattatggtttactaaaataaaataaaaataagcatcttttatttttgtttgtcttttaaaaggtaagaagatagacagcttccctgcttacctggtggcagggcgaggagatactgtctgtattagtctgttctcatactgctacgaagaaatacctgaggctgggtaatttataaagaaaagaggtttaatggactcacagttccacgtggttggggaggcatcaggaggcctgcaatcatggcagaaggcatctcttcacagggcggcaggagagagaatgagtgccgagcgcagtgggggaaagcccctcataaaaccatcaggtctggtgagaattcactcactaccatgagaacagcatgggggaaccgcccccatgatctaatcacctcctctgaggtccctcccccaacacgtagggattataattcagattacaattcaagatgggatttgggtgaggacacagccaaaccataccactgcctttgtcatgaaggacacttcttgtgaggcaggggatgggccatatttcttgtaaatcggatatggttgccacacaagagagagaactgggagaagtcttgaataggactttgtccaagatgtcctgctgaagggatgtagtaaccacagcaaaaggaggctggaaacagtactaaggggcattataagtgtcctgcatttggaggaatcacttcttaggaataacaaatgaggtctctaggggaggattctctgaagaagtcacaagtaccctacaaaagaaaaaacaaacagattttggacatcagccactttagggcgtcaatgacataaggcaactgtgccagtcatttcagctttcctctacttctcaccacttctccatcccacacagaggactcaagagacaatgtagagtaaaaattcaaggcagggaaagaaagaagctgtaatgacttcctgttttatctatttcaagacaaactggaagatagaaggtgagagtgattagctctcagggtttttatatcagactggactgggatttttaagaccatgaggtagcttgaaaagcaatgaactttaattgaaattttatctatcacaggaaagaagctgttgaaaggggaaattgaacaaagtataaaatcatgttcttcttacattttatccagtttgctttattctagtaaccattcacaaagaacaatgataacaaactatcaaaagttctataacatgagaaaaaaaggatgttatgggaacacaggaagagctttgcttccagcgacccaagctactctcctagcaaatcttccactgatgacagtaaagagagagtgatcttggatccctggtaaatcctgcctcagatactgaatgtagaggtgagctctctccaagaggtggatggaaagccagaaatccaggagctaagtaggtacaaacaactcgaggacaatatattgcctgtgtctcaggatgtgcagtggaatatttttagtgtactcaactttcttttgtggtgtctgccaaaaactctcataagcatcccataagggaaagaaagctttaaacacctgtcacattcagaaattgctgagccatcttacaataattccagtcaagaaagaacttaggtgttcttctcacccttttttttcttcctcctctttggccctagaggggagacagaaataacagctaacaggtggcagggaaggggaataaaagagatttttacagttgaacaaaattggaaactcaaattattcatatggtttagggcttttataattactaaattactaaactatatctttgactttaaagtcagccaaatttttccatttcctaataataagaaaaataatgaacaagcatggcccctactatgtgccaaacatgattgtaagaactattacctcctaatcctcataataatgctaaaatgcagaaattcataacactctgcatttcatagggaaaactgaggcacacagttaaatgacttgcccaattttattgggatttaaacccaacgaatctggtaacagagtacatgatcctaatcactactttataagttaaaagagaagataaatgatgtagttttcattaagtgccagacatcgggaacccaacccccactaagtaggtttgaatggagagagggagacaataacaaagttgcttctacggctataattctttgttcaatgtactgattgcttactttgtacttcagctggccgttagaagctactgaagagttttaaaatgatttgttcctatgatgggatttgcttttcagtgtgatcactgtgacttctttgtagagactggtttggaggagtataagagtggaagaaaataggtagatcagaaagactattatgagcggactgctgcctgaacaaagtaatgaaagtgggatggatggaaaagattcaagttaggtagatctatctgtctatctatctatctatctatctatctatctatctatctatctatccattcatccatctaagacagagtaaattggacctaatgattggatatggaggtgagaaaacattaagttataaatttccatgtgtgtatgtgaaactgctaaagtacatcataaaatatcataaagttagagtaaggatcaaattagataattcgtgacaagcgcttaccaccatgaactgtaagtggctaaggaagtttgctgaagtgaaaatagcttgggttctagcaccgtgtgtatatcctggggaaggtgttgtactctctgttcctctggcatcttatctgtgaaatatcagtaccttcctcatggtatacattgagtgaattacgtgaaatgattcttgtgaagagattagcacaattgctgacacactatagatctcaattaatgctagccatcttttactagactgttttcttttcatctacctgacattagttgtatggctttttgaggttaatttctgcatgtcacaaagcacactgttttcctcagaagaagctgatatttcataaagctagtttattgctcttatgcaaatggggcagtactttaagactgttaactactgaaaaaactagtattttgtcatgatgcaagtgaggagggtactgggacaccactccttccccatgggtcagataattagttaagtgggaaaaagttacaaaccacacagtgcactattgtatctagtaggaagtgataaaactattatcaaggattaatattgccctcatctatttgtttaaggcctataacaaagatttcatgggaattttctacatttttattttctaatttttacatatgacctctaatttggttctgaaatgaaatcaacttttagttctttttttatctcaagtgtattacatttttggagatgttatttataatactttgatttttcaaattaataaattgaagatgcaatacagtattcaatttgctgcaaaactctactcttcatacgaaaatagagatagagctatgacctaaagattaatacacagctccatcacagcatagcttgaaatgttaaacagctgatgtacaaaatgatgtgagagtatcagtgaataatacacagaagtgcatactgtaaacaaagcaaacatttctaaattgagagctgtctaattctagaggcaaactcagaatttggatttaagaagataattataggggagaaagaaagtaacaactatgttttcttaaaccaagatagagagtaagaaacatccttaaccaggaagctattgtcttaaactgctgttgttttggcatcattcataatcacttaccaactatttttttgagggtaaatcaggttatcttctgtttataattcttctgagggcaacttaacttcttttctttaacctatcatttctaactaccttcaagtttagccgtatacaacttaaatcacattttgctacactttttagatcttgagattgttttttggctactctgtcatcagtgtaatttttaaaattctatttgctatcggtaggacctggagtttacacatagccagaattaaaatgtattgacaagtgaaaataagttctttgatctcagtggggaaaagggatgcagctctgcactcctgaattctaccactttcatattctgagcctttgaagtttttctttgctttcctgcacatcctttggttcatagtttgtgcttattttttttcctgataaaattgtttgacaggcttagagctgtaaagataggagtgttgtttaataaataaaaataaaaagataattaattgtttctgtaaggtcgaatgcataatccatagagagcttctttctgctgtactcgctccctacgtaactcaactgtgaaaagcagaaacttttcatttttttttttttttttgagacggaatctcgtctgtcgcccaggctggagcgcagtggtgcctgccatctcagctcactgcaagctccgcctcccaggtacatgccattctccggcctcaggctcctgagtagctaggactacaggcgcccgccaccaagcctggctaatttttgttgcatttttagtagagacagggtttcaccatgttagccaggatggtctcgatctcctgacctcgtgatccgcccgcctcagcttcccaaagtgctgggattacaggtgtgagccactgcgcccggcaaaagtaggaccttttctatctccagtgtgaatttaaccacctggcaatatttgaaaggtagagattctgactcagaacgtccggagacttaaactctttttttttttaaacaagtttccagatggtcttcaggggaccacattttgagcagtaaagataaacaggaagaaaggaaagcagaagtattctaaatacattacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaaaaaagaaaaccaccaaatagtgggcaaaggatatgaacagacacttctcaaaagcagacatttatgtggccaataaacaaatgaaaaaagctcataatcactggtcactagagaaatgcaaaccaaaaccacaatgagatactgagaggtgacagcatgctggcagtcctcagagccctcgcttgctctcggcaccccccctgcctgggctcccactttggtggcatttgaggagcccttcagtccccccactgcactgtgggagcccctttctgggctggccaaggctggagcccactccctcagctttcagggaggtgtggagggagaggcaccagcgggaaccggggctgcctgcggtgcttgcaggccagctggagttccgggtgggcgtgggcttggtgggccccgcactggaagcagccagtcagccctgctggcccggggcaatgggggacttagcacccgggccagtggctgcggagggtgtactgagtcccccagcagtgctggcccacctgcgctgtgctcgatttctcgtggggccttagctgccttcccgcggggcagggctcgggacctgcagcccgccatgcctgagcctcccacccactccatgggctcctgtgcagcccaagcctccccgacgagcaccaccccctactccacggcgcccagtcccatcgaccacccaagggctgaggaatgcgagcacacggcgcaggactggcaggcagctccacctgcagccctggtgcgggatccactaggtgaagccagctgggctcctgagtctggtggggacgtggagtctttatatctagttcagggattgtaaatacaccaatcagcaccctgtgtttagctcaaggtttgtgagtgcaccaggcgacactcggtatctagctgctctggtgaggacgtggagaacctttatgtctagctcagggattgtaaatacaccaatcggcactctgtatctagctcaaggtttgtaaatacaccaatcagcaccctgtgtttagctcaaggtttgtgagtgcaccaatcgacactctgtatctagctgctctggtggggccttggagaacctttatgtctagctcaaggattgtaaatacaccaataggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaatctctgtatctaactaatctgatgcagaggcggagaacctttgtatctagctcagggattgtaaacacaccaatcagcaccctgacaaaacaggccacttggctctaccaatcagcaggatgtgggtggggccagataagagaataaaagcaggctgcccgagccagcattggcaaccagctccggtcacccaccaattctggacacaataccatctcatgctagttagatcggcaatcattaaaaagtcaggaaacaacagatgctggagaggatgtggagaaataggaatgcttttacactgttggtgggagtataaattagttcaatgattgtggaagacagtgtggcaattcctcaaggatctagaaccagaaataccatttgacccagcaatcccattactgagtatatacccaaaggattataaatcattctactgcaaacacacatgcacacgtatgtttattgcaacactgttcacaatagtaaagacttggaaccaacccaaatacccatcagtgatagactggataaagaaaatgtggcacatattcactatggaatactatgcagccataaaaaaggatgagttcatgtcctttgcagggatatggatgaaactagaacaatcattctcagtaaactaacacaggaacagaaaaccaaacaccacatgttctcactcataagtgggatttgaacaatgagaattcatgggcacacggaggggaacatcacacaccagggcctttcgggggctggggatctaggggagcaataagattaggagaaatacctaatgtagatgaggggttgatgggtgcagcaaaccatcatggcacgtgtatacctatgtaataaacctgctggttctgcacatgtatcccagaacttaaagtataagaaaaaaaataggccaggcgcagtggctaacacctgtaatcccagcactttgggaggccgaggtgggcagatcatgaggtcaggagatcgagactatcctgcctaacatggtgaaaccccatctctactaaaaatacaaaaaaaaaaaaaaaaattagctgggcatggtggtgggcgcctggagttccagctactccgaaggctgaggcaggacaatggtgtgaacctgggaggcggagcttgcagtgagtggagatcgcgccactgcactccagcctgggcgacagagaaagactccatctaaaaacttaaataaataaagaaaaaaaatatttacctcacagtgatgttagaagggtttgggatatattcacatcatgtagccaagtgcctggccgaagtaagtcctttttttttttttttttttttgagatggagtctcgctctttccaccaggctggagtgcaatggcacgatctcggctcactgcaagctccgcctcccgggttcaagcgattctcctgcctcagtctcccagttagctgggactacagttgcctgccaccacgcccggctaatttttttgtattttttagtagagatggttttcactgtgatagccaggatggtctcaatttatatttcttgacctcgtgatccgcccacctcagcctcccaaagtgctgggattacaggtgtgagccaccgtgcccagccccaagtaagttcttaaaacattttctatcattattataattccaattttattttattattagtttttgagatggagtctctctctgtaacccaggctgagtgcagtggcttgatctcggctcactgcaacctgtgcttcctgggttcaagctgcctcttgcctcagcctcccgagtagctgggattaaaggcacctgccaacccgcccagctcatttttgtatttttagtagagatggggtttcaccatgttggcgaggctcgtctcgaactcctgacctcaagtgatctgcacacttcggcctcccaaagtgctgagattacaggcgtaagccaccgcgcctggcctataattccaattttagcagtatatcttgctaatcaaccaaaaggaacacttaagtgcttatattttatatttactgttagtcatttagaaatgatacaatttgaattatagatgtaattgacaaatttgtactttcattgacctgattggttaagatacttaatcatatgataccacttttcctctttaaacggtaataaccattcattgcaaattactaatatactgacttactcatagttttcactagtcagcactgaatcatactgcatgtgtattttgttctcagcatggaaaagtacatgtcaaatagtaaaccctagtatgccaatcatttagtaacttcaagattactaattaccataatgttgaagtgctaagattatcagggtataatgcattcattatgttaatgattctttatcttatccaagaatcacacattttccctgggagcaaaaagaatcaaaagaaccaactggaagcttttaataaaagtttatgcatttaagcgtgtgattaaccgacaatcatattacaagtgctttattttaaaggaaataataaaaagaaaaaactgtttataacgggtaagattttctttctaaacataattgacatttcactaactgaaattggaattaccaaagaagtgtaagacatgtcttgtgccctcaagggggaagaaatattacatacaaataatgaaactaattatagtctaaactcatagaaaaacaactacttataaagaattaaaaatgggagaaataaggttagataggagtagtcacagaagtgatgaaagagacgttaactcaaatttgaaagataagtacaggtggatagagtgtagaaatgaaaaacagctactcagaacaaagtatctctttttcttttttggaagaacatagtactaagcatcagaaaatttgaatttaaagttgaatttaaattgactgtacattccttgaaatgtgttctctcatttgtagaatgggagatttagaaaagaggtttccctaactactctatgcttctttaactgtaaaattttaggcctagctatatagggcaggaaatagaagggcacatgcagagcacaggtattagggcctggtagtaaacatggttgtgtgcagagcatgggtcaaactatacggccttcagaacctagtacttgagatggaatcagtacctgctgctaaggatggtaataagaaggaatttcacatgagatcaggattatgatgcggtttaggacaagcaatccagtggatataaaaagtaagatacaagacagatatgacaatattggaaaggctgtgtaacatgcagattgactctgaattgtcagtgaaagtggatgacatcaccatccaagcagttgaaatgggctctgtggggaaatgtcagagctgtacagaaaaaaaaataggtgcccagaattcataacaggaaactcagttgtttggggggcttaggatttgatttttatttctaagcctcttttataagggcatcaatttcacttatgggggttctggcctcatgatccaatcacttcccaaaggctccatctcttaataccaaaatgttggggattaagtttccacatgaattttgaggggacaccaacattcagaacatgaacagggacttccatttggagagattttgaagagtaacactcctggcctttcctccagcccggattttctcctctcctatggataaagagtgacttatctgattggaaattatagctcctttcttgctcttgttataattagataagcattctggtctactctttatcatccagtaagtagcctgcccctgtgtggatggcatgtggctggccagcttagcctctctgggatttagatactaatttagataatcatactaataataaagagctgactctctgctctttgttgttcagggtaaaatcttaggaaacccactgtgtttgcatatgaaagccaggttctataatccatgctacgccttctgtctgtctcatttgcttctgaagtctgagggaaagatgggtgttattttgcactgaattaccacaaaggatcaaattgttgaattgaatgtagaaggacagagagcttacccagtctcaaattttaccaatagcttcaaggatgcaagcactcaagaaacatggacaaaaaagagagtggttggggacatcttttatggcttgccaggtcttcctttgcttcaagagaaatgcattctaacccagaggaatagaatgtttgcagatcacctcagctaatagagatttttaggttatgaaacaagtttatttcacagccaaattgttatagggcttatataaccatttccagggagctgtgcttcaaaaattcacagactctcggtttgtatactatagaaaatgccaaaccagggatatcctgtctagatcattctatagataagaatggtcttccctgtaaatacctttagtttatttaccaggaagtgcctcatcagcatgtttataaagattacttaggtagcttgcttctttctttggcatgtctcttggtcatcagggtgagagagagaaagaaagataaaccacaggcacattgctttaacttcttcctccccagacccattaaatttccacagactggaatagggaagtgtaggagtgaaaacagacataggtctgcttctagcattaagccaagtaactatttttacttgacatgagtggaaatagtataaggaaaatattgtcttgggaaaaatagctcactgggacgttatagaagagtttaagggtgaataaatggagatgcaatgactagtcagaaagcatgatttagtgagtctgagcgttactgtggtagcaatgacaatggggaggaaggagtaaaacacaaaggtattttaaagaaagaaatgacagaaattggtaactttagcattaaggatagaagaaagataagactaaaatgttaccctggaatttctagtgagggagacaatatttaaaatgctaaaattaaaataaaccatgtatttccagagtaggtcaaagtcatttaaaaaaaggataaactgggccgggtgcagtggctcatgcctgtaatcccagcactttgggaggctgaggcaggtggatcacctgaggtccggagttcgagaccatcctggccaacatggtgaaaccctgtctctactaaaaatacaaaaattagccgggtgtggtggcgagtgcctgtagtcccagctacttgggaggctgaggcaggagaattgcttgaactcggcaatggaggttgcagtgagccgaaaaagcaccactgcactccagcctgggtgacagagtgagactctgtctcaaaaaaaaaaaaaaaaaaaaaaaaagaaaaaaggataaactaagtttaattgatgagtatgaaaacatgccagatcatcccaaaggatgtattagggaaaagcagaatttgtgagtatgtgaaaatttggaaattagttggagaaatctaatagttgatttattcagtcaacaaataggccagtatgcacactctcaatttaaggcatgagagatataatgtgactaaaacgtccaaaaccaaataagactctgctcctttttttttttctttgaggcatagcctggctctgtcgcccaggctggagtgcagtggcttgatcttggctcactgcagtctcaaactccctgagctcaggtgatactcccacctcagcctccctagcagctgggacctcaggtgtgtaccatcatgcccagctaatttttgtagagacagggttttgtcactttgcccaggctggtctggaactcctgagctcaagtgatccagctgcttaggcctctcaaagggctggtattacaggcatgaaccactgcactgagccaactctctggtctttgttattcaattgctgtgtgcctcactaatctgattcttagtactcccaaactctgaccttagtgatataaccatattctaaattcatcatcatggaatgcccatccatcctcatttctgttctgtctagccaaacctgcagttggagtcactacaaaactggtggcacagaattccaacaaaggacttccccatagcatcccaagatggggctgattgagattccaaagaaggaggtactagatgccaggaaaatcaatcccaagcatttattaggggaatttacataaagaagagggtgcggcgtgtcttagcaacagtgagaaaagagatattccacctagatatgtctgcaatgaggggatggagttaatggagttgacttgagtgtttaagaagtttggctcagggccaaagctagtttctatgtatgtaacaacatggctgatcttttagtgttttccaacagcaacctaaatagctttatcaatttctgagaaggttcaagactgaaggggaagacatagctggctgggtcacagagcagttaggtcactgtgtttctgggtcaggacattgaaagaaggcagggggaaagtgggggaccctacaatctgtcacccagagaccatgtcaagagagatctctttttcggcatttctcaacatctgtagtatttacagtcaatgctctgcccacgttcccttactcctacagtgcatgccagcctaatacccaactgccaatataataggcaaggagatactgaggacttcctctccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatatcatacaggaatattggttttctagacaattgcctttactgtttcaatcaattaatcatttgtgctgggcattacaaattaagtagtaactgaaatatacaatgcaaaagaacctcccttcctggagattaattctgcagaagagactggcagtttttttaaaaaaaagtttaaaaataatttaatggtgatatgtgctgtggagaaaaatatataaatcaatggagtgtgacaggacctgctaatgttggtttgagtgcttgatatcaattttaaataaggtggtcaagaaaaaaaatcaatgagaagataattgagcaaaaacaggaagccagtgaaagggtgatccatgacagtgcctgcactaagggtacaccaagcaaggagaactggtacaaaggcgctgacgtggaaatgtttctacatagcaattgcgttagtgtgacatggagaggaataaatgagaaaaggagtgttgggagataagggaagaaaagtagcaatggggctgaagctattccaaggattttggtttttaagctgagtgataagggatacctctaaggatgctaggcaatggaatgacatgaattgacttacattttactatgatctaactggctaacatgtaaagaacataaaagggaggtgctttagtcagattagatgaatgactttttattttattttattttattttgagacggaatttcactcttgtcgcccaggttggagtgcaatggcgtgatctcagctcactgcaacctccgtctcctgggttcaagcgattcttcttcttcagcctcctgagtagctgggattacaggcacccgccaccactctcggttaatttttgtatttttagtggagacgaggtttcactacgttggtcaggctggtctcaaactcctgacctcaggtgatctgcctgcctcggcctcccaaagtgcttggattacagacgtgaaccactgcacccggccaaatgacagttcttaaatctcactggcttaatgcaataatcattttttctcttatttatatacctaaatgaatgtgtttggcagagaggaattctgttccaagtagttggtgagagattcagcttgtggagcttgtggcttccttagagtctcagcccccagagtgtctactgcctccttctacctttctgcagtcaggggaagagaaacgaaaagcacttgagcagcagtggttattattttcaccagtaactcacaggcaagaactcaatcatatgctgtacttagcagcaaaggaaactgggagatgccgtctaaatctgtgttcaggaggaaaaggaaatgggttttagagaacacgttatagtctctgccacagggaataaggacagaaacagaatgctacttaggaagatgttgctttatacaaaaaggagatgatggtggccaggcccggtggctcacgcctgtaatcccagcactttgggaggccgaagcgggcggatcacctgaggtcaggagatcgagaccatcctggctaacacggtgaaaccctgtctctactaaaaatacgaaaaattagccgggcgtggtggtgggtgcctgtagtcccagctgctcggcaggctgaggcaggagaatggcacgaactcgggaggcagagcttgcggtgagctgagattgcaccactgcactccagcctgggcgacagagtgagactccgtctcaaaaaaaaaaaaaaaaaaaaaaaaaaaaaaaaaaaaaaaaaaaaagatgatggaatgatggcagccttgaccacagtgcttgcatgggtataaggagaatgatgtactggaaaatgtcccaaactatttattttttgatggggatagtaacattaataggtgatcaatgaaaaattgtttcagaagtaaaatacgattaggaaatgctggatttctctacaaaagatttcttgcaacatttattaggcttgaggatctttgttattttgttgtaaaaatataaaatatgcggttatcaaaatcatcaggaattttttaatagacaatatcacatagctaatattccaaagaatattctttaagaagacaagtgaattattggatagaagatagggtctggtttttgacacgtacttcctgtgtgactctggatgactctttaacctctttgagatttacttccctcaattctagaatggacacactaccttttagattgctcaccttacagggctatacaaagctaataaaatgtacatataagcactgtaagcatcagtgagtattattataagacttagcgtggcaacaaaggagcagagcaaactgagatgcttagtttttgccaggaggagcctgaatgtcagccatcaaggagtcttatcaggtagcattatcttgacagtgacccaatggccctcagtcctttgcctctggaattgatcaaactatatttacagagcctaactacatctgtcagcttataaacaacattgaaataagaatttctaccgattaatgtaaagttgtctagggacaactgtgctgatgttccctatttattataacttattttcaaaatgaggatatttgggaatggcaagcaaagacatttgtttagtaaacaccaaagatcagagagcaaaaacatcagatttttgtggaaggtattctctttaggccttggtgagaacagactaacatcagtcctcagctaggcagtgaccaagtcctctatatttaatgtctagatgaactctctatcactggactgagaggatgctccttttgtaaattaaacaaaatgagcaactctttacgtgcagacactcttgctccaaattagagagaggaccagtgatttgattttcatttataaatcatggtctgtttccacttatggttccttgcaattacctcaggtctctcagaaatatccagtggcctaaatcactcattcacagttgattaagctcgtccactttgcagattttagcagtttaaccatcagaggaatcccatttctaatataaaagacattgagtcaatctcactcattgtaacaccaactagggaaagactcagttaaggaagaaactgcagtggctgtggttgatggcaaagtttatgaaacatatcataagtattgtatagtgaataaagaagaagtttgggatcaaaatacaattatagggaaatcagtagcatatttttaccataagagcagctgattttgtatcctgccctttgtgggataattggattgtcttgacttttttattccatctcttccacttaattttgctgaatataactctagattgataggtttttctttcaatactttcaataactcacttcactctcttgtttatatggtttctgactagaaatctatgctaattcttattatcgtttctctatagataaggcattatttcccctatgggttctttcaaatatttttctgtctttggttttctaaagtttaaatatgatgtagttctcctacttggtgttctctgagcttcctgaatatttggtttagtgtttgtcattaatttggaggaagttctagccattatttcttccaatgttctcctactctgttctctcttcttcttcaggtattccaattaggcatgtgttatgccttttgattgttccttagctcctcaatgttgtgttgttttgtttgtttgttttacttgtttgttactttgcacttcgggttgggaagtttctaatgaccaatttttaggctcactgattttttcctttactgtgccaagactactaatgagtccatcaaaggcattcttcatttctattacatttttttatttttttatggtttcttagagttttcatctctctgcttacattatccttctatttttgcatattttctagttttccactagagtccttaatatattatacacagttaatttaagttccctgtctgataattccaacatctacattatatctgagttttttttttttttttttttgagttggagttttgctcttgttgcccaggctggagtgtagtggcgcgatctcagctcactgcaacctctgcctcccaggtccaagtgattctcctgcctcagcctcctgagtagctaggattacaggcacccactaacatgcctggctaattctttttgtatttttagtagagacggggtttcaccatgttgggcaggctggtcttgaactcctgacatcaggtgatccatccacctcggcctcccaaattgctgggattacaggcgtgagccaccatgtccagctgtttttttttttttttttcttttccaacttttaagttcaggggtacatgtgcaggatgtgcagatttgttacataggtaaatgtgtgccatggtggtttgctgcacagatcatcccatcacccaggtattaagcccatcttccattggctcttcttcctgatcctgcccctcttcccaccccctgccctccaacacgtcccagtgtgtgtgttgttctccacaatgtatccatgtgttctcataatttagttaccacttttctgttcctgtgttagtttgctaagtataatgtcctccagctccatccatgtccctgcaaaagatatgatctcattcctttttatggctgcatagtattccatagtgtatatgtactacattttctttatccactcttgatggttgtcttttcactccgttggtagtttattttgctatgcaggagctctttaggttaattagattccatttgtcaatttttgcttttgttgcaatggcttttgatgtttttgtcatgaaatctttacctgtgcctatgttctgaatggtatctcctagattttcttctagggtttatatagtttttggttttacatttaagtcttttatccatcttgagttgatttttgttgatggtgtaaggaagggatccagtatcaattttctgcatatggctagccagttttcccagcaccatttattaaatagggaatccttttcccattgcttgtttttgtcagacttgttaaagatcagatggttgtagatgagtggtcttatttctgggttctctgttctgtttcattggtcaatgtgtctgttcatccatcttggcaagccaaatcacaaatgaactcccattcacgattgccccccccgcaaaaaaaatgcccaggaatacaggtaacaaagaaagtgaaggagggatgtcctcaaggagaactacaagccactgctcaaaagatccactattaccctagattactgtagccctgttttggttactatagccctatagtatagtttgagattgcatagtgtgatgcttccagctttgttctttttgcttatgattgccttggctattcaggctcttttttgtttccacatgaattttaagatagttttttctaattctgtgaaaaatgtcatggtagtttaatggggatagcattgaatgaatctgtaaattgttttggggactatggccattttcacaatatcaactcttcctatccatgagcatggaataatgtttttccatttgcttgtgttatctgtgattttttttgagcagtgatttatagttctccttgaagataagcacttaggttgagttcatgtctttgttattgtgaatagtgctgcagtgaacatatgcatgcacatgtctttataataggattatttctatttttgtgtgtatatacccagtaatgggattgctgggttgaatagtatttctgcccctaggtctttgaggaattgccacactgtcttccagattaattgaactaatttacactcccaccaacagtgtaagagttttcctttttctcacaacctcaccagcatctgttgttttttgactttttactaatagccattctgactggtgtgagatggtatctcattgtggttttgatttacatttctgtaatgctcactgatgttgagctgtttttcatatatttattggctgcgagtatgtctgttcatgtaaagggttcatgtccttcacctactttgtaatggggttgttttttttttcttgtaaatttaagttccttatagatgctgaatattagacctttgtcagatggatagactgcagaaattttctctcattctgtaggttccacattttttgttgtgacaggaatgctggaaggggttgaaatgggaacagttttcttcctccagttgggaggaggaatatcccaataaaggtgggggaaagtgattttccttggagaacagacctgagtgtatttcacaatgattatttcttcatttcttctgccagagttatgaagggattttttttttttttttttttggtgtgtgtcttcatgagaacatcgtggggattctgaaagtaaagcaaacaaaaatgtaaaggcctccccaagactatggcctccaagactttcttgtatttggtttctagttagtttccaagctagtccatccttaacctccagtactttatcaacattaccattttgtggtgtcctcatcaatttatggttccagtggcttctgtttcaagtgagacttctgttgtgtttctcttgtctccagatttaagggtgatggtttgcctagtgacttcagttctctgataggttcaagaaaagttcatggtttttagtttgttcaactttttcttattttaaggatggagcaacttgcaagctcttggcatattagagttaaaaccagaagtcctttattctgttttatagccacttttatattcctttttttggaaatgagtttctagagaaagaaaggagtccgttactaaacctgaaacttactagatttagaagttcacatcacactgagactcactgtgattctctgtgaatataacatctgtcacttctctgtctaaattctggggaaagtccagtttaggcctactcttgtggcgtgcatttatgcccctgggtatgatttaggttacctaacagttttcattcttgatcgagtgatgggaggaaagaattgcaaggactgtaaaatgaaactggccatgagcaggacccagcaagaaaagagataaatgctagatggaaactgccatttgcccacaattctaacatcttaaattcagttcttagctattgggtgtcagtttttagaagtgaaaaactaacactcttctctccccaccaaaccaagagaaaaaagcattgagacatttcttgatagtcactataaaaaataaagataaactgagcaaagattaagtatttttccttcttccaaaataagataaaacttttattataaaatatgctgctaaatatggacatgctctttgaaaaaataacagaaatcatatgcttgcagtagatttatagaatcaagtttttagaattggaatgtattttgaaggtgagtgtctttttaataacttttaaataactaattttatccagttgcaataaaggggttatatgcaaatacaccagaatgctatgggttcttctttctcattctttcattttatgtagacttggacatgtttttttttggtatgaacatgaatttctttagttttcagtggcatttattataagccagacaatatgctatttatttttttgaattatttttaaacttttgaaaagtagcatatccaataaattctgtaattataaaataaaatgatggctttgtacttcatatgatgtgacaattgttaatctccatcgcctgtttcagtaggtctcaaccttttattcattattgtcccctaaggtgcctttctagatatttttttttcctaattactccctctcccataaaattttattactattgcagatatactccatatctgcttatgtactgcagcccttgagaagtccaaaaacactgtaatatctcctaatttaccccttccccataaaccagttttcacctcttgaacatgctattatcctagttgagaatgcatgccctatttgattaataataatggttatcttttataaatcaccaaactaaatatgtaggtgctggttctagagtcacattatttaggttagtattctggagcaactctttaccagatttgtgattgtgaattatttattaaactcaaagttcctcaattttctcaattcaaaataaaaataatagcacccgaattggtgaaagtaatactgacagttgtaacaaacatccccaaatgcaggatgtttcaaatcctatagaagagtatttctcagtaatataaattccaaacagaatgttactgagtgtcaggttagctctagtccaggtgctggcttcttccaccatgcgattcatcaactgaagctcatattgtttcccaggttgcactgggagttggtatccagccattagtcaagacaagataagggaaaattgcaaaataatgaaaagcctttaggggccagtgtggaagtgatacatactagttttagccacgttcctctcaccagaatttaggtccagctatgattgccacacttaagtaaaagaggggaatgggtgggaaatatgttccatctctgtgtttaggaaagataggagatgaatttcattaatagctagtcagtctctgccatggcagttatttcatagcattgtgaagattattaaactatttgaaagatatattatgtctagaattgtctagcactacaactgggatgttttgaatattatggatggggcataaaatgtaagtttagataccgtcattatacagatgagggaaatgacaggcagagataccactatcctaatgaggatgactggagatgagggaattgatatttatggagattaagaatttgctcaatgtcactgaggtagaattttaatacagcttaataaaaatttaaaacccatttgtttcctctcatttcactgtgcttactctattcaataatttaattagttacttttgctttttaaaaggcactgtcattctgttttccatgataactcaaggtttctttaatagagtgaataaataattatatcattttataaaatgttttgggattatcataataaagataatgatgatgacatcaattcttgagttcctaattgctgtaggttcagatttttttttctttttttgagatggagtctcactctgtcacccaggctggagtgcagtggtgtgatctcggctcactgtaaacttcaccttccaggttattctcccatttcagccttccaagtagctggcattacatgcacccaccaccacacccggctaatttttgtatttttagtagagacagggtttcgccatgttggccaggctggtctcaaactcctgacctcagatgatccacctgcctcggcctcccaaagtgtttggattacaggttcagattttaataagatgacaactgaagtgtgtttcacaggggtaataaaaatagagatcttaataccaaattaagaaataaatttctccaagcatatagaaattaatctaattgatgtgtgcatatatttttaaataatttttttttttttttgagacagagtttcacttttgttccccaagctgcagtgcaatggcgagatctcggcttgctgcaacctctgcctcctcggttcaagtgattctcctgcctcagccttccaagtagctgggattacaggcgcgcaccaccatgcccagctaattttttgtatttttagtagaaacggggtttcaccatgttagccaggctggtcttgaacgcctgacctcaggtgatctgcccacctcggccccccaaagtgatgggattacaggcgtcagccaccatgcccagcccaatgctgttgatcttttcaactaactcatgttagcagccctattaaggcagccaacattttatcagtttcaaatttattcactatgtcactaagatgatggttcttgatttatttttattaatttttatttctatagaaaatctatgaattgtgattgcagttttatggctgataactttctagaaaaaattatgatatacaacaaaacttaacgaatatcagcaaaaaggggaatctacaccttcacactattctattcacgtttgcactttcttccaattttctttgtgcatacgtgtttgcagttatagcatactatactctttatattttttgttgtttgctaatgtaattctgtatttctacggagtcttcaaaattatcacttttaatggcttcaagacattctctatgctgttatataattggtaacatttaaccgtttagtaccaactttttttctccttactttttctttttcttttcttttttttttttgagacggagtctcgctctgtcgcctaggctggagtgcagtggcgcgatctcggctcactgcaagctccgcctcccaggttcacgccattctcctgcctcagcctcccgagtagctgggactataggcgcccgccaccacgcccggctaatttttttgtatttttagtagagacggggtttcatcgtgttagccaggatggtctcgatctcctgaccttgtgatcagcccgcctcggcctcccaaagtgctgggattacaggcgtgagccaccgcgcctggcctctcattactttttcttacatgtatactttcttcttaacattagtaaatgtaggttgagaagttattttcgatttttgtcagcatgacattttgccccagttgtgtctctttttctgtctatagttgctacctatcaatatttttaaaaaaattctgcccctcttttaagccataattatcactcattcattcattgaatttcttaagtgtttctcttcattgtagttttaaatttttctctttctaaacactttatagttttctaaaaactttagcattcaaataatatcctggttttattgccttacagtgcaagataattcatattgaacagcttgttattttactgactgtaaattgattacattctcaaatctcattattgaacattttgtagagccagtatagttaagtatagtagtccgtctttacatgggggatacatttcaagacccccagtggatgcctgaaattgtagatagtactgaaccctaccctatatatgctatgttttccctaaacatacatacttatgataaaatttaatttataaattaggcaaggtaggagattaatgaccagttattcagaagatagagcatatgagagtgatgactgataaacctgtaaaagattttccacattccttaaaatataatgcctttaaggatatgaaactaatttatttcataacagtagctacattactattcttggcatatgaaaaattgaatgttgagaagtaccactataaaattttaaaaatgagaagtcatggcaaatatataccttataacttatatcaatacagaggtgccataagacattaaaaattatcattgctttctgatattagtttactattattttattgtttttgttattattgtcagtttagcatagttaaaaatatactgtatgaaaaatatgatagttataatgctgttcaccaattatttccaactctccgttcttttttaacacatggtaggattgcactttttaggggctccatttggggagatagggctttaagacaggttctgtccagtgggtttggaacagacatatcttctggccagatttcattgccagtatgacattctcaagctcattttcttctgccacaggtagccacgttacagagagtgactgttctgctcatattgatcttgatatgcatataggataaacaggaaataagtctttgcttacttttacttaaacaactgtgatttggggattgttaacatagcaaaatcaatcatcttctgctcatgacagaaaagtcagtttttgttttatttgggcaatttgctcatctaatatttgctcatcttattattatcctagtagcaatttataacaaatggttcatgaagagttctgatttcagattatttatttcccacgtagcctcagtaggataatgtggtttggttaatttggccccctattacttgtacttcaacaggttaattttataactacttattttataatgtaggtttcattgcttttattcagaattaaaatgtgtctttgcatagtaatatttcatttacaggataaatattcattgaataaattctcaaatgcacatctgttacctttgaaaaagttctttcttccctaagtttcatttagttcttaccttacttagatagatatccacaagtttatcatgaattctttaaaaataaactcttaatctaggcatacttatttagtggagcatagttcagcatatcatttatggaaaaaattgttttgacactaaattacaatattccctaatttaaaatctctgctttttcttttttttcctcctgagacggagtcttgctttgtcgcccaggctggagcacaatggtgggatctcggctcactgcaacctctccctcccaggttcaagtgattctcctgcctcagcctcctgagtagctgggaccacaggcatgggccaccacggccagctaatttttgtgtttttagtagaggtggggttttaccatgttggccaggttggtctcaaactcctgacctcaggctatctgcctgcctcgacctcccaaagtgctgggaccaaaagcgtgagccactgtgcctggccaaaatctctgcatatcctttgaaaaattaaatataaatataacttgtattaatatatttgaatttcaaatacatttggaagcacttagtttttagggcaacaatactatgaattcttttggaaagccaagatttattttgtccctttattcttaagaataaagattttataaaatgactcctttccttagactgaaaaatcatattacattacacattacatatatacctaaaaatgaagttaaatttaatatcatgttacatcagagatgtagctgtaagataatttataattacaaattatttttagtaatgtctcctaaattagagctaagagtggtaaaataatcaatataatctctattctgaggtttaaacagatgactccaggaatataaaatctgaggtagacacttcattagttgagtgaagtttctgtaacaaactgtaaagaaaggttgatgtcttatgaaatgtgaaaggttgatgtcttatgaaatgggagtggaccagaaaggaacagctgctcactaccaaaaagaggtgagtgaaggctctgcctgtaaagagggccacattttcttttaagaagtcaattttaagtcttctggtagattgcgttgtagttcaggccatcatcatttgcctcactctcatcatgcttactgaaatgagcaaatgaataaactccagggggaagtcccgtatcagcaaggcatcatatgccacagacttctactagttatagggcatatacactgtgtaaagtgaaaataacaagggtaacttactaacctcctcagtgagaggctgtggcaaagtcagtaagaggaagagaaagggtaactgttggctgaacacccaagagtgtggggtaaagatggggcgtgaaggtgaagctgggctatggacaaagaaagaccaattacttggaacccatttcactatcatttattgacagcattctaaccatccccatcagtgactgctgaggcaatagaaaccactttcaaacagattaaaacagaaattaactgttctttcaacctatgtttccttaaaatatatcatgccatagtgtgagtttttaaagtttggggaattttagggctaaaacagcaggtgctgagcattaagttattcaactattaatttaacgcctcataactttagttaatgtgacaactaaaagaaattaaaatataataaatgtttcttaaggagaaatcttattaatctttattaaaggtaagggtaaagtaagaatatatgataaaaatctgaataaaataaaaaatactagttaagcgcatgtctacaggcaccactttaaacattttctatgtataagtatatttaataatacattattgttattatttccatttcaaaaataaaggaagttaaggacagacagattgggtgatatgctgactcctatatgttggaatttgaattaaatccaatcagtattctctacctccccaagtctgagtatgctccattgccttcaaaaaccagaagcaaatatctgttaggatcataattgtaaatgagttaaccttacctgttgaaagactaaggaaaaaaaagtaaaccgctgagtaaaataaaatgatacacagagatgataaattaaagtttagtcaaagttatattaatcaagtacagataaaagaaagcagagattataatgttgatttcagattttaaaaaataattcatagcaaactaaaattgaatgtttccaagaaggccatttttattgcagtgtaaaatcttagggattttacaatgactaaacattacattagtcattttatatatgtgccaaatagcttgataggtatattgtaaattcagctttataaatttagagattatattattaactcaaattggatttgcaattgttatatctacctgttgaattaaacctgtatcattttgagttgttctcttttttccttgaactctcttgtctaatatttatagagttacactaggtttctttggcttcatatgtgcatggttattatttttcattcttttttcaacctttctgtgtaattgtgttgtagaagtcttttgtaagtggcttatagttttgtttttttaatctagttctcatttgtttttaattggagcattaaatcaatttatagttgatgtaataccaatgtgtttgggtttaaatctgccatctggttttgtacttgctgttctgtgtttagtattttttttttactctcttttcttggtttcctttttattacaaaagcattttcaattaaattttttccctaagaattttggaacttacagattgtttactaattttggagacagtacagattctgtcttatatacttctagttgaatattaataaattcatttgtcttccctttcaagaatacaaggacattagtatagtccatttgcacctcttctgactgacatgttactattgtatattttaatttcattctgttatgatactaacaagacattatcttattgttctgttcaattactagtttataaatttactcacgtatttaccatacccactgatcacctcacataaaattataaatacctctacaggtacactcttgatccctcctgtcttattttgcttatttcttttttttttttttttttttttgagacgaagtttcggtcttgtcgcccaggctggagtgcgtggcgcaatctcgcctcactgcaacctccacctcccgggtgcaagcaattctccagtctcagcttctcgagtagctgggattacaggcgcccaccaccacgcctggctaatttttgtattttttagtacagacagcgtttcaccatgttggccaggctggtcctgaacccctgacctcaggtgatccacccgtctcggccttccaagtaatcctgagtagctgggattacaggcgtgagccaccgtgctcggctgcttatttcttaattctacaaatttgccagtatttaacatgccgtattgttgtttttttgagacggagtctcgctctgtcgcccaggctggagtgcagtggtgagatctccactcactgcgagctccacctcccgcgttcacgccattctcctgcctcagcctcccgagtagctgggactacaggcgcccgccaccacgcccggctaattttttgtatttttggtagagacagggtttcactgtgttagcgaggatggtctctatctcctgacctcgtgatccacccgcgtcagcctcccaaagtgctgggattacaggcgtgagccaccgcgcccggctgtattgttgttttttaaaaaattattttagtgtttattgtatctcctcttccaactaaaatgtatgttctgaatacactgacattcatggattttttcctagtgcttagaacaatgcctggcccctataggaagcaccaattatatatttattgagtgaaagaatgaatttattcttaagtgtcttacactccatcctgagatcaacttccttctgtccaaagtatatcttttatgttccctttgtgaagatttgctgatgtgctcccttattttttccctagaaatatcttatttcatcctaaaaaatgtttttcagcatacaggaatgcttttattatttaatattaagacatttaagatattaattctctgacacctgacttccattattgctgttgagcagtctgctgtcagtcaaactgtccctcctttgtggtaaatttgtctgtcttctcgggctactactaaaaacttcttttcacattctatactcttcattttcacagtgttgtatttgttgcgcatttcttttttaattaacttgtttttgggttcattagatctcgtcttgtcttctatcacttctagaaaattctcagccatagcatcttcaaatacttgtctctgtcccattttcccactgttctccttttaaactttaaatgtgttagaactcaatctgttcttcatgtattttaacttcctttttagatttttcatctctgcttctgctgattcttattcctgctttttctgcttcgtggtaccttgcctcttgcatgcttagttatattttagtgtgagcatctctttttccttgggaaattatccatgggaatatttgaggctagaatgaaggtgtattcattccttcagaggatttacttttgctacctcccagagcactccctatatgagagtagtttatggaggttgaaggatgttttgtctgctcagttgatatgtattaatatttggacagctctgaaccaaagcagctttttctttttttcagcttccttgggttgtcaatgaagtaggtgcacatatttctgggtcgcatgtgccctctgaggatacagttatataattgagaatctcctccttgattttccatgttggctggaaactggattttactttatttctctcttaccaccccacagtcatcccaagcttcctgcccaggttatcagtctgtgatcatggaagcttgagctctccaagcttggcagttatctaagaataaggaattctgtctttactcttttttttgtcaggtctttagtgagatatttatacatgtaatcacaaaataatatattatcattacctagtttttaatactttttagctagagactccatctgacaatggaatcatccatagtatctttgtgtcattgttctctacaaataatgattttaaatcaatgggaagtattaggaactgtttaataataaaacactgggagaagtggttaatcattaagggatggaggaagactttgagaaggaaaaaggctgataactatgtgatttgaatctaattcatttcacactgcaactggatacatagtttggcatatggtggtttaaataccatacatataaggtgccattagatacacctttaccacttccatattaacatttctggtgactcacaagaacatctgtaacaaaattctggcattcatagattttcaaacaaaaatacatgtttacttttaattccattttgcctatttttaaagttttatactcatttatggattttgggtattgtatgacatacgttgatttttcttcatttgaagatcaaacataaattcacctacacaacttttccaaaactgttatggtttcacgttttcaacttctatttgtgaattagctttttctttttttctaaaaagttaaccagttatacaatgcaattaattaaatgcagatgtctatgattttaaaaaactatctatactacataaattaatttgatctatttctgatacattcatattttaaatatgtagctatttattttttttcttttgagatgaagttttgttcttgttgcccaggctggagcgcaatggaatgatcttggctcactgcaacctctgcctcccgggttcaagcaattctcctgcctcagcctcccgagtagctgggattacaggtgcctgccaccatgcctggctaatttttgtatatttagtagagacggagtttcaccatgttgactaggctggtcttgaactcctgacttcaggtgatccactcacctcgacctcccaaagtgctgagagtacaggcgtgagccactgcacctggcccaactatttcatacttattaaatatcatgattttatatttaagttatagatatattcatacttttaagaaaaatagtatatctgcattttccaaaattgttatatttaaaaatagctttgaattttgcgtacatgtttcacttccttattggtatgtctttagtatatggtgctttattcaaatgccataattataaaaatatcttataataatcaactttaaaaagggacatcggtttgattttgaaaaatcacttcttgaccttaaatactagaatgtaataataaaagagattatttgaaatggtgaactgagtacataaaatttgatggtacacttttaacacagatttttctattgttcatgtttaacttaagaaaggtggtaggtttcatctctttatgtcttgatttctcgtacaattgcttcatgctgttatgctaagatcagaattacagatctttcctggctgaaatgaatgatcaacatttaattgactaagttcctcattgtttaagatgctttgacttgtggacgtcagatgcagggaaacagatttactgaaattctgacccctggcatattttttgtcatagacacatagatattacttgaaaccaaatatgtatttttcatcatactttatccattaagccactgaagtcttttggaatattgtcttttatttaagtgccatccatctaaagccgcctgaagttgcagagttctgcaattactgacagtaatactctctgaaaaactatgttaatccagtcttatgccacttaacctcattttggtcaatgatgaaccacatatactatagtgtcccataagattataacagagctgaaaaattcctatcacctagtgacactgtagccgttatgatgtgttagtgcaaggcaatactctgtggttgtggtgatgcttatgtaaataaacctactgcaccgccagttatataaaagtatagcacagtccgggtgcggtggctcatgcctgtaatcccagcactttgggaggctgaggcaggcagatcacccgaggtcaggagttcgagaccagcctggccaatatggcaaaaaccctgtctctaccaaaaatacaaaaattagctgggcgtggtggtgcgtgcctgtagtcccagttactagggtggctgaggcaggagaatcacttgaacccaggaggcagaagttgcagtgagccaagatcgcaccactgcactccagcctgggcgacagagcaagactccatttcaaaaaaagaagaaaagaaaaagtatagcacatatgattgtgtacaatacgtaatacctgatagtgataatagatgactgttcctggtttatgtatttactgtactttttatcattattttagagtgtactccttctacttatcaaaaaaaagttaactgtaaatcagtctcaggtcctttaagaagtattccataagaaggtattgtcataaaaggagataacagctccatgcatgttattgcccccaaagaccttccgggggacaagatgtggatgtagaagacagtgatattgatgaccctgaccttgtgtaggcctaggctaagtatgtgcttgtgtcttagcttttaacaaaaaagttcaagcagtaaaagataacagtttttaaaaatacaaaaagtcttataaaagaaatctataaagaaaatattctgtatagctgtacatgtttgtgtcttaacctaagtgttatttcaaaagaacaaaacagattttaaaaaatttatgaagtaaaaatatagaaagctaaggttaatttattacttaataaaatattttttataaatttagagtagcctaagtgtacagtgtttataaagtcgatagtaatgtacactagcgtcctaggccttcacatttactcgccactcactcactttcttacctagatcaaattgcagtcctgtaggcaccattcatagtaagtgctcaatatgggtataccattcttatctttatactgtattttttgcacaaattttctgtgttcagatacacaaatagttaccattatgttactatcgctacaatattcggtatggtaacatgctatacaggtttgtaggctaggagcaacaggctagaccatatagcctaggtgtggggtaggccctgctatctaggtttgtataagtacactcaatgatgttcgaagaaggataccatctcagaatacatcaccgtcttgataccatctcagaatacatcaccgtctttaagggatacatgactatggtttagcagaaagatcatttatttgtctgtaacgtttgaatcagttcatctgatgatcaaaatcttgccacaataaaacatattctgtcattcagaagtatgctattgagacagctgaactttcacctttgctttccatataaaactcagggttctatagcaattaatttattcaagttggacgattattgttaataatacccttgtctttaaaaaagttattgacttaatccttttggattatttaaaaatgtatcaattcttttttttcttccagtatccattataaacttacagcacagttcatgaatttcaggttacaaaaaatagacatagagttgttaacagcatagttcatgaatttcaggttacgaaaaatagagttgttttcctcaagaatattttatgaaatacttttaaaaggaacatattcctaaatgaaaaaatatttcattgtgcatgtttcagaagcacttttattcaggtatgattaatacatagaactggaatgaacatttgttcatattctttcagataaaacacaaataggagtatatacatgtctttaaaaagatataagtaaatttgcattaaaagtttatgttcttttccaagtctatattttctctttttattaagttgaaaaaaaatgaagaaataattaataagttttatttcattagttctttgtaaaatattattagaatatgtaaaaatagctcatgctactgaaagttattaattggatatgtttactgtgtttatttttatgtatatcattcattaacatataaataagaaaggaaatctgaaagtaagcgtaaggactattatacataatcttgtgtaatttcccaaattcagaaatcaatacatgtgatataattactaatacctagatgatcaatttaattcttttttagatatgtaatataaatagaaaatttcttagggcttaagtaaaaaacaacagtgttttagtttttttctgtgtgaaaaaatactttcatttgcctcattctttacctgttaaaaagcctctcagggtggggcgtggtggcacacgtctgtaatcctagcactttgagaggcctaggcagggggatcatgaggtcaggagatcgagaccatcctggccaacaaggtgaaaccctgtctctattaaaaatacaaaagttagctgggcatggtggcgggcgcctgtagtcccagctactcaggaggctgaggcaggagcattgcttgaacccgggaggcggaggttgcagtgagccgagatcgcgccactgtactacaccctgggtgacagagtgagactctcagaaaaacaaaaacagaaacaaaaacaaaacaaaacaaaaaacactcagaaaaactttatttgctcccacttattttctactttttcttcttttgctattatatttatatttatgtttaatggtcatttatatttaatataaatctatttatataattgtatttaatggccattttatatttttctgtattctcccagttaacatatcctggcagcataaatgaaatttgatgatttcattatcagttatccaaacaagctttcctatccctgacctgtgaatctgtgctaggtggggtagattagaagcttcaggatcttgtaagggtgacgtgacaagggcagataactgatggtcctgatagcacccagagaaaagctacgttaaatctctgtcctccatatagctgaagtagtgtctagtatcagtttatggttcttcacttgaaatgagaatatgttgtatactatagatttaaataaaacaaacttagatttaaactgcttaagctaaagatcttggctatttagctataatttttagtgaaaatatcctagtttattgaatcttacctagatattctttttataagtttgattttattttgttctccttctttcctttttgtcatttctttacttaggctataaatttattttaaagactgagttttctcttgaccaattctttccataagttcacctgttttttatatgacttacactataagagcctatgtagacactcaataaatgtgttttattttgtagcagaatccatgacttattatcagtaaaaccctggttgaggtacttttaatcttgttttccacacctaaacctatctagccctgttgcattgtatcccgaggcccagcattattcaatattttgtgtatttacagtaagccaagtggagtacttattgtatcctggaaataataactatgtcgactaataggcatcaaaataagaattaatttttactttgcaggacaagtactccaagaaacctgagttgttaaggtggtaaacacagaaagcactatacaaagtatttgtaaagattaacattgctacagttatgcaagcacatatttgccttaacaagattagtaatgccagctgcctgcattcaaagagacaatttaacttcaattttaatattacctgaaacagtgtaaaatgacaagagttacatcgaaatatgtatcacaatttcaaatgaagaaattaaagcatacctttatgttatctgctgtgacttttataaatgaatgaaatggaatatatgaatttttattatagaaagctatttgtccaaaattaaaataatattttattacaatatagtttttactgatgtttttacaagtattgtattctctttgatggtaggttctcttgttggtaaattccaatcgattaaaaattcatgttcctttgtttaggcgttggtcatagtggatggtgaattgagtcacttcctcacctctctctattcaaccttttgtgctgcacaggctgtttcctaggaccacttgaagcttgagttctgttcataatttgggttctgccaattagatgcacttgagtaaaatgtggaaggtggaaagcagtctaggctatgtttctaaggtttttctgctggcagactcctgatagaattatctgatatctgtagagtgtcttaccagaataatgcttcccttaatatgggttgcatcctcatcataacagcttcctaatcatggccagcttctggaccaccgatgatacattaactccttgggtcatctagttctgtgaccctcacagttgttctgttaaatgcaatgtaaagtctgttttcagccttcaatatgattcagaaagttatttaaaatttcataatgcattttttatgtttatactacaaaaatgtagttggtctctgcatttaattgatacaattaacaataatatattttaaattttatttacttcaattgttaatttttttttttactaaagaaaatgtacttatatggtaaatgttataaattttatttactatagttgctgcctctacatttatttttagggctgacatagttatttaaaacctggtcataacctagttaaaatttctcctccacgtatggttgcttgcaatatagcccacttgttcctcatcccactgaccctaaactcaacataccccacagctgctaatcacgagaaaacctagtgttcaatattagaataatgtaaataagttctcccttcacacgtgttttctttaaaccagctaatccacaacctctgagggaaagcctaagtggtaacactcataggccttaataatggtgtagccacccaggttctctccatcgtttcctgctcactgggtgaactccctgccacctccagtcttaccgtcagcctcctgttgtcaccccaacctctctggaatctgtgagtaataaatatcttctattttctgcactgtggcttcacttccttattgtgtctcccctgacgcacacgcacgcctgaacttaaccttatattcagccagagctcttttgggcagtggctgtcttgacaagaataaacaagggtatctgctgtataaacaagtttcctgtgaaaggacgacctggtcacagtgagatacttaggcattaggccatcatcaggataaagaaatagcccaaaaaaggcatgctacaaactctcaggcccagtttttttactttccaggtcagaacagggctggagcttatggccagtcttgagagagaccacaaaaccaaattggaaacaattcataacaaattaaatcaaaactgtaaactaaaccgaaaaagtaaaggtgatacctataattaaaggtagcaatttattggccccactactcccactccaaattgccgtagctagaaacaattgctttttaatttttctgggttttgttattttggtggttacttcatatctctgaataacacacgtattccaacaatcatgattttctcatgcgagacatattccgttgatttttctgctagactagataaggactttgtcttcttaaccttcttcccagctcctctccccatagccacccaatgtagttatatcaccattttaatttctttattatgtttttaatttaaataatatgtacttttatcacctttccatcagctctagaaatatgatttttgactcccctctttgtaagatattatcagtgctaatcttccctgacctttctctcctctaccattctttcctccacttctgtgtttcttctgtagttataataaatagtacattttctttctcttgaaaacttctaaaatgcttaaggttttaagctttctttaaacatagtgagatcggaaaataaaggccttatcgaattactcatgattttatcttttctcatggtcatttaatgcctgatctttcaaaagtttcactttcttttactgacattcctctgttgccttggttttgtatttgctgccttcttactctttttctctgctttgtattttgtgaagcacaaaaagctacacagtacactaaaacacaactaattatacttcacattaatgaataggctaatgcttttccggtgtggtgggggagtttccaaaacctagattaggaagactatcaatttgttgactattcagttagcagtagaataagggaacagtatagagagactccagttccctttcctagccaatgaataaaagcttacaaaccatcgtcttatgttcatagattgttttccctaaatattttacatgtatttatatatactgaagttcattagtcaattctatgctaactcaaaaagttattattttttcaatttttttcttttttgagacggagtctcgctctgtcacccaggctggagtgcagtggcgtgatctcagctcactgcaagctccacctcccaggttcatgccattctcctgcctcagcctcccgagtagctgggactacaggtgcccgtcaccacgcccggctaattttttgtatttttagtagagatggggtttcactttgttagccaggatggtcttgatttcctgacctcgtgatccgcctgcctcggcctcccaaagtgctgggattacacgtgtgagctgctgcgcccagcctattttttcaatcttatgctatttatcttactactttctttctcataagtgcataggaaaatttgacactgctgagaaatcactgaactgtttgtgggataccaccagattatttatggttctataagatatttctcaggccaggccttttataaagcaattttaatatatgtatgaattattatatgtcatgtaattattctataattttagaatgtatattcagattaagacattagtttcatgtaatactttcaggcatgctgaagtcccagtagctacaggtagggaagaagcaggaaactgtaaacaggtggacccaggatcaggtacctcacatagctctaggactagtactacagagagtaatagtagtatagtcaacactgtacagtgtggatgtaatatggcagcaggttcttccaggacaggtgaggatacttgcagattgactggtaccatcactgcaattgtagatggcatgaatgacttagacctaactaggaacatgaagacatgtgtggtcttaggaaaaagggttgagtagatatggccagattatcaggaatcaggaaaatgctctaccttcataagaatgataaatcacagtcaagaaacaaaaggataattccagttgcatgttcagcaagccgtgacataggttagaagcaaagtctgcagctcactggacacagagatatcttgagagttaattctaacctagtatttatcaaaaggtgatctattataactctctggaatcctggtcaaaaactaagataattaggcctgttccaactcttagacttcagatcaaatccaataatctctgtgaacctccctgagtgatccttatgaatcttaaaatttgagaaccacatctttagacataccagatactaagtttagaacagaaagacaaatttgaggcattttatttcacttgcttactaccctttaccaaaatattgaggctagttttcttaatttactcttgtcaatgtggacaaaggcctgaaaacactgtgcttatagtttgaaagcatttatatttgcagtgatgtggagctggaaaatgaggatttgctcatttttatttatttttctatactagttgagtgttataataaaatataaaaactcattttagcttcatcttagtctaatgtgcttttcatgacaagtacttaaagattatgtctagtcagtgtagcttcataattgatgtaaaacaatgcagaaacatattaaacatatgacagcttatgagatctaaatttgtaaacttcataaatattaaaaaactttcatattttaaactttcatattttaaaataaatatgaaacctacgatagtcttacattagtcaaaatgaaataaaattaatgtatcacagcccaatgactagtttcttctcattcacctgatgaatgcaagaaagcctgttagttggagtaaaatcatctggtgtgtgctcagctgcatttaactgtagaggccttaagacatgttaagcaatgtgattttgatttcacctgctgactttccgaaggcaacttattataagaaacagttgaatagtgatatcatgctgttggcacttgagctttctgctggaggttgcaatctaatctttgcaaacctgtaattactatttcctaagtaattctaggtttccattattgaatctctaaatgtctaaaaggtactgagatgtaatatacaaaaaggcatagggatcaaatgataacaacaaactctttgtgtcagtaatactcaatttcgatgtttttgatgttataatgacatgttactggcaagaatatttggtgcattttgcaggttcagtgtatttttttatgttggtgttatgaagtctttgaaataaaaagatgttttattccagggttatcaatccatgcatcacagtttagagaaataagtgaaagatagtgattctactttgaaatttaaatgtttgtctctggttattcaagttaagtattttaaaatagttttgactgatatcatgttatatagaaaatgtgaagtcataggtgtctgtgtaatggaatatgaaaaacattgtttattaaaaaaataaaatcctggtagagacatcatttctcctttgaaatatatagataagtgatccactaaaaaagtaaacatctcaaacacaaagtttaattctgcttgtgagaatatgccatacattgcactttttttgtgaaagataaactactcttttttatcatttcattttaatgtgtttcatgtactgtcctaggcacaaggaatagaatcgtaacaaggacagggtttgcttttgtagagcatagattctaatggagaagatagaaagttaaaaagcaaacagaaatttcaagctgatgataatgatgactgagatgatagctgtcacagtgaagatgataggcagtggactttagtagatattagaaagatatacccaagagcactgcatgagatatgtaactaatagagaggaatctgtaataactcaagaaaataaagttctgtgaccaaattattcagacatatatgataaaatattataaaatagtagaaaagaatatttgcagtccctgtggctgcatttaaccatctaaatatatcaatatctatatacctatatatgaaaatccctatctaatgaaatagtttaaaaatcttcccaagattatgcagctacttaaatggctgagtaggactagatctgcagacccctgaggccagcctcagatatcagtcagagtgaacataacaaatcaaagtagtgtccttccacagaggagttaaaatatttaaacataagtaattttagcaatccaataggtgttaaaaaaaagaaaaaagtctatgggccaggcacgatggctcatgcatgtaatcctagcactttgggaggccgaggcaggtggatcacctgaggtcaggagttcaagaccagcctggccaacgtggtaaaaccccgtctcaaaaaaataaataaataaataaaaattagccaggtgtggtggcatcctcctgtagtcccagctattcggaaggctgaggcaggagaattgcttgaacctaggaggcagaggttgcatgcagtgagctgagatcacaccactgcactccagcctaggtgacagaaaataaaaatctatgcccagataaatctttagactaattgagcaaggcctttgcttatacatctttggtgtaccataggtttggatttgtagctgtagactttaacttttgcttgtctatagccactgcattacaaagatgcaaataccagacttttccaaacatgttaatatgggatctctgggagcgggaaccccctaaatggctaatgtataccaggccaattaaaatttaacggcctaggatatgtgtgggtatgcatgtgtatttatttaaaaagacactcaaatagtttttttttatatgaagaaagtaaagctttgacactgaaattaaatgatgtaataactgttatattcagctaatatctcaatgatggctttgaggcagttgatagtagatagcttttttaaagaagtgtttttgaatgtttagcatatgaaacccttatggtgttgtctttatagagcaaagagggaataaagaaatggaatgtaaaaaatcctaaatattccacataaaaaagcttactagaattaataaatgtattcagcaaagttgcaggacacaaaatcaatatgcaaatatcagttgtgatttcatatactaacataaatctgaaacggaaatttttaaaaattgggttaaaatagcatcaaaaatacatagaaatataaacttaacaggagactaaagacttgttctctgaaaactacaaacatttctaaagaaaataaagatggtaataaatagacatatatattcatgaattagatgacttaatattgttgtccatactacttaaagctatccacaggttaaataccatccatatcaaaatacccatagctgttttttttttctgaaatagaaaaagcaattctaaaattcatatgcaaccgcagagaaccaaaaagagcccaaacaatctaaagaacaagctggaggtcctgcacttcctgacttcaaaggatattacaaaattacagtagttaaaacattatggagaaatagttatagaaatatggtggagtaggaagcaccaggaatctgtcttcccacctagagaacaattgtactggcagaatctgtctgatatataactattttggatttttgacatctactaaaggcttgcaacttctaggggaaagcttgcatggcgaattatgattaatttcagtcaatttcagcacttaaccacagtagtagctacccatttcccacagtcacccctgtagcaggcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggtgagtggttattgttgcacctctatccattattgcaagcccctccctgctggctgaagtgacttccagaagattaaaagggccagtgcccttctcctactttatttttctgtttttccccctttgacagctagacattaaaaagtagggcattcaaagtaactgcacatatggtgacaatcagaaaatgactaagttactaagtgtaaacttaaggactgtcttttctaagcctgtgccttgcctttcctttggcacaggcttagaaaagacagtctttaagtttacacttcagactgattcttggcacagagatagcctacaacagaatcctcttatgacaatataaaaagcaaaatcattgactgaagtaaccgcaaactctcagtaagagggagaatctaatttttagagttactatgttattagatccaaaatcacaattcatacaaaaaattaagaaactatgtcttgtccaaaggaaaatatgaaatccctaaaatgacttgatggtggatctgctacagagggactttaaaataattgtgttaaatgatcaaagaactacaggaagatatagagaaagtcaagaaaatgatatatgaacaaaatgaaaaaaattcaatggataggaaacctcacaagaagttaaaaaaaattgggagctgaaaagtacaacaacttaaataaaaaatttactagagcgattcaaaggaagatttgagcaagcaaaggaaacagtcagtaaacttgaagataggacaatggaaatcaaggaacagaaggaaaaagaattgaaaaaagtaaacagagtctaagggacctgtgtgacacaatcaaggagtcacaggaggagaggagaaagagaagagaaaacttgaagaaacaacggatagaacctttccaaatctgataaaagacattaatataaacattcaagaaatccaacagaattcaaggaagatgaactcaaaaagacataaactgaaatacattataatcaaagctttaaaaggtggagacaaagatagaatcttaaaagcagcagaaaaacatcaatatattacttataaggaataatcagtaagattatcagtatatttctcaccagaaacgttgcaggccagaaggcagtgggctgacattcgaagtgctaaagaaaaacaaaaacagaaaacattatcaaacaagaatcttatatccagccaaactgtccttaaagtgagggcgaaattaagacatccccaggaaaacaacagttgggagagcttgttaccattggacctgacttgcaagaaatcctcctgcagagtgaaatgagaagacactagacagtaacttgaagttgtgtaaagaaataaagatcttaataaaggaaaatacatagaaaattataaaagcttatattattgtaacaatactttttaactgcacttttcgtgttctacatgctttaagaggttaatatatatatatttaaatttgtataaaagttcatattatgctttgtaactccaattttgttttgtacataatttaagagactaatgaatttaaaatacttacatgtttatatttttgtataatacataaagatataattttgtgacatcaaaaattgagagggtgggggaatggagcttttgaaggagccgagtttttatatattattgcagttatggtggtacaaatttaaattagaatgttatatatgcaggatctaaaatataatccctatggtaaccaccaagaaaatagctatatacaaggaaatgagaaagaaatttaagcaaatcactaaagaaaataaaatagacaactaaatataaaagatagtaatgcaggaaatgtagggaaacatctataagctataacgaattcaaatagtggctgggcgcagtggctcacacctgcaatccctgcgctttgggaggccgaggtgggtggatcatgaagtcaggagatcgaaaccatcctggccaacatggtgaaaccctgtctctactaaaaatacaaaaaatagctaggtgtggtggcacatgcctatagtcccagatactcatgaggctgagggaggagaatcacttgaacccaggaggcggaggctgcagtgatccaagattgtgccatggcactccatcctgggtgacaaagcaagactctgtctcaaaaaaagaaaaaaaaaagaattcaaaaatagtaaaatgacagaagtagcttccttcttttcagaaattacttataaattgattaaatgagctaatcaaaagactggcaaaatagatttttttaaaaaagatctatgtgtgtacaagagactcattttagatccaaagatgcaaatagattgaaggtagagggacagaaaaagatttctcaggcaaataaccaaacaagagcagggtagctatactgagaacagacaaaatagactttaatcaaaaagtttacaaaaggcaaagaaggacattctatattaataaaaggtttaatacagtaagaagttataacaagtataaacatttatgaacctagtaacagatcactaaattatatgaagaaataacttacataatggaagggaatgatacacagttccacagtaatagttgaagatgaataaatcactctcaataatggctagaaaaaaaaaacaaagataaataagaaaatgcaatacattaaaaaaaaaacaattagacctaactctgtgcaacaacagcgtacacattcttctcaagtgtacatggtacattttccaaaatagactatatgttacttcataaattaagtctcattagattgaaaagatagttatagaaagtatcttctctgatcctaagaagattgtcttagttcattttttgctgttataacaaaatgccacacactggataatttatataaaaatgttttttcctcacagttttggaggatgaggaatccagaagcatggtgccaacatttggcaagggacatcctatggcagaaggcattagatggcaagaaacagagaaagagacagacatcaggggctgaacttgtttataactaccccgctacttcaataatgacagtagtagttttagtccttatggcaggatttatgggaggactctgcctgtatgacccactcaccccttatttggctccatctcctaacactgttgcattggagattaagttttcaacatatgaattttagggggacatattcaaaccatagcaaggatgaagttagaaatcaatataaataaaaccagaaaaagttacaaaactttggaatttaaacaatacactcttaaacaatgaacgttatcaaagagaaattgtaagggaaattcgaaaatacttggagatgaaggaaaatgaaaacaatatatcaaaacatatgggatgaggaaacagtgctaagggggaaatttatagctataagttcttaaagatctcaagtcaacaacctagctttacaatgtatggaactagaaaaataacaaattaaacctaaagctagcacaagaaaggaaataataaaaattcgaccagagataaacaagatagtgaatagaaaaacaacagaataaaccaatgaacccaagacttggttctttaaaaagatgaacaaaatttacaaaactttagctaaataaactaataaaaaatgagagaaaagattcaagtaacaaagtcagaaatagaaaaagggacattcaggctgggcacggtggctcacgcctgtaatctcagcactttgggaggctgaggcaggtggatcacgagatcaggagatgagatcatcctggctaacatggtgaaaccccatctgtactaaaactacaaaaacaaaaaattagctgggcgtggtggcgggcgcctgtagtcccagttactcaggaggctgaggcaggagaatggcatgaacccgggaggcagaggttgcagtgagccgagatcgtgccactgcattccagcctgggtgacagagtgagattccgtgtcaaaaaacaaaaataaaaacaaaaaaacaaaacaaaaaaaaaccctacagaccaatatctcttacgaatattgaggcaaaaatgctcaaaaaatactagaaaacagaattctgcaacatattaatgtatgataagccacaatcaagtgggatttcttcttggaatgcaagggtgactcaacatagcaaagtcgatcaatgaaatacaccacattaagagaacaaagaagaaaaaacacacatgattatctcaattgcagaagaaaaagtatttgacaaaatgcttagagtagtcaaaactgtaaagccaaaaggtagaccagtggcttccagggactgggaggaagggagaatgaggagttactgtttaaggggaatagagtttcagtttataaaataaaaagagtgatggagatgaataatggtaatgtggttgtacaacattatgaacacatttaatagcactgaactgtacacttaaaataggctgataaattatatgttatgttcattttaccacgataaaaaatggagaaaacaacaaaaaacaaacagtatggtactagaataaagacagctatataaaccaatgaaacagaaaacagaacctagaaataaacccacacatatgcaatcaaattatcttcaacaagggggctaagaacacacaatggagaaataatagttgtttcaacaaatgaatttggaaaaactggttaccctcatgtaaaagaatgaaattgaacccttaccttgcaccatacacaaaaataaacagtactaaaaattttaacaaagacctgaaactataaatcctatttaagaaaacttaggggaaaattttataacatttgtcttggcaatgattgcttggataaggcaccaaaagcgtaggcaacaaaggcagagataataagtcgaactacaccaaactaaaaagcttctgtacaacaaaggaagcaatccaacagagtgaaaatgcagtccacggaatgggggaaagtatttgcaagttgcaaatcttataaggggtcaatctttaaaatatggaaagaactcctacaactcaatagttaaaaaaaccaaataaccttatttaaaaatgggcaaagaacttgactagacatttctccaaagacataaaaatgttcaacaggtgtatgtaaaggtgctcaccatcactaatcaccagagaaatgcaagtcaaaaccacaaaatatatcacctcacacatgttaggatggctgttatcaaaataacagaaaataaaaattgtaaggatatagagaaatctgaatccttgagttgtgttagtgtgaatgtaaaatagtgtagcctcaatggaaaactgtttggaggttcctcaaaaaaatcaaaaacagaactatcatctgatccagcagtcccacttctgggtatttagcactaagaattgaaattaggatattgaagagatatttgtattcctatgttcattgcagtattatttataatagctaaaaattacaatgatacaatgtggatgaaccttaagggcattatgttaagtgaaataaaccagttatagaaagaaaaatactgcatgatctcacttatattaggtattcaagtagtcaaactcatagaagcagaaacttgaatagtggttttcagaggctggggagagttgctgttcaattggtgtagagtttcagttatgcaacattaaaaagttctaggtatttgctttacaacaatgtgcatatagttaacaatactatactgtgtgcttaaaaattttaaagggtggatctcattttttttttaccacgataaaaaggaaaagaaaaatgaactggaagtttggaatagaatatcagctgtgatgcaatatgatattgtggaaagaccgttcgttgcactcatgatgccaagatctggatgaccgtcttgctctcatccttatgaactattttacctggcacaagttacttaagctcattgactattttaggactattgtgagaagcaaatgaaataaactttgaagcagcagcttttaatatgagaaggactaatgagcgaggtttgcacagttgggcttcaggaggtgtgtgaaccaactaaaataaaacacaaatgtgaagggtgggtgtggattcatttccatagctctctcttttcagagtcacaagtgaatctctaagataccctcaaagactcaggactattgctcctaagtgttacacaaatattagttagatatcttgtgagttaattaagttattcagaaagatggtgatttagaaaaatgctgactatgtaaacgagattttaaaatgatgactaagtttttttttctctttttcttcatttctccaccactttgccttttaggagtaattttctttcagtttttgaggtagaacccaaatgaatgcttggaattttttttcttttttcatttgttttgttccccatactactttgcagtgctttatcagcatgggtgacattaggaacattcagggggaaaaaaaaaacctgagtaaattaaaattgtcagttgctggatgagaataaactacaaaagacaataaataggcagtgaactagatatagtgtccttggacttacattttgcaacgtagtagatgatatattgtattccacatattttttttaaactctctgaaaaatagagaatctagaaaagaaataacttctaggaacttcttttatttatatagctaaattgtttcatttttctggctggcttttctccgaattcagttctggtgttactatcttgaatcaaagcaaaatatttactactactgagagaacatgatattattccccaaaagctaatattaatgaaaagaatatggaaaagattatgaaactataaaatattaagttataagtgatattttaattatatgaagtatgtaatatattcaatattataattcattgccatcttgaaatcatttataattattacattttaacactttgtttctcaaagaatgctcattatgagaaggatattttatgcataaaagtctgaaagcacatcatgtcaattataaatgcttgactcaagcaagagtcagtgctcttctgtcacatgaaatgtgcctttctcatcattgcaggccttttccacttccggccactgaatcacatggaaaataaacaacaaggtcaacaaaatacaaaaattaacattaaaacagaggccgggcacgatggctcatgcctgtaatcccagcactttgggaagtgcccgaggcgggcggatcacaaggtcaggagaccgagaccatcctggccaacacggtgaaaccacgtctatactaaaaatacaaaaattagctgggcgtggtggtgcatgtctgtaatcccagctactcgggagactgaggcaggcgaattgcttgaacccgggagtcggaggttgcagtgagccgagatcacaccactgcactccagcctggtgacagagtgagactctgtctcaaaacaaatcaaaacaaaacaaaaaaagattaaaacagaaatttcagtgatttattttttcatcaggcttagaagaatggagatagaaaaagcaagcagattcccaattatggaatgccttctatgtcctcttgagtctatatgtgtatattcccagttagggaatccacttacctttttctgtctgcattcttacattccttacatttattcattcacaatgtcacgtgtgtgtgtgtgtgtgtgttatttacttgtttcttctatctcaaattcttccagtatatactcattcttcttcctccaaccttgttttaaaaatatgcttcttttaaaattaagacatttataggaatcacattaactttcaattaattgctttgttcctaacactgaagtactaggggggttctgtttttggtaatgacagaggtatggttgtgctggaagttgatgcttttgtagttggaaatgtttaggagatagaacaaacttaagcagctatgtagataggtttaggacaataggattagggaaacagatccagatcccggttcctcagtaaacgagaacaggccagagtcaaacaagaatgaatgtaacattgacctggaactgaccttggactgaaaggtataggaggacttctgtttcatatactgagagcttcgtggctttaacgctacatttcagtcttatggaagaatacactgtgtcttgggaattccgtattcaaggctctaaataagaaactggcttccacatggacttttataaaatgccatgtattgtatgattccatttacttgaaatctccaaaaccagaaagtgcatagaaatagaaagtagtttagtggttaccctcaggtaaagaacaggagaaagggagtgactgttgagaatacaggtttctttcttaggtgacaacaatgttctggagttagatagtggtcatggttgtacaaccttgtgactctactataaaacatgaattgtacacttttaaatggtgaatttattaaattatatcttaataaaaatacatctagtcacaggttgggagctctatgcagtgatctctgtcagcagctcagctgaaattaaaaaagagctgaactttcaggtgtcagggagctgatgaaagccacaagtcgaaaatgaaagttaagcctttaatcacttactgctatgctgtaagcatgattcaaaccagagaaatctctgacagctcagatatgggggtggtctcagtgtcgagaaagcaccaaacaaaaaggctctagtagttttatgagccttagattagggatggggagcagaagaggctaggaatggaaaagtgaagtacaggctactgagtcagagtggtgaaaagtgtcttcgagatgtgccacacttcacagtgaggaggtctcagcagagacacatgggctaggtatgcaaatatgcaaagagaatagctagctagagaggactgaattctggcctgcagcttcctttcaacactgtgatttattacctgagcacaaagtctgggttggagagggtagctttctcctgcgaggcctgccgggtaaaaccttaggaattacccatggtcaggcctgaaaaatcatggataggttttcagtcaggagccagactcctcaatctccatatcaccagttgtttttgtggacatagccaggcatacgtttatcatcccttacattcactgattggattaccatgtaggtcatcatgtcattcttcaaaggaaaaggttctcttcgttatcttccaggtgggaaattaattcatacattgttgggcttgtctttaccatcaatgatttaagttgtcttaacacgcattatatgttctattatccaagtattaattttctatcatataattatcactgaatatttaatacatacccataccacgcagtagggtatcatgtaataaatgctctcccttttagagtaaggaatgaaaatcagtagtgtaggtaggaatattagaaagtaaattaaggctgggtgcagtggctcacacctgtaatcctagcactttgggaagctgaaatgagaggatcacttgagcccaggagttccaggtcaacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcaggcatgtataaataagcaattatagtatagtgtaacaaatattctgatgagagaaatggcagtgtgtcaaagtgctgcactggaacagctcttaactcagtttggcaatggtgggtaagtttgactgctttttaagatcttatccccaaattatgtaaagaaaataaaaaaggaggcaataagaaggaaagggtatctagtgaagaggaaagaacatgggcacacacctacaggtaaaggtgtactctggggtctaaacagattttaatatggtttgagcataaagtattgggggtaaaggactgatgaaagcaggagctagaaaaaagagataagaatgcaataaaggcaggctttctaagctatattataggaaaaatttgtcactaaacagggcaatgacataatcaaatttacatttcataatgagcctttctaacaccagtgccaagagtggattgcagatgagcaagagtgtagacagaaaagttactctgaaagctctgttgtgaattcaggcaatattgtagagttctaacttagactagtagacttcacaagacagcactatatatgaatacaagtaaatctttagaatttaatatttacgaggacaggtgactgggtatggaaggtgtggaaagagatctaaattttgaatttggacaactagttggaaaatgataccatttgttccaaaatggaacaaagggaaaataataggtctcagatgatgaaaataaatttcgaatatgttgaatttgcaatgtttgtgagaaatccaaatggaaatatccaatcacatatctgggtgtgtggctcaggagaaagatctgagttgtggctataaatttgtaaatcatcagcctataaggcataagaaatgtatgtcaatagatgtggccatgctggacaagtatgtatcagagaggaatgcctagaacaatgcccatctgaacacaaaaactttagaaaagagaagggggtaagtcaggagaaggctataacatagagaatccataagaaaaggtctgagaggtaagagggaaaccagaaaagtagtgtcaggaaatcccaggaaagagatggttggttatgagaaagaattagttgatgatattataaaaagggtgaggtcaggtaggaaaaggatgggaaagaaactagttcacttagcattaaagaagtattggtagcctaggcaagagcactttcactaacatgcttggattaaatccaaacatgagttgaatgaggaattggggtggataaagtcaactctaagttaaatgtttggggatacatttattaattttatattaccaattctatcttgaggaatttctcctccttttatatatcagtgagttgtagagatctctttctagtatagtgaaaatttccatagaagttgaaggtagtacatccttagttcatttgcggtagaatatggacttgaagacagccttactcagactttgaattgacagttggtataaagaagtagtgccaacagcatatcttttctggcagtggcattggtgacagcgttatcagattaggtggtataccagagtcagaagtccaagctgtggcacgtgcttctcagtaccagtatcagaaacaagggcagaggaatcctcatctactagttacctggcatgcttttgaacatagttctgatttttataaattctcttgattcctgctgatttccccagcctggctttgcaggatccctggaaattgctcactacctaatatcttttaaatatgtctctttctgtttaattaaaattcaatttctattgcttctgctaaaaaattttgactgatacacaatacaacaaaatgcacagacgtgtacagtttgatcatctttgacaaattcatatacccatatacagtttgatcatctttaacaaattcatatacccatcaaacccctatcaagacatggaacattgctatcaactcacaaagtgtgcccaataagccactgcaccctgaagcaaccagcatctgatttttactaccatagattaattttgcaggttctaaaacttcatataaatagaagcacacaatatgtactgttttgtccctggcttctttaactcagcatgaagatttgaagatttgtccatgttgttgcttatatcaatgctctgtgtatttattttactgagttttatttcaatatatgaatatatcacagtttatttatatatgtgtattaataggcacctggttgtttatttccagcttggggctattaggaatgaaagtgctataaactttcttgtacaaggttttgtgatgatttatttttttcttatttttttgtttttacggatatgtcatttttattggataaatacctagaagtggaattgctaggcatcatgataggtgcatgtttaacgttttaagaaattaagaagcattgttttctaagttgtataattttttgctctcatcagcatgccttttcattttcatcttctcaacactgtaattttaggatcagattatatatttttaaatttaatttaattttaagttccagggtacatatgcaggacatgcaggtttgttacatggggaaacatgtcccatggtggtttgctgcacctatcaatccatcacataggtattaagccccatatgcattaactctttatcctgataatatgcttcccctaacacccccttgacaggccccagtgtgtgttattcatctccttgtgttcatgtgttctcactgttcagctcccacttataagtgagaagatgtggtgtttggtcttctgttcctgtgttagtttgctgagggataataccttcaagctccatccatgtccctgcaacagacatgatctagttcctttttatggcttcatagtattccatagtgtatatgtaccacattttctttatccagtctatcattgatgggcatttggttgattccctgtgtttgctattttgaatagtgctgcagtgaacacatgcgtgcaagtgtctttataatagaatgatttatattcctttgggtatatactctgtaatgggattgctgggtcaaatggtttttctggttctaggtctatgaggaatcaccactctgtcttccataatggttgaactaatttacattccctccaaaagtaaaagtgttcctatttctccacagcttcaccaggatctgatgtttttgactttttaattatcaccattctgactgacatgaaatggtatctaattgttgttttgttttacatttctctaatgatcaatgatgctgagttttttttcgtatgtttgctggatgcatgaatgtcttcttttgaaaagtgtctattcatgtcctttgtccactttttaatgtttttttccttgtaaatttgtttaagttccttgtagattctggatattagacatttatcaaatggttagatcacaaaaactttctcctattctgtaggttgtctgttcactctgatgatggtttcttttgctgtgcagaaactcttttttttaattagatcccatttgtcaatttttgcttttgttgcaattgcttctggtgttttcatcataaaatctttgcccatgcctatatcctgaaaggtattgcctagattttcttctagggtttttatagttttgggttttacatttaagtctttaatccatcttgaattaatttttatgtgtggtgtaaagaaggggtccagtttcaattttctgtatatggctagtcagtttttccaccatttattaaatagggaatcctttccccattgcttgttttcatcaggtttgttgaagatcagatgatcatagacgtgcagtcttatttctgagatctctattctgttcctttgaattatgtgtcagttttggtaccagtaccatgctgtttggttactgtagccttgtaatatagtttgaagtcaggtagcataatgcctccagctttgttctttttgcttaggattatcttggatatacaggctctttttttgtttcatatgagttttaaagtattttttttctaattctgtgaagaatgtcaatggtagtttaatgggaatagcattgaatctataaattactttgggcactttggccattttcaaaacattgattcttcctgtctgagcatggaatgtttttccatttgtgtcctcttatttccttgagcagtggtttgtagttctcattgaagaggtccttcactttccttgttatctgtattcctaggtattttattctctttgtagcaattgtgaatgggagttaattcatgatttggctctctgcttgtctattgttggtgtagaggaaagcttatgatttttgcacattgattttgtaccctgagaccaccctcaacatgccagatcttgactatctcagaagctaagcaggattgggcctggttagtacttggatggaagcagatattttttactttttttcttcagtgatttgaacattttgtatcctatgtagcaaataatcttctaacataaggtcaaaactatttttcctgtgtttttgcctagaagttttttaattttagcttttatgtttaggttcttcctcattgaattgctgtagtactcttgcgaaaagagtactactatatatatgtgggtttatttctattccattgactggttagtgcatccttttaccaatataacatctttctgattagtataactttataataagccttaatgtcaggtagattaattctcctaaatttgttttctttcttatcaagtttgtttgggctactttagaatcaacttgtctatttctataaaaaagcctatgcattttggttagaattgagttgaacctgtacatcaatttgaggaaaactgacatctaacaatattgtcttccaatctatgaacatgaggtatttgaggtattctcctattccttttagcataattttataatttcactgtaatggttttatatatctttcattaaattggtccctaataattttttgagatgcttttatatacaatatgttctattttacttattctttttttttcaattttttcattcatatggtttgtttttcactaaagcctttaacatattaatcacaattattttaaagtctttgataattttgatatatgcatcatatcttgatatcatttggtttatcccttttagagttctttttatcatttttttaatttagtgtcttataattttgtttttaatgatggacatcatgtcttagtttcaggcagtttctacggaattctgttttatagatgagattttctcagcatttgtgagttttttcccacaaggcattcacacactcccttgaatctgagcaaagtcatttaggagagattttctgtgctctttcaagggaaggtgactttaaaacaaattgatgcataagaaaacttcatatttatggcatatagagtgaaatttcattacatgtatacaatgtgtgattatcagttcatgtaactagtatatccatcacctttcctgcatcagatgacgtttgctcatggcataatggtagtgtatcctttcctgggaatggtgtttctttttgttttaatttggaaatttttctttctttcctttccttttttgatggagtctttctctgtcgcccaggatggagtgtgcagtggcatgatctcggcttactgcaacctctgcctcccaggttcaagcagttctctatctcagcctcctgagtagctgggattacaggcacctgccaccacgcctggctaatttttgtatttttagtagagatagagtttcaccatcttggccaggctggtcctgaactcctgaccttgtgatccacccgcctcagcctcccaaagtgctgggattacaggcatgagccaccaagcctggcctaatttggaaatttctattgacctctcttcaagatagactcttgtctatctggtcctcaaataatccaaccaaaagaatttcttatattcattatcatatattatatttctaacatttccttttagcttgtttttatagcattcattgctcttttagaatcctctgtctgttcactcctattttctattcctattttttaccgcaatgtgtggtaaatggtgtaatacatttatcatagctattttgatgttctggttagataattctaatatctgggatatcttttggtctctttatcttgactatttttcttttgcctattggttatgtgtcagtttcttagggctgctgtaacaaattaccatacactgggtggattaaagcaacagaaatttattttctttcagttctgtaggttagaagtttaaaatcaaggtgttgacagggacataatccttacgaaaactctatgagagttctttcttgtcttttctagcttcttccagtttgcttataatctttcatgtttttgtcttgtagatgcatcactccaatccttaatcttcacatggcatttttcgtgtgtctgtctgcatgtggtcatcttcttttaaggacatcagtcttattgatttaggggtctaccctatttcctgtgatctcatattaagcaattttatatgcaatggtgttatttccaaataagttcatattctgagttaatgggggttaggatttcaacatattctttacaggggagacaattcagttcctaaaagagttctggtttcttgtttcttctctggtaccatcacttttaaaaataaaataccagatatttgtgtaaagaaacacttaacactgaagtcaataatacctgtgccctagataggagatggctcaatttcttcgaggccagtagtgtggcaggctgactcaacctatattttatctggacctaattttgttgaagctttagttagattcacttctcaggcttcaaatggtctaaaagcagaatcacaaatttttccttagtacgtgcatgaagtatgcatgctggagggttttctcatatctcctactcagctcccattcttcagcaggcccagtgtacctgtgtctcaggttggatctgtctcggcactactgtattgtttctaaattttctcaagacttgtcaaaaagagtttgttagtgagctcagattctcagagtacaactattttcttctagccggcatttatgacgacttgctccttttcctgctgctctgccaaagacgaaagcatcctgagtctcttctagattgaatgccttacattttagattttgttttaaaaattttctttgcatcctcagttctttgctgggctttataaatcataattgtatataccattttgtatttctttgtaattgaagtgctcttgcaacttttctaaatcactttattgtagtataattaatatataaaaatacatgtttaatgtatacaactaagtttgaagatatgcatatagctgtgaaattattactacattctattttataaacacagctatcacctccaaaagtttcctctcactctcctaatttgttattacctattttgtgataacaacacttaacataagatctatctaccctcttaacaagtttccaagtacacagtacagtattgctatctataggcactgtgctgtatagtagatcttcaggacttattcatcttacataactgaaacactgtacactttgactgatgcctcactgttttcccatcccctcagtccctgctacttaccattctactctccgcttttatgagtttggctattttagattcttcatataagtgttataacatagtatttgttcttcttgcaactttctacatctttataagtagaagtcactgatatcctttttaaaggtcttttcataattatcctttaccttagatttattaagtggaagctgcattttttggttttatttgtgtataccattacaactaagaaacacaatgtacaaactctcagtcaaatttattgaactggagattgttagtaaacccctaataaattagctccaaatagctatgattgctttctttccaagggttgtgtatttgccacattggcataaatgtaaactagataaagaaagcattataaattattttgtgtgtagttacatataattcaaggtctcagtaggcaaagtaaccccttcccaacatcccaaaatatctacatcccaatcattgggatttatgttacctcatatggcaaaggaactttgtgacagtgattaagttagagccctgatttgtagagattatcctggattatgttggtggacccagtctaatcataggagcccttaaaagtggataaatttattctggcttctgttcatgggagatgtgattgcaggagggagagagacacaacattgctggctttgacaattgggagagggctataagctaaggaatgtgggtgatcactagaagttggaaacagcaaggaaatggattctccaccagagcactcagaaaaacatgaagctcttctgggtccttgatttaagttcagtgagacccatgtctgactgctaatctatagaagtggaagataacaaatctgtgttgtttgaaaccaagtttgcggtaatttgctacagcagcaatagaaaactagtaaaaggccagaacaacaacaaaaaattctgaatatcaatttgtaaaagttgtgagggtgaaattttaaaaagtttttttttcttattctcccatgtttagttcgctaggttagttttataagaaataaaatagaaagctggaaaagacattgacttttttacagacattacttttagagactaatatagagaaataaatttggtttcaaatttgaagatcacaagaaaaggagatctcataatatcttaccagcgttctatgccaccccccccccaccccaggacccgagcattattcttaatataacacatacatgttcttaataagattaacataattttagcaaaaaatttcataagaaggaaatgttgatgggtctataatagtggaaaaaaaggtaaacttagagttatgtaagattaaaaaaagaaacaaaagtaactgactttttgaaatactgtacattaaccgtagttattaaaatgtcataggtttctttgttacttcacaattgagaacattatactatttttccctttttcatgtatatcatttgaaaaatatttcctaaagaaactattgtttttcctacttaaattcaactattctgacaatatattaatactaaccccaaatcttctggtcattcttcagcaagtgtccagtttgtaggaatttttttttttttttttttttttttttgagacgtagtctcattctgtcgctcaggctggagtgcagtggtgcaatctcggcttactgcaacctccacctcccaggttcaagagattctcccacctcagcttcctgagtagctgggattacagtcatgtaccacaacgcccaactaatttttttttttgagatggagtctcgctctgtctcccaggctggagtgcagtggcgcgatctccccttactgcaagctccgcctcccgggttcacgccattctcctgcctcagcctccccagcagctggattacaggcgcccgcctccacgcctggctaattttttaagtatttttagtagagacggggtttcaccttgttcgccgggatggtctcgatctcctgaccttgtgatccgcccgcctcggcctcccaaagtgttgggattacaggcgtgagccgcccaactaatttttgtatttttaggagagatagggtttcaccgtgttggccaggctggtcttgaactcctgacctcaagtgatctgcctgcctcggcctctcaaagtgctgggattacagacttgagccactgggcctggcctgtaagaacaatttaattgcactccagttgtgcctaattcaattgcactccaagttttttttacaggcaatccaattatactctaaaatatcatcttcctgaagagcaaagaattaggatccttgaaaaacttgctcttttagttttgctcttgagattataataaatttcttaggaaaggtgctagataataaatttctggatatgtaaaaatactgtatgtataagctgtccaacccaggaaatctaaatatatagaatgaacgttatactgtttaatattaaagtgtttgattcttaaatatcctgatactagatgagaattagataagtacatgtactacaaatcacacgatgattgtcatttccacaaggttgcttaacatctttaattagtctatctgaattcttagtttaacatatatacttaactataaaagttaaaataagaaagtcatacctagacttttttgacactattttgagaattgacacctgaaaacctgctattgaggataaaagaaaggggaacacacttaaaaaatagacttaattactaaagtcaaataatctttgattctttataataggggcaaaaatttttatacctttcactttcccagggcagtatgtagtatgctttattacggaccatatcaaccctagtgctttcatctctattatatcttcatccatcttttcaaataactctatcctaggttttgtcataactctcagtacccaatccactggccataagtcaagagcttaccaactctcatactcttagtacacattttcttcttttccatggtatattatctttctctcccttctgttctgtccctacttggctaaatccatcagtcatcacttcaaccaacctctgccactatctctagttctttggccccactgatctatcttcattaatgtagctgtttaccaagcaaacttctcttatgcaactggaaagccttgagttaatattaatgaatttttttcagttccatgtctgcagtgattctcagcaagccttctttggccccttaattatttacgttttcttcatactagcaatttcaaagtatttctgctccccataaactaatgacatagccaccatatttcattttattctcatcccatcacttaattcttcaaaagtaaagttaaaattgccttgagtgaagttactcaacttcccaccactaaacctgcacaaatgccttcatctatttcaatcctttccagttttccctttaacttttcacactttaaagagatgtattctttcctacttaatgtttcttgagaatattgctactccataagttttctttgtttttagttatacctccaacttctttttttccagatgtcctttattgagttcttaaatacgtctgtttcttctacattagaattgataacagtagtagtataatcaaaccaaaccttcaactccacattccatttttagatctgtaatatttaatatggcttaagctgcaaattagagtaaccttaacctaaaatgaatttaaaaattttaaaaaaattgtgcttgcctaacaggatttccaggaagtcagtgttccaactctattccttttgtgatatgttcagttctgccctcttctatattttggttttgttattcatggtcaaagatggctgccattcacagctaaagcaacatctgctttgttaatatcaagaaagagggagaggtaaccgctccttcaactataaaaaaaattatcattccctgaatagggtcatctggtgccctaggatcagtagtagtcatgagatgttgagatgattgacatatctggagcctgtaccagtcattggcaagaggaatggaattgctgtgatcaacttagcctactcaggattcttacctggagctcttggtagggataacatctcctgaatcataacgatgatgtaagggaagtctgaatacttaaaaattgaaacgtgttattttatcccagtaaggaagaaagtggaatacttgataagccaccagtggtgtctattacatgaagaagcaaagggaatgaagtaaacttaagtgcataaaaatgacttctcagaaaagtacagatccagatcctatggatacccaaattaattcctaatttattgcttaaaatagctactaggcatgctgactcctgtttcaccctgtcagagggactttgaataaaatggtactagattattaattatggggactagtcatgtacttcatgctctctcaaagcaatgtctagatctgtccttgctttggctgctcttcagccagctctggggtctggcctcatcctgcactccaccctcccaaccttttagtgagaggtacttttaccatctgcaaaggtaaaagagatacctttactatcacatggcatcacatttgccacatgatgtctctatcaaattcaaattaacctacccttaagggtaactgttgcactatctttagtctttctgattccaggtctcttcccatttttctctgacttgtgtgaaatatatacactttccttatatttccaggcatcttctcctcttggggaattgtacctttttctcttattattcctattttctggacctaatgttttttcaactatgtggaatctggtgttagtttcaagtagaaccttcctatgtatgctagtttaccaaagcaggtccaaacatttttcttttctttcttttttttttttttttttggtggtgagcgggggtgaatctcaactatcttagggaattccttttgactttggatttaagaactgagggaaagcatttagctctttgtgtatttgcaaaggagaataatttatgtactattacctttgtttccttcttattttcccaactttgagaactctattttgtttcctgaaactgcctgtatgctttttttgccagagaagtcatcttataaatacttggctatctataatttggcaatgataaaactaaaacagaaaatagcacacacataataataaagggtggtttggtcacaatcaatttctaatagtatacattaccactagctgtatatcatattccacatgatactattggtagtccacagaagactagacatttgctttacctgaaggcccatgtcaagtcattgtcagaaaaagccctgaaaaataatataggcttttacaaaattgccttctgaagtggtggcaacagagttacattacagacattatatgttactcagcaaaactcctttaaggtcttccttggttgagcatgtcttcctcttggttcctccattcctcaagccttccatcttcatagttcctacctccccttttttaggcggatgcctctgccttctgagaagctatctgttagtgtttgtctaagtcttctccattatggagagggaaaaactatgaaaacttatatagaatatttttgtccacatcacccaatgagaaataatttgctttttatagaaggcattaatagatataagatatattaccttgataaaataaaaagaaaagcaaaaagttgatgccctctcctaatcccccccaggtttcttcctgccttcttaatgctttcatgtgtagctctgctatctagagtgctcattctcctaacccctcccctgcccatactttccccatggaaggaaagaataccttcctttattccttacaaatgactaaaaagtctttagtcctgctcacaacagtatttaaattcaaacggaaagcggtattttacattaaggagaaaaatctttaatttaggacttttgcatatccactctgtacctagggaaggactgtgcactgggtaaattttctagaacttctgaaatcacattacgtggacaactttgtatttgcagtttggtcatgaagaagactgctcttgaatgtgttcattgaagagctttttccttctgtgattgtcttttggagcatgaaagtcaaaataccaaagaatgataaaacttaatcaaaatttaaattactgtttaagatctccaaaatccttttggaaaataatttcatagtacattttataactagagcaaaaagagctaatagaggcacgttttctatagcaataactacctcctctgtgttttcacctcttcagaggctaataacactgtcaaattgatggaaaccttcctgcttactgaattatagcacctccatttacattagcataatatatgccaaaaatgaaatactatctcatttcaaagtctgtgggtttattttattacttgtagttgatatttcttgtactctaaactgtaatagtcttcagttttttttttttaaataataaaaaaaggaaggaaagaaagagggatggaaagatgaagggaaggaagaaactgttttttagtgttcttcctcccatggtagataattaataaaaacattgatactaaacaatgatgtaaaagattatatggaaacagggaaatctcaaaaagaaaccaaatatttatatagtgaggtatggtacctaatggaagagcatttaagaagaattatgtagttataatagtcgtatagatatgtagtaccaaatgtaacaacttaacatgattacttcagcaactttcaatgaagtatttgtttcaaatattctttgatccctttcaaaaagaaattacatagctgttattcaataaagataatcgaggtaggtggaactgaaggttgaaattacaggaatctatattggtcataacacagaatttttgaaagcttcacaacaacccaaacaagtggttatggtaggttttaccacattttacagatgagaaactgaaggccagggaattcactgataaaagtatgagagggaactggcagtgggacattgactcctactctaactttagtgaaattctcactatgccatacttttattttttgcagatagatgttctaaaagtaagaattaaatattctcatgtttgtaatttttctcaagcaaactttcattatctcatttaactctgggtgcttctgtaaaagagttctaagaactgtgggagctttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgctgtgtttggttttttgttcttgcgatagtttactgagaatgatggtttccaatttcatccatgtccctacaaaggacatgaactcatcattttttatggctgcatagtattccatggtgtatatgtgccacattttcttaatgtgcacatgtaccctaaaacttagagtataataaaaaaaaaaaaaaaaatcttaatgacttaggaagaatcagagtgaagattttgaagcctttttatatataccatgagttatacagtcaatacatttttgaaggcagagtatctatatctattattttttttaagaacacattgttttacacaattattttacttccagaaacctatgccacagaagacttaacaccctggacaaaaaaatatatacgtatgaggaattttgcataattgtccatagtgaaaatttggcaacaaccaaaatctcacccccaaataaatgattaaagaaaaatatatttatacagtttatgttgtacagttacacaatggaattagctagttctaatgaaaatgaaagattttcttcagaatacagttagtgaaaattgccagttggagaacatatacaacactacttttggggaaaaaaatatgtaggtgtatgtaaatagtgaaaatattttaggcatgggattttggtaatcttcataatctacatgttaggagtgaagttttggtaatcttatgtagtctacatttgtacatttttgtattatgaagagaaactacagagaagtttgcattgtcatctcattaatataatttttaaaatttaaaaaggcttctctgagattgcaagaggtgagtgactttgccacaggtttttagaaaagtagatgactacacgcttaacatgttgttgaggtcatctatgcatcagcaatgggaggttcaggtattatctggtgtccttctagttctaagactctgtgatgctgagagatgggagagatatgaaatctgctgtgctgaaatggaagggcttagcttactcgtggcactccaactgcaatttagaatttcttatctcactccttcttcctggaccgaatcattctcactgtcccatcatattttaaggaataccattaggaagtcactaaagatttcactttttaagatttcactttttctagcacaactagaaacaatgtgatggatttgagttcttaatttaaaaattgtatgcttcatatagttatctagtccaaaaatattttacattgtatgtttataactaaagtgtatcttgttctccctccaccttgtgtagtttatcagtaaaaccaataaagcctactgaattaacagacatataatatcacttacaataaaagtaaatgtactttttacttacagtaaaacaatacaattttacttacgataaaattgtatcacttacagtaaaagtaaatttgtaataggaaaactggaaaataaatgcacagcaattatttctaaaaaaaaaaaaaaaaaaaaaaaaaaagaactgtgagagctccgtgatagaactatatgctgtttgctctctaagagattccaatataatggaaagaaaagagaagcacatgtcctaaagttcttacacctccattgtactggaaacttgtgcaactcttgaacaagtttattattttttttttgtagctaatgtccctacttttatgctcccttgagattttttgtatggtgctatttatgatatccacatgtattaagattatttgtaattatgtttcaaaattattttcaatcatgtcttggacttgtggaatgtgaagattagttcctattcatcctagttctataaggctaagtgtagtgcttacaacacagtaaatgttcagtacatgcttgtgtttggtatatatttattattagaaaggtctatacctctcatataaaattcaagcaatatggacgtatataatgtaaacagttaaactttacatgtctttcacccactcctactgctctcaggtaaccatcgttagcattttgattcagaactacttagactttttttacatggacaaatacgatgtgatttttgaattcataagttaaattcataagacgcactgagaatcaaaaatattctataagctgaagacattatataaaattaaaatattattttatgattttaaactacttcaactgtgttctgtagaaagaaaacaattgaacaggatgatcttaaaactttgatagttgtatagattatcaatagtattttacatgttacaccaaaaatattcatttcatattaacattctaatttatcaggacaacacactaaattttagttttctcattatcagacatcactttattttcacatacattggaatattattggtcaaacttttactctagtaagagctgacatttctatttattaggttctaaactagtgatttataaggtatttctgctttgcagagtattcccattcagtaatggaaataatccttggtcctttgagttaacatttgaaagtacataattaataaatgaacattaagaactttatatctatatttactattcttcaaaagaagtttagccaggcgcagtggctcacacctgtaatcccagcactttgggaggccgaggcgggaggatcaagagactgagaacatcctggccaacatggtgaaaccccgtctctactaacaatacaaaaattagctgggcatggtggcacttgcctatagtcccagctacttgggaggctgaggtaggggaatcacttgaacccgggaggcggagtttgcagtgagccgagatcacaccattgcactccagcctcggcgacaagagcaaaactccgtctaaaaaaaaaaaaagaattttatatatagacagcaattcaaatgtattttttagttttctttatttctatttcattaatgtgcttgactattgatagtcttgattaaggatataatatttactctatttctctgacttaaagaggaaatatatgctcctcattctctatgctacttagtgattttaatttttctcaaggaaactttcatcgtcccatttaacatttgcgcttctgtcgtaaaagaatgctaagaactatgggagctccgtggtagaattatatgctgtttgctctcagagagcttgttagaattttggagtttaagtggtgactttgacctaaaggctgaacatcaaattacaaatgttattacactttagtgagtattagaagaaagaaaaaaatggtacattattgagaattaatgaattatgattgaactaaatggattttagctagccatacagaaactgtgaggttaaaaacatggatttttctgtttcataaaacaacttataattatttgctatcatttaaaattttggactataaataaataaactattaccatgtaatttaattaaacttggtatgacaaacactttgtggcctcagatagaagatgatgtagagctatgcaaactgtgtattcataaaacatatggcagaaaagctctatgaataatagttgactaagagcttaacatatgtctaataatgtgttcagcatagattaatgggaaataaatatattgaaacaatatatttgatatttaaaaactgatttgagctgtgttctaattacctcattgtgccttaatttaatagtgtataaaaactgggaataatacaataaatttattgaggaatttgcaattagtaatagttactagagttaaaacaattctaataatttcatgtggaaagtgataaaaatgatataagtggtatggaaacaaatgaaggttatttattagtaaaattgattaccaacatttttgtgtgaaaggtctaagaaaatttacataatcaatattaagtttaatgtctcatatccaagtcgagtactagtagttaaatagcgttaggaaaaatagctaatgtatgctgggcttaatactgaggtgatgggttgataggtgcagcaaatcaccatgacacacgtttacctatgtaacaaatctgcacatcctgcacacgtaccctggaacttaaaataataataaagaaaatttaaaaaatacaagacttcatacttttctgaggataaagaagtagaagttgatgagtgataatggtattgatgctttctatttgcttttgaaactataagatataaataaatagaccaagagctactaagctactatttactgaatttttaccttattctaagtaattttcatatattagcttctttcatgacttgggtttagatgtgtgtgagaaactgaatgaaatataatatagctacaataccaaattcaagagaaatttggtgaggtgagcttggagataggaaggctgtagattttggatagccatgtaagtcatgtgccctttattttatgggcagtgggaaagcattgtgggttataagtatcaaattacattataggataaaatataattaaatgatttttaaattatatgaacaattcagatttgttttattattaaattggaaaacatcttaaaatttttacagtaacctcatgataggtggaaaaggaatagaaatttatacattgtttttaggagtggcagttgatacaacaatttttggatggcaatattatactatgaaataaaattttaaaatcacatactcttttacataggaatacaacttctaggaattaaaaatctggatactatcacaaaaatttatcgtgaaaactatatatttgaagatgtccaaaaatcctagaagagcatgtcactacttgagaaagactaacatatatgtgcaaataataagaaagaatcataagagctggtgttgttgataggacaattggcactcttaggcactattggattgaatcatcattatattcacacagaataatttaacctttatgaaagatttaggtttgactcagcagtttcgatcactcattctaagaaatttattggattccaatccaaaaatttaagtacaaatgtgctattgtaatgttgtttatcatagcaactaaaaattaagagttaaataaattataatacattaagcagctgaattttatatagtcaatataagtatttatagaagtaaatggtcataataacctataaaaaggaaataagctacacaatcacatttatacaaatctcatatgagtaagtcatatatacatatgtatataaatataaacattatgaaaacttatgctaagctattggtaatggtaaccctgtgatgatggaattttaggggttgttattgtttttgtggtagtgtttatctctacttccttttctttctgtgcaagattctttgttatttatttaattagaaacactaagaaaattatttacataaattctatatctcatagccaatatccacagtgtttttccttttaggagactcataaattcttcccctagaggagcctgatatgctaaatttcacaggaaggccttagaatagactacatcactgggacctttggtataggctgacttaatccctctgttcaaaacttgcttcaaatattgcctagaatatactcaattattaataaatgctgaaaggaataagacaacatctaaacccatctctcagctcttatatttgtttttgtttgcttgttttatggatgtgacattgatgatatacttgtgtgacgtctttatgagtgattctcaaattattgtgcaatttccataggtagaatctttccatttatattaattctaagtagtataattccttctctctgtttttatagcatcatttgctttataaagatagatgaaaaacaggagtctgaacgtttttcctgttttctctgtcactgaaagaagaatgtcagtatacttaaagataagcaattgaatgcaaataatttggaagaaccattttaatcaccataattgtactgaagcacttaaaaatgcatgtatggaattgaaaaatagattaaaaatcctttcaataagtgtactcatttatttaattactttgaagttggaagtaaaaccatcctttctgtaggctatagtatttcactttgggttaacaacttagtaagatgaacaccatttttgacagttagtgtgggtcttgatgttttatcagcattttaataaatttgacttcagtcatttatgtgctttatcattgagattttccaatatcttattccaataagaatgactaatagttatgctcatttaaaaagtaatattgcaatgctgagaatgatcattgcctttatgttcagatttatctgagagtatgtgtggcatctttcctgaaaaatacacacaaggtgattattttgttggagacattgtttgaagaccaatttatgtgttatcttttatttgaaaagcagcttaaaaagacaaaccattccagcacaacattcaacatttgacagttcggctcagtgataaccttattcactcacacgatgtaatggttatttttgttgcaaaggaaccctccctggttttcttgtatctccattatactttgtccgtaagctctatgatgctagaatttccaaatagattgatttttcaactaaaattgaatgtatctacttattcactttcaaacccaaaatatactcacctatttttgcctcaaattctttttaaagcagggaagttaaaaataatttgtaaatccctaatttctccaattttcggtaacgatatcattatcatccaatgtattttgagtcaaaactgtggtattatttttattcttcacttttctagatctttcttaaccacttatattaattaaaatctgcccttcaaaaatgatctctcatcttttttgtcccctcagtattattcaacttgattattgctattttagttaccttctaattccacaacatcatccactcccttgttctttccccagtggagtacctttgttctatggccaaaattattctcataaattaatcatgaattttattattaagcatcactgatgattcatcactgcctataaaataagatgcaattttttggcattcaagactctccacgatagtttccaaaattatcttttcagctctataatttcacttctataaacttttaactcctcatctccaactctcaactctcaacacttatttaggttcaagtccagtggatcatttatcattctctgaacattttctttgtaaagaactgccgtcactagcttcaatgttctccataactcagaccgttataaccaaaagcatatttttggtgtaatattatatctttcatgaaggtttaatggattatttttcttttttttgttaatttctacctcttctgtacttatattttcattaatatatttaaaatattaatattagtcttctaacagttattataatatttgttttggtctgttttattttgtgggtgaaaaacaccaattatatacaatgtgagcataccagtattgtgtatatatgtacatatgcatcctcaagcatctatgtgtatggtctaagtgtgtgcatgtgtgtatatgcatagaggtagaataatgaaggtagcttaagatgtaagaggtaatctttgcctgtataatgattttgtcatgggccaattctgattatgtcacatcagttgaagatgcacatcaagatgtctgaaataactttcttctgcctgttctgacctttgttgtctcactttaactcatcatccagctgctgcctgagtattttgctttaatctattctctactcagctaaattagaaatactattttagatgaaaatagcacataagtatccactgagaaatccctggtggtttaattatcactgattttttttagaagcaatttgaaatggtctccaattgtggttaatttagcaatgagttttcagtggtgtggacatagtaataagtgttaaaatattaaacaagccttcattttgattgccaaatttcttttagagcaaaactaatatagaaatccttacagtcaaggcttctttacaaatccaaacctggaatgtgtgtgtgggtttgtttttaaccttgcagtgaaaaaataaattcctcattaaagaaaactaaagtttgaaaaaaaaaacataaatcctttgcatataccccttatttttgaatcatgaggcatttttggtaaaagtggaaagcaaataatgtcacttatctttagtataacttctttttttatacaaagaaaatagttttaaggaataaaatggtacatcagattcaactcctgactagataatcataatatttacggaagactatttgacaacagcttaaaggatacacaaaataagagcattaaaccatgtaaaagggattagactagtgttctctcagcagtggtcagagttgcataaatctgaaacttgaatgggagaagaaatgtgtgcattctaatcctaaacatgaaaaatattcattctgaaatctacgttaaatacttcaaataaaaaagtatttataatatccatatgggttttctaaaatatattcttccaaaatataagtcaagcatggttaagacaggcccttatcatttaatggaaaggattaggagtgagtataaaaatgttttaagtcacgttttgcaaagtttattctgtggaaagtaagtcctacaaggtacttaatggaaaaaggtgttcatgaataaatgttttaaatattttgtacatattatgtcatcctgtattgaagttaaagcattcattaacatattaaagactgagtattttgcaacacattggaagccaacttttctcaaaattatttcagaacaagatagcttcccaagccaaatgtgtctttcttttttcttaaaacaccaagccagtattcatcgagacaaattctcagaaatgttgtttaaaagtgttaccaattaaaaacaaaacaaaactttacaggtttgtttgttacagaaaacagaattgaagtaagaactactttgcaatggctcatagtattaagtacataaaataaaagtgccaaggaatcccatagcttttgctgacggaagcaaatcgcactcactgtactgactgtgcaatattccatttgacttcattgaagttctgttttctcataaaggagcaacagttgtgcctccctcagtgtgttgaaaggatcatatacagctatttgttttaacagccctaaagtgctacaaaattttcaacttacatttgcctcacactgcctaataagcttgatttttcatgtcagttcaatttccccagtctgaaatgactattgtaaacatgttctcctctcacttctcttaggacactctagcagcattgttcatcaaacagcattgcttcctaattttcagtgaaaatgagtatcttttttttttttttttttttttttggagaccgggtctcactctcttgcccaggctggagtgcagtggcttgatcctggctcactgcaacctccgcctcctgggttcaagcgattctcctgcctcagcctcccgagtagctggaattacaggcatgagccactgtgcccagccgaaaatgagaatcttctgggcagtcctcagtgtctagctgccacatctctaaaactggcctccatcttgccagtgcttctcatctgagtgaaatgttggtgttcttttcttcaatcccaggaggtctgaatcccacgtctccaacactctaagatctttaagtaatttttccttctttagtattttctttttttttgagatgaagtctcactcttgtccccaggctggagtgcaatggcgtgatctcacctcactgcaatctctgcctcctgggttcaagcgattctcctgcctcagcctcccaaatagctgggattacaggcgcctgccaccgcgcccagctaatttttgttatttttagtacagacggggtttcaccatgttggtcaggctggtcttgagctcctgacctcaggtgatccacccgcctcggcctctcaaagtgctgggattacagatgtgagccaccgcgcggccttatctagtattttcattgagtttttctcctttagattcttactgtcaatattttgttattcctatcaaactaagataaacagtaccccaaacatacaaagcaacaaaacatgcaaacctttatcctgtacccgtcagctaccatcatacctcttacctctcaatgtcaaaaaattttaaaagagttataggtacatgccactccttctgcttaccttccagttactctgaataaataaattgccagtctggtttctgcacatacaagttactctcaaatttagttttaaatagctagctaccagtttgtttctatgtgacaactttaatatcctttgaaaaatacttatgaaaaactgacttcaagtgtctagttttctgtaagttacaaagatatatagtctacctacatctattgtaagcactagtaataattcaaaatgaaattctctaaaagatgttaaatgaataaagtaagatttattcccaaaatcagaatctcagagacaaggtaatgttaatgttgcctctttgaaatgctagtttcttcgctctgtggtccagtttggatatcccagaagtcataaagtataacgtcttaatacctccaagtatccattatctacctatataatttattaatgggccgtgcataaatgagacacttctcagtggattatgaatatatattgcttctcagatgtcttaggttgatttcctttttaaataaccagtacatttgaatttaaccacgtcttttgttcacaaacatcatcaaattcttaaatcttacattcaaatccaaactttagaaacttttcaaccttttacaaagtataataaagactgctcactgcatcagtgaaatgtgttttaagtccaggatgtattaaattaaagttcaagctttgtccttaactgtttattttttagaactctcttaatatcggagagtagttctcctgttgtattctaaaaagactcgctgaatttgaaataaaaattattttaattacagcaacaaaaaagtcaatattttcagcagttttttctgtatgagtttattcaagaagtgagtttttattggacataacttatatgcacattgtacagttttaatatataaatgactgtttaaatcctaacagtggcctaatttcataagtagtattttgaaacaaagtatctaggctctctgtaaatagtaagggctattaagaatagattccttttctgcatgttccctttcctggtctttttgggtactttgctttgactttttcctttcccttatgttgattatatcatttgttttaaacttttcttcccgaaatacttatctccaaaggcagatattgagatggggacaaaaaatgttgttggactggtagctaaagaacaaactatagttcagagaatatacttgaaatctcacaagataggtacattttgtttagtaactttgttatttagtaacttttacagcattatcactttgatcttaacaataactcttcgaaaaatacactaaaactatgccctgcatccagcaaatgagaaaacaaatttggataagataaacatctaagatggcagttgataagagacatagaattagaacacagatctgtcttaaatttcatgctctgattttcctgaaattaataaatggcatgaatctaaagctttagattacctaaaatttatttaaatttggctttagaatgttaatttattctctactggaccactattaaaattaatatgcattctctgaacatgtagcaaatgatgatgaaagactctgaagataattgagccgatgagaataaaaacctgtgcaaacttttaaaaattattgataagccccatttcagtatatcattatagataattgaaagttcattctcaaagtgtaagaaagttctgttcaatgtggtagttgtgagataaactctgtaaatcttactagtaatgagatgttatgtttagcaatgattaagaattgttattggcaaattctggaaaagaaattattttcatgatatgtttgtatctgtagattaatatatataagctatttacacagtactcagtatgtgaaattgtaatgtaattgacaaatacacaaaaaggttactaataccactagtcatttctacacttttatgtcttcccatcagtggcaaactaaatccttatgctttcaacatttttctacttagcatcaatatatccttcacacacaaaacattctgccttcaaaaaatacgccaatcctttaattagaaattacagacaattttctgtttgttcattcttgttcatatttctgacacttggtgatacggtctggatctttgtcaccacctaaatctcatgatcagttgtaatcctcagtgttagaggtggggcctggtgggaggtgattagatcatgagggtggatctttcatgaatggtttagcaccatcccctcagtgctgttctcatgttggtgagttctcacgagatctggttgtttaaaagtgtgtagcatctttcccctctgtcttgctcctactctagccacataaaacgtacctgcttttccttcaccttccacagtgattttaagtttcctgaggactccgcagaagcagaagccactatgctttctgtacagcctgcagaaccatgagccagatagcctctattcattataaattacccagcctcaagtgtttctttatagcagtgaaagaatggactaatacactttgtattccagatcatgaattgtgttttgaaggaaaaaagtcacataattataagaattttggaggatacgatatatcttaataaaacatctaatctattcaactccccccaaaatggttaaaaatttttattacagatctttcgtgggattctcaaatatttttgcatttttatttatatattatagtaatttaatttccataaaatttgcccattttaattctacaatgtaaggatttttagtaagtttacagaattgtgcaactatcttctcaacctaattttactctattgccattacccccgaaaaaagtccatacctattctgactttcaaccccaggaaacatctaatctactttctatctctctatatttgtctcttctggacatttaatgtaaataatttgtgttttttaatgtctgaattatttcattgagcataacgtcttcaaagttcattcacgttgtaacatttatcagtacttcatttctttttatgactgaataatattccattctatggatatacagtcatgtgccacctaatactttggtaaaggacagactgtatgtaggatgatgatcccataatattataatagagctgaaaattttccattgcttagtgatgtcatagctgtccttaagttgtagcacaatgcattacttatgtgttagtggtgatgctggtgtcaacaaacctgctgcacttctaatcataaaaaagtatagcacataaaattatgtacaatacataatacttgataataaataaagttactggtttatatatttactgtattatttattattattttaagtgtacttctacttattaaaaaaaagttaactataaaatagtctcaggcaggtccttcaggaggaatttcagaagaagatatggttattatgggtgatgacagctgcatgcatgttatttctcctaaagaccttttagtgagagaagatgtggatgtggaagaaagtgatattgatgatcctgacacgctgtgtaggcctgagctaatgtgtacatcttaagtttttaacaaaaaaattaaaattaaaaaaaaaaacattaaaatagaatcaaccttatagaataagaatataaggaaaatattttgtacagctgtacaatgtatgttttaagctaactgttaatataagacatccgtaaagttaaaaaattaaacagtttataaagtaaaaatgttacagtaagctaaggttaatttatcattgaacaaaattttttaaaaagaaaatttagtttagcctaagtatatagtatttataaagtctacagtaatgtacagtagtgtcctaggccttcacattcactcaccactgactcactgtctcacccagggcaacttacaatcctgtagttttcattcatagtgccgagaaaatgtgtatcatttttatctttatgctggatttttagcattacttttctatgtttagatatgtttagacacacaaataccattgtgttacaatgcctatagtatacaagacaataacatattgtacatatttgtagcctagaagcaataggctagaccatataacctaggtgtgtagtaagctataccatctaggtttgtgtaagtacactctattgatatactcacagtgacaaaactgtccaaggacacgtttctcagatcatattcccatcattaaacaatgaatggctgtgtaccacattttgtttattcattcactaattgttgaggaattgggcttttcccagtttgggggcattgtgaataagctgctgtgagcatttatgtacaagtctttgtgtagacatctgctttcatttctcttgggtagataactaggagtagagctgctgtcttatagggttaactgtgtttagcatatgagaaactggcagacagttttcaaactgcctatagcattttgcattcctttcagcaatgtatgagtgttccaccttctctcattctcatcaacatttgctgtctttcttttgattatatttcaatagatgtgaacggggcatggcattgtggccattacttgcattcccctaatgactactcctgagtaccttctcatgtgcttattgcccagtcatatatcttctttggaaaaatgttcaattcccttaaccatttgttgaattatttactcttttgttattgacttgtaagcgttctttatatattttagatataaatcccttatcagacttatgacttgcaaatattttctcccattctatggcattttttgtttgtttgtttgttttgagatgaagtctcactgttgcccaggctggaatgcagtggcacaatcttggctcactacaacctctgcctcccaggttcaagtgattctcctgcctcagcctcgctagtagctgggattacaggtgcccatcaccacacctggctaatttttgtttttttttatagagatggggtttcaccatgatgggcaggctggtcttgaacttctgatctcaagtgatcctcccaccttggcctcccagaatgttggtattaacagatgtgagccactgcacccggcctctgtggaatgttttgaagcataaaacttttaaattctgatgaagcctagtgtattgtttatttatcacttgtacttttaatacaatctaatgagtcagggagtgacccaagattatgaaaatttactccaatgttttctgttttataaccttacctcttatgtttaggtccgtgatccatttttatttaattttcctgtatgctgtgaaataagggtagaaatttatatttttacaatggatgcccaattgtctcagcaccatttcttaaaaagactattcctttcctattaaaatttcctagcatatttgttaaaaaatcaatagatcataaatgtaagagtttattactgggttcttaattatattccatttatttacatgtctgtcatcatgccagtaccctattccttactgtaggtttgtaataagttttgaaatggggaaatgtaattcctccaaatttgttattttttaaggtttctttggcaatttggcatctttgtatttatgtagacattttaggatcagcttgtaagtttttgcaaaaccaaaaaagcagagattttgatagagattccattgaatctatagaccaatttgtagagtattgccatcttaacaatattaagtcttctgatacatgaacataggatgctattccatgtatttaggtcttgtttaatttctttcagcaatgttttatagtttcgagtataaatttttcacttattttattaaatttattcctaaatattttattcttctggaatctattgtggatggaattattttcctaatttcattttcagtctgttcattgctaatgtataaaaatgcaatttatttttacatgttgattttaatcctatgacattgctgaatcaaatattttatgagagtttagaaaagcccaccctaaatacataatgataacattacagaaaacttagggggaaatctgtgagccaaccatcttgttaaaataattctgacattctgatgtaatttttttattttaacaaatttttgcacaactttgtaggatacatgtataacacaatacaatgtgccttctgtttttacatttattattgtattttatgtgtttttctataacagttttatagaaaatataacataaatgattacttgtcagagaagtaaacttgttataggacttatcagaatccataattgaggatatcaagccaaattgttttgtataaaagtgtttcagaataaatatatgggttccggggtcagaaatatggaagtcaatatcaataggaaacatataactactataacaacaacaaaatcagcaatgctattgtgaatagtgctgcgataaacatgcatgtgcagtgtctacccaaatgcccatcagtgatagactggattgaaaaaaaaaaaaaaaagaaaaaactgttttcagctctcacactgtctgttttactgtcttttaaaagttctttagttcacctatggctttcttaaattatgatgttgacagaatactttgacctgtataaagtatgggagactattgacctccttgttctggagattcattattttatttgctgcaatcttagcttctatgcagcaatattacagtctcagtttatacttattttgtgatcacctaatatcctggtttttatactcattaaatgttgttaaatcatgcttctgccatatttcttgtgtactttccttcatcttgtctccctatatttccctccctttctccttccctccctccctccctccctctctccctctctccctctctccctctctccctctctccctttcttcttttctttcttttgtctcactcttttgtccaggctggagtgtgggggcacaatcatagctcactgtaatctcaaactcctgggtttgagcgatcctcccaccttagcctccttgagtatctaggactacacgtgcacaccaccatgctcgtttgttttgattttttaaaaatttttatatggacagggactcactaagttgccgaggctggcatttattcttcctatgttttattgtgttgactttatcccacagtagtgtattctttaaaaatatctcttgacttatataaactaaaattaaataataaaaatagtcttggaagcaaaccagcctacaggtatactacatccaaaaatttctaaatctcataccaaatttgtagtgatgctttgtataaacataacgtcccaattctgcttgaactgttactacacttccacataatacagtagagtacgctgtgccaatattatgctatgctttctaccaagtgtcatgtgttttgccgcagcagaaaagattttagtcaaatcaaaaagcaatgaaactcaagaactttaccattatatttctagctttattctctcattgatgctatatttttgaaactttgatatcccatcattatcaccaatagcataaaaacaataatgccaatactacaaataataaaaatgtattattgaaatgtatatggattaaaacaaatgtgcaacatttgtaagtgttcatatgtcttcagatcttttctggcagacctggaaaatagttattgtcaaatcaacaatgaaaacaataataaactattaaatagaggagtgaggaaggagctttgcgtgtgtgtgtgcgtgcgcgcgtgcccacatgtgtttttggtggaataaatactttctctatttcctaatttatgattctactaatcaggtgtcttcaaaacaataatgtattccttggcaatacaaatctgaaagctgtcagtaaattctgtcatttatttccattgttttcaccacgtactaaaagatagaaagaacaagactataggagattgacagattgtccaggcatatgccacattagttccacagtcaaatatatattttgcaaatcataaggcacacagtcttttcaggattacacaatgaggcacagatctttacacactgtccaaacaaatgtcttccaagccaagtagacctatgtgctaaggttgatttcaaaaagagtacggtaaagaaaataagccaagataggagatcacaggagaaaatggaggttgacagatgaagcacaatggtaggaacagagactctgagatggaactttgagaatgctgaattttcaatctcaaactcatttacttatggtcataagccactgaatttacgtgtcaatatgagaagggatgaaagtattccaagcttggaaaaataactaagtttctgacgattgttgtgggaaccaattgtataatgtgaataagaattagtttatttgataagtttgagtttgctctattcatttataaaatcaggatgaaacactttataaacgccaagtcacattataagttatatataagacataggcatttacttaatcatagtgtcatttgaggcaaattacctacaacattttcaggtcaccatcacacaaataatgtctgaaaagaacctgagaaaagcccacttttttgtttgaatttattttctgttacaaggaaaagcttgagattatacagttgtttttaagttacttgagatggttttgaagaaatggacttgatgagagatgataaggggaggaatgttttagttcttgccatgtccctctctgattatctcctctgtggtcagaagatagggactggggtgaagatggcaatctggccaaagaggaggtgttagagactcattgcccttctttaccattttgcctaaaaccagccctccatctgattaacagaatatctgagaaagcaaatgtttacttaaaacccaaatgattcatgtctctatctatctatctatctatctatctatctatctatctatctatctatctacacatacctggagttcagtgtcttatcatgatctgattgtataacccaataattttctgagatagccaactattttttccagagacaatgtgagaaagaatagtttcttttgagaaaagttaaaaaaagcacctaccctaattctgaagacaaagaccataataaatgcttttaatattgtaccaaatgaaccaacatctgattccctaagaggaataacattaagagtattcatgatttaaaaaaggaacaaaggtgttaagaagaataaaatatataaactgtgattactcagagtttaatttgtacatttttgtgtggtgaattattcaaactctaacttctgtctctctctttttttaatcttaatgtcttcctttcaccacttgttatcacttccagaaaaaaaaagtagactaaaattgcaaaatagaagaaaatatagaaattatcaggggctgaagttactatagaagaagataaaaattattctgggcagctaccataactgaataggtagtaattggtctcatctggattatacttcagggcagtgtacgtaggaatcttttggagttttttttttgtataacctatatctgtctatgaagtagatatatctttataatatctgtgtgagtagaaataagtgaataacagaaaatttgagtaagccaggtaattccaagaaatgtatgtatcctacaagtaggacaatggacagataacctttaatagtcaattatagacatgagatagaaagtcccctggaatatggcaagatgacagattggacataatttgtaaaaggcagagatgtcccattccttgagagtgcataactcaagattaccctactaaaatgtaatgagagaataatgaggcatcataaatagaggagtgagacaaaatatcttgtgacaaagatttgatgttctttatcctaagggggaaaatacagaggtgagaagggagtgagagacagattttaccttggaattgtatcataagctagacttcccattgtctttctgtctcttctgagagactataagtaagctcaaaaatcaaagcctccagatagatttttttaaaagaaaaaaacgtttgaaaaaagaaggaaaacaaaacaaagcaaaatatatgaatagttccagggctcccaatccagagccgcgaggtgttcactaggttcttacctccaatttttgtcttctagcaccaaaagactactgaaaattttactctgtttttcagtggctttctctttaactttttttaaaaatgtattatgtatgtatatatttagaggaaggatctcgctctgtcacccaggctggagcacggtggtgccatcctagctcactgcagcctcaaactcctgggctccagggatcctcccacctcagtatatacaaaaataaacaaacaaatcagccagacttcatggcacaggccttgagtctctaactttttagctttgatcctttgcatctcagaattagaaaattccttgaggggagatccactgctaaatactaaattcatatccctgggcttttcctctttccagcctctccaactcttaatttttagtttctttgtcagtattgaattacaatttatatgatataaatgtttattgatgacctattatagatcaagtagtgggccacgtactaggggaaaattgggcacaaaaaaacagatgaggtcttggccctcatacaatttaaaatctgctagaggactcagacatagtcaagtaattacacaaacaaaagaagccgaatgagtggaaggaagtacatggtgccacaaacccatgccttaggtgattttaacttggttggggaggtaggcagaagattctcttaggaaataattctttatctctgactaaggatgggcaaggggtaagtaaggaaggagggctactaaagaacattataagggccgggcactgtggctggcgcctgtaatcccagcactttgggaggccgaggcgggcagatcacaaggtcaagagatcgagaccgtcctggctaacacggtgaaaccctgtctctactaaaaatacaaaaaattagttgggcgtggtggcaggcgcctgtagtcccagctacccgggaggctgaggcaggagaatggcgtgaaccctggaggcggagcttgcagtgagccgagatcgcgccactgcagtccagcttgggcgacagagcgagactccgtctcaactaactaactaactaactaactaactaactaactaactaactaactaagattacgagacaggaagcacagaagcataagccctgtgcgggatggtgagaataagaaaccaagagaagacggatgtgcctgaaaggagagagctctgggaaatttgacacgtgatgaggccagataggatgctggaggccaattcacgtcgtgcctcttaagccaaactaagaagcgttatcttcatcctcagagcaacggaagccattcaaagactttaagaagggaagaacataatgagaatggcttattggaaattttagctggctgtaatgtagctaatgggctgtagctcattacatattataataccaatgttactgttgaggagtataaatgtcaaagagattgtcaaatgtatttatggccacagagctaataagtaatggagttggaactcaagctcagaattctacttcctgacctggggcttctccctttaatcagagttgtctgatatgaaagaagaagagcacacatagaaagggctcccaggtaaacaccagcagtttgatttgattgtcagatgacaccaagaaaggagaggccagtcttggggtctatattttcaaactgggagaaaaagagagaaagaccagattggtggagaaactgatgtggcatgtgaggaatagaatactaggtatgtctaccctaaaggaaagaatatgtgggcggtgaaaacatggcaactgtcttcaaatagtgaagaatatgaatttatttgacagggcttcagagaaccaaccaaggccaatagagataagatacagggaagtaccttttaggtttttagaagagttatctgaggaggggtgttgtcgaaactgtagcagagttttcctattattgaaattatataagcagagctggataaccacttataataatagtgtagaaaatattcatcttttgggcagagaaacaaaccttctgatgtctgagagcccttccaactcctccattctgtgattctctgacacataattacacataacctttcaaatttcttaaagagaagatcccaatataaaaatacagtaaaatgtctataatgcaaataaacttgctcagagttcaaactatttttaaattttaaaatattttcatatagcaatggttgttataatgcctaaggcatggtaaaaagccaagttgtaggcagtgtagcaaattataaataccaggttgtatagtaaaacgtcattccttttaaaagcttactttagatataatggttattaattcttgaaaattagatatgctggaaatcgctttatatgtagcatatatggataaaattattattaggttttatgtataacttgattgctgatataaaattgatggtttctttgtcagcatgcaacattattaatgtgctcagcacacacatatcaatgttccaataaatactagagagcatcatcccactaaaacaaaaacaaaaacacctgtaaatgtttaagtttttcaagtgaaagatgatacttgcaatgtgggagattattttagaattgcttagtgaggcctggtttacaggcttgataagaattatgaatataacttttaattctgccaccagatggcagaagtagccattacttaggtaaatgtttacagttaaagtgctttaatatgttttacattattagattaaaccaaaacaaacaatttggatatttgtaatagcgtgtaacatgttttgtaatggtaaagatggaaaatattagcttaaatgagattttggaattaaattaatcataatgtttatgtatcccctgagaatagtatttttctttaataaaaaaactctcacaaggaattcccactgatatgttttaatgaatgcagtaaatatcttaattaattatttatacattaataattcctatatcttcctaaaggtagtcattggactcaatattggggtaaatttaaaagcattatgcacatgctgagtacaaaccaaagactaaagatattatatagttattgagttaaggcatggatgattttttaaaaagattacaaatgttacaaacgaaatacaatcacatgtacctaatacaaagttatttgcctttaataagttaaaaaataaaattaatttgtctagtctctagacaattttaaaacatcaatccaaagggatacatgtgtttctttactaaacagtaaatgccatggctaattaatgcgtgttttcaaagatcacggatacattagctgttttccatatcaattcacatttttgttgtgttgttttgttcagtcctttaaaaaaatctacttccttacatcccactgactctttaaccttctacatctggcttatcctaactatgacaaagaaaatagttttatccagtaaatttgactcttctttaccaactaacacactattttggtcctaaactctcagtattatgtgacaaagattactgtgtttttcttcttaaaacaggatctttccttgactcatttgcttccatactccttcatgtttttctttgcactgctttttagtctatttggagggggagattcttgtcctcgactccacctgcagatgtcagaaatcataggaccacttgttttcttttttttttcccctcaacatttccctacatagtgccattcattctgtcacctcccaatgttatctctatgatgaagcttcccaagtgcctatcccagcccacttctctctactgacctctagacttgtacatccaattgcctccttgaacaaagtctcttttattctagtacattccctttcttcatgagactgacttgatgaatgggctaggcacaatgttttaccttccagcaaaagtgtcgaaaatgtgctaaagtaaaaaccacacaacctattttcttgtcaagtgggaaaaagtaattgtacaggagaatggccacactatcatcagtttcatccagaagcaagatatttataaagggctttgaaaacttctgcttagggcagtaataactatatagttaaggtgtgccttaatttacagagtagacatattaggactaaagataagcttgagctaaattgtgttaattcataatgcattaattcataaagttctttgcagtgaagattcttggtttacactggttgttttatactgaaagacctgtcaacttaaatatgactgtgatgtatattttctatttattgtttcacctagctagtgacctatgataggccttggtgccaaatattctgcccaaatgaaaacaagatgcaatacagactcactttaaattagaatcaagaaacacggaaagaatgagacactggacaatgagatctacccatgtaaagttatggattaaattactgaagaggccatgagtaaagccacgtatgaatgaggctgttctataaggaagaatagtgtttgttaaaatgagtacctgctatgtgctgagtattgttctgagcacttgtttgcaggtaaacaagaacatttaccaagtaaggtgcatgttaacaagtaaacacattcaaaattttgtggaagaacattttaggcagcataaacaacaaatgcaaagatcctaaggcagaaactaaaaaacgaaagaacagccactcgtttacaagcaaacgagaacatttactggaaaacacaccttaaagaggaaagaatggtatagctatagtttagtgagtgagaggttatcagagaccgggggtataggaggatgagctcaatttctaaatcaaaaccagtaaagatttttaagaagaagttcatgtgatgtgatatgtgactactttggctgttgtatggaccatgggttgcaagcctaaggctaggaggatatctcagtgggaaacaaaagaaagcaatatgtattttttgcctcaaatatggcaaataggaaagattatgagtaggccaagtagatgacaggatccatgtagtactgttttgcttttgtttatattttttagaactgaggtatctttcatgtatatgtaggctaaaataaaggagaattagataaggagagttaaagaagcagagatagaagagtaaagatacagaaaagtgtctaatgatctaagatccttgttgaggtgtctacaattaaatttaagaagtgctggctcttgtcaggccccatgttctattggagttgtctcaagttgggctagaaattggaaaaaaaatgcacatcatagattaatggtagagttttattgaaaaaaggagaatctggcatgactgggatcagcaagacaaagatgtaaaagggcctcttgactcattatcattctacagtgcagcatgccaggagcagggcatctgctggacatgcatgttttcattttggtgaaagaatacctcacctctgtgtgtctccccattaacagagcaagcatgagaagtggccttgacagtaagggaatacattggatttatgtcatcgggaaatctggattttgtgtgcttgccaattattaggaattctctggggaagctagatattctctatctaaggaaataggaatctgaaaggtctgagagattctctgattcaccctggctaagagaagaagtctttggttctgtggaaaggtggacttgggtatgtactgtaagttggaaaaaggaaaaactcacccaggtcctagcaagctcattgtccatgcaacccacaggaaacatctaaggtcatttttagatatttctgctaataacacagtagctctaaatgaaaaaagaggtactacatccaatactagagaaaataattatataacaattaaggtatttgtggtgagaaggtgacaggagaggaggaatgtaaataactgatgttctcaattttcccaatgaaaacaagcagcaaggttacttgctgagaatgggagaggttgtgtgggaatattgtggaagtttaaaattacaattaaaaagagaagctaagaaaaagtgaaaagattgatgaacaattccaagggcccacatgatgcacttttatttagggggagacatggtttatcaatgttaatggtattgacatgcatgtgtttatatgtagatgtgcatgttttcctttaacaacattaactctgtttctagaaatcaggtgggaggctatataattgatttatatttggaatttttctagttgtatgtggtagaaggatgggattcatggtattcataattgaggaagctggtgagaggttagtttagatgataaaccatacaccatggcacccacgcatcgtacgaaaaggatagaagccctaagggggctgacaggtcaagaggaaagtattcatcaaaaagataatattctctctgtttaagaagttccatggatcagaagagtaagagagaaggatagttagaggcttttgtcagactatggaatgctggtatttacattgttttaaatagagccatttaaggtgataaatagaatataacattattattttgttgccaaagtagactgagaatagcatggacattaagaaggtccaggattttctggtttaagagtattggataattcatttacatgaatcctgaagccttctaaaattatagtgggagttctgatggaaagaaagagtatgaggtctcccaaattttggcaagtttaagtaatttattgaaaattcaaatgattgtagtggcaaggaagtagactcatatgacattatggcatgactcttcagagaagataagacattataagagatgacagttatccaagagaatgcagtcacccctcttccaccatatccaagtggtacaaatgtgaggacaggtgtcacctccttaaagaaagaaaaatctgctcagctaatacataagataatttgaagatatagaggacaattcagaagagtttgagggaaggaagtcaatacagcaggaggaacaagcagcaaagtgtatcaaaagaatgagagctctggggaaagactggtctttagtttcgtggtgcggaagtactagggtggggagcagaactaactacctagctcaaatattttgatattggtctaagttatttggttgcagaactggctgagggtctcaggtaatatctggctgtgttaaaatgtgtaatagataatatttcaaagttgtggcaattgtctgttttgcagaaagaccattccgatttggaacagtgaataggctcctggtgaagccaggactactgtgaggattgtggtgtagctgtttgatccttcttctgggttgtgtggaatgtggaaaacaagggtgtagtagtgatgaagggagggtctcctggaaaatttgttttcatattgacttttattaaattttaaaaggaagcaatagttaatatatacacttttacaaataattaaaatatacattaatattcagtttttacacttctgcttatttttaaacaaagatttctctctttgtttaacagtaagaacattaaggttggtgtctaatgtagctcttggaaatacaaaatctctttcatttattaatgactataattaaggtacacatttgctaagaccaataattaggttccataatgaacatactacagtaatcgttagctgtgacataaaacatgacaagatgagggtttgcttccctttctctttccctccagtttatattctctctaataaaactcttaaatcttctgtgtctgtgtatgtgtgtgttttgcacctaatatggaagactggtgtgctggcaggatggtgaggagagccaatggtctcatttaatgaaattggaagcttctctcttcttttgtttttcttctctattcctcaccatgtttcttctatacccctgtacatttcactgccaaccgacaaggcaatgagatgaaaaatacaacagagactagccagaaagagaataaggagcattgtcccaaccgtctgctgagaaagaaatgcattcttcccagctacggcattcagtcaggttagtggttgagaactgaaattatttttgctggtataatttatatattttctttatgatcctaacataaaatcagcactatggataagattgctgagacagatagctttaatatggtaagaaaaggaaaggcaagcagtgaggggtcaatcctggaaactgcaccaaggtggctggatgacacgggtacactcagctgcaggcgacctgagggagttcaggcaagcagagaacacagaaagagataatacataatcacagtttcaggggtaggaaatcttcaacaagagctaaaatgggcctagcaacaggagttagaagcatggtaaagaggaggtggagaacagagatggtgagattcaggctgccaggaagacagttttcagttgttacaggaacctgataagtgaactctggtcttacagaaaactgttaggacaaagtagaatcacagaatgagaggaacttaggtgcttgaaatcatgtcaaggcaaagtaccagagaaaaagagaaggaccaggatactggaataagtatggaataacttaagaagaactgggactcaggagtagagcaaagttttaagggcctatattatactgaattgcttttgcaaatgaaaccagagtgtggcagaggaagctatttgtctctgacctgatgcaggtctaagttagtagttggaggctaagagactcagctttaggttaatcggcaaagataaggacaggaaatctaataggttattacaaccaaaatatctttttaaaaagtgattagaattgagtttgaaataaaggtgattggatgattacctggtagcagatgtatgtttatttgtgggaggagggtgcagggcagtgcattagttcatgagagaagagactgcaacttacagtgttttggttccagaacatgctaggattttttttctctcctggtatctggaacatttggtatccaaataattttaattctgtttaacttaatagctaactttgggtttattcattcatacaacaaatatttagcattttttgttttattacatgtaactaggcaagtcctatcatctctaggaaactgggacgagtacttaaaactaaacatgttttgtttctttgctttgatgcattgtttcatatgttatcttttttttttgagtttcagataacctgaaagaaggttatgaggtttgtatgtgaaaaaataaagaataggatttttaaaagattaagaaacagccttcaattcatagtctaaatttgggtaagaaaagaaatgaaagttataaaattgacttcattccatgacttaaaatttcctttgagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttcaaagagaggcagggcacacctttagcagagcaatggagaaagagatggaaaccattaaaatgggtaagaagcaaagaataaacattttaatgaaatctcaaaggtcaaatgtaggctagtgtagcagaatagaatccctaggagtactggacataaggcacaaaagcacctccaccctccacaccagataatttccacagatttccaccatgtgctcaaaagaaaagatggagggcaggcgggagaccacagaggacaggcaagatactccacatgcttgtcacacccacctctcattgaagcaaaagctatcttctgctagaggaggacaggaagcactcctgtgccctggtccaggggaaaggtctgctgctattgggggacaggtagaagcaaaaattgtctgccaatgaaagaggagcaagaaacatgcccagttcagattcctgtgctgatacagaagcagaggcggtctgctgctactggagaaggaacttaaagggaaaaattcctttgagttcaaattctccagttttggaaattttatgcaaatggactcccatgagataaaacaaacaaaaaacacaaactctctccccaccatggcaagaagcacccacaacacacacacatcaaaaaatacaaaacagagtttagctgacatgaagaggcaggaaagaaattctgagaagcccatactctgaggttcagatgcacaggcctgtctaggatcggggctttgaaaagcagcagtcacaagcctgagacacagagggagaaagtgggtaggaggagacggaggtagggagagagagagatcggtagggtgagagagagactgaaagagagatgaattgattgattttaagaaatttactgacatttttatgggaacagtcctaaatttgcagatcaggctgacggggtagaaattcagggaaaagttcatgttacagtcttcagtacaaaatctgcaggctggaaacacaggcatggtttctaattctgcagtgttgaggaagaattgctgctgctttgggaaacctcagtctttactcttaagacattcagctggttggctgaggcccacctaattatggagggtgatctgctttactcaatgtctaccaatttaaatgttaattacatctaaaaatatacctttataacaacatctagatctgtatttcaccaaacaattgggcactatagtctagacaagttaacatgtaaaattaaccatcacaatggtcagtatcagaaaggatacttcagaaaaattattaagaataatagcccaagtgaagtggctcatgcctataatcccagtactttgggaagccaaggcgggcggatcatgaggtcaggagtttgagaacagcctggccaacatagtaaaaccctgcctctactaaaaatacaaaaattacctgggcatagtggcacacgcctgtaatcccagctactcaggaggctgaggcaggagaattgcttgaacctgggaggcggaggttgcagtgagccgagatcgcaccactgcactccagcctggtgacacaatgaggctctgtctcaaaacaataataataataataataaagagggacattacatgaagataagggggttaacttttcaagagaacataacagccttaaatatatatatatatatatccatagcttctaaatacatgaagcaaaaaccaatagaactgaaaggagaaatccataaatatacaattatagtaggagactttaacaattctcacccaataatcagcagaatatataaacagacgattcaaaaaatataaaaaacctgaatagaactatcaaccaacttaacctaattagcatttatagtacactccaacctacaataacagaataaataatcaagatattctgggcaatcaagtttcaataaatttaaaaagattgaaacaactgaaacatgcatgaatatgtttgcatcctgagagcattttattaagttaaagaagacagcaacaaatggctacatactatatgatttcattaatatgacattctagaaaaggaaaatctactgggacagaaaggttgccaggagccagatttgcagggaaggtaattgactgaaaagaacacaagggaatttggggaatgatggaaatgtcctatactatgattctagggtagttacaggactgtgtgaatttgtccaaacttactaagctatacatttataaagtatgaattttgttcaggtaaattacatctcaataaatgtgatttcttaagataaattcctttgagttcaaattctccaattgtggaaattttatacaattagactcccatgagattttttaataaaacaaaaccacaatagtgggttatcaaatacccaggtggtactcagggccaaagggtatccctttgggcccctttgtatgaaagccttgtccttcctttaactaccataatggcacatgttcactaactagatcaatttttatctcaaagtaaccacaaatgaaatgttttttaaaatattagatatgttcattaatttttacttattatacgtataacaattatttataatttggttctcattacctagagcacatttgtaacttttttcaatagtagaaataaatttacatgatattgactcataattgagggctataccttattttcatcaaaaatatacttagttggactgtaggctaattggaacaaagaattaggcagctcacatactcattaaatattctattgaagattaatatgcagaaatacacacaaaatattcaagctagatagattttcatgaagtaaacctagatcaagaaacaaaacattgtcatctcctggaatccttattttgcctccttgcagtagctaccaactccccatatcaaaggttcctgctgtttttgaaactttcataaatggaatcatacagtatatacttttttgtatgtgatttttaaaatagtattttgtgtgagttacatccatatcattacatgccgttgtagtttggtcactgtcttggctgtataagaatgcttttatatgaatgactacaatcattttcccattctgttgatgaccctattgattttgttttcagtttgcactagttcacagcttatagctatgaacattcttgaatatttcttttggttaaaatgcataggcatttctgatgggcgtgcttctaagaatgtaatagctagatcgtaggacatgcacatatatttagctttactctgtaatttttttcaaataaaatttatttttctaaatatgtcatttgtaataaagtgctaaattttcggcattaaaagatgataaattattacaaacaataccactatctatctgcttgacatcttatgagatacttatgccaatatccagaacatattttatatcttggtgtgataaaaagatagcctttacacatgtctcttatgcacatgattcctaaggcatattgttttctaggcctccagtgacacataactttgacagtgcatgataacaatgctatgttcatggattaaaaatatgcataatttcatattttattccccttaggaaatgttatcactgaacttacagtgaatgtagttgtcagtattccacctgtgaagcccaatattactgtaataaatgctctagaaatatgataattgacttctctgagtgccaagaagaatcagtagtcaaactagggcctgcaagaatgagcttcccctacagcaatgtaataaaattttccagggtcttagatggagtattttcttatagagcctgatattttaaaaggcaaacttataaaacagataaaaggaattatttttgtttatttaataggtaaaattacacagtacactataataatagttatataatgttccaaaaataatttgtcagtacatataatagtttttatttatttcttgatatttaacttactactttgtacaaagcatgcatatatatatatatatgcttatatatatatacttatatatatgatatatatatatatatatcacagtcagaatggctactattaaaaagttaaaaaacagcagatgctggtgagactaacagagaaaagatgctggtgagactaacagagaaacactatatacactgttagtgggaaagtaaattagtttagccaccgtggacagaagtttggagatttctcaaataatttcaaactaccatttgatgcagtaatctcactactgggtatatgcccaaaggaaaataaactgttctacccaaaagatatatatatacttttatgtttattgcagcactatttacaataggaaagacatagaatcaacctaggtgcccatcaacagtggattgaataaagaaaatatggtacatatataccatagaatactatacagccatgaaaaagaatgaaatcgtgtcctttgcaactggaggccattattccaagtgaattaacacaggaacagaaaaccaaataccacatgttctcacttataagtggtagctgaacactgggtactcaggggcataaagatggcaacaatagactgggaactactagagatgggaaagagggaggtgggtaagtgttgaaaaactactgggtactatataggctgactacctgggtggtgtgatcagttgtaccctgatcctcagcatcacacaatatacccatgtaataaacttgtacatgttctccctgaccctaaaataaaagttgaaattattaaaaagtaaaggaactggaaggcgttaaatgctgcctaactttgtaagcttctcttgtttcttccccatccccaagcataaagaaggactctctctgcaatttccttatctaagtaaacttctttccatgagaaatgcagtcctttaaagatcccctccataggaatctcatcaaattagcaggaaagtttaatcactggaaaagagaaaactaaaagctgttaccttgcgcagtagatctttcatcagttctttactcctggatattacctggtagagtttatctcataatatgacaaccattgttcacagtaaagttccacccctcaccttcctgccacctccctgggacctcagaggaactttatctcaggtcattgttttcttggctcattcatttctcctaaaaatcatttacttcccctgtaatgtttcctgaagtctctcactttcctgtcccctatgaagagtgtatatgagcctcaaacatctggctctgccttgggtctcatatttgcaggactgccaagtccatgtatatatgaataaactttgtatgccctttttttactactcatctattgttggttcattccagtgaaccctcagagatggtgaaaaggaagcattccctttcctacaaaggcatgcataaataaacatacattatatggtttggttctgtgttcccactcaaatctcatctacaattgtaatccccatgctttaagggaggaacctagtgggaggtgattgtaccatgggggtggttttcctgctgccattctcgtgatagtgagttctcatgagatctgatggtttaaaagtggcagtttcccctgtgctctctctctcctgccaccatgtgaagaaggtgcctgcttcccctttgccttctgccatgattgtaagttttctgaagcctcccccgccatgtgaaattgtgagtcaattaaacctcttctgtttataaattacccagtctcagatagtaacttcatagcagtgtgaaacctgactaagtattaaaagtgtacattcattcatctgtatgtttactcttttaagaaatactagttatgacttttatttcagtgaagtttctcttgaaggagtggaacatttctttataaaatagagctccaaaatgtgtagagatattgaataacattgttattttattcccatgattccttatttaagcaggccctacaaagtatagtatctgaacgcccaattccaatcagagagttttgcatttcttactattttcttcaaatgatattcaagctattttatttcctggaaaatgccaacatgaaaaacgtttggaagtttgaaagacttctctgataaaattctaagctcaaaagtggcactaattactagccaacattttatgtgtccatttgttaacttgtttatttgattattatctgtcttccttttcagaaggtagatgggaactattttatgttcactcttatattctcagttaatatcacaggtgttcaattaatatttgttgtgagagtaaaggaataaatgcacattctttgaaaactttttttttttcccagaagcgtctacttctgtcacccaggctaaagtgcaatggcacaattatagctcactgcagctttgttctcctgggctcaaggaatcttcttgtctcagcctcccaagtagctgggacataggcgtgcaccaccacactcagctaaatttgtttggtcttgttgttttttgtttgattgtttgtttggttggttggttggttttttttttgagacagagtcttgccctgtcactcaggctggagtgcaatggcacaatctcggctcactgcaacctctgcctcccgggttcaaacaattctcctgtttcagtcttccatgtagctgggattacaggtgcctgccaccacacccggctaatttttctaatttttcgtgtttttttttttttttttagtagagacgggttttgccatgttggccaggatggtctcaaactcctgacctcaggtgatccacctgcctcggcctcccaaagtgctgggattacaggcgtgagccaccgttgtttttgcttttatttatttttgagataggatctcactgttttgcccaggctgaagtgcagtagcttgattacagctcattgcagcttcaacttcctgggatccagggacctcctacttccagcctcccaagcagctgagattcctggcgcatggcaccacacccagctaatttttgtattttttgcagagattgggttttgccacgttgcccataaatagatatcaatgcctgtaaatagatgtaaatttatgtttgtatttctttattgatttttggtaaccttttttttgtgtgtgggaaactctttttattttgtcgtagcttacagattcttcagtaaacttgtattctttggtgatgggctccaagtattcaaattaggactggggtgatttttggcagactgcacaggaatagatgcttaaaaagtgctttttcagtttttataagcacaaaaaaggtagaaccttgatttgctgagaatgaagtgtgaaaaactttctaagaacatcatattatttaaattattttatgtctgcatttgtttttgtctacttaatctgttagtgactgcaataaagacttctaaataaattttaaatttgctatatatattttattctatcccatcagagatatatagatttatgatttaatatcataattatgattgtatctttcattaatagtaaatgacatttgtgaccatttttatctttttaatgtaattactaattgtataaaattagtactatcaacctaactttattttgtttacttatatgtataatgcttttatttatttttgcatgtaaataattattaaatgtgtactaagtttgcccattgggcaaggatctgggcataaaatgctccaaaaatataaacaactataagaaattcctttctgaaattctcataaatatttacttatctttttttcctccttaaaattcctgtattgcagttttttaataattaaaatacagacaaattttgttctgccggctattttcttttcctcagtctgtgaattcttgtcttttataggttgattaaatcttgtaggttcattcttctgtcatattgttttctatttttatgaatttgtgaaaagtattaaatttattttctaacttgtccttataaagtgttttcttgccttttattcttctccagtaaattgacaagcttatagcctctaattcttctggcagtttacgttgacaaaatattctttaacctatgttatttcatcaaaagttgaaagcaaaatgatgcaattttaaaattttattttttcataataaacagggattaggttgttattaagttcttttttaaatttttaattgtgtgtatagtaggtatacatatttatagggtacatgggatattttgatacataaatgcataagtaataatcacatcaaagtaaatggggtatccattctttcaagccttcatcttttgtgttacaatcaatttatgtatactattttagttactttaaaaagtacaattaaattctaattgactgtagtcaccatgttgtgttatcaaatatgaaatcctattctttataactaatttttgtaaccattaaacattaacctcttcccccacaaccacactacccttcctagcatctggtaaccatttttctactatctgtctacaagagttcaattattttaacttttagctctcacaaataagtgagaatgtaagaagtttgtctatacctgtcttatttcacttaacataatgacatctgggtccatccatgttgttgcaagtgatgggatctcatttttttgtagctaaatagtactccattttttatatgtaccacattatctttatctattggtctattggtggacacttaggttgcttccaaatcttggctattgtgaacagtgctgcacaaacatgggagtgcagatattttttccatatactgctttcctttgttttgggtatatccctagtagtgggattgctggatcatatggtagttctatctttagcttttaaggaacctccaaactgttctccatagtggttgtactactttacattcccaccaacagtgtatgaggggtcccccttcttcatatccttgccaccatttgttattgtctgtctttttgatataagccattttaactggggtgaaattatatctcattgtagttttgatgtgcatttcatcgatctttttatatgccagtttgccatttgtatatcttcttttgagaaatgtctattcaaatattttgcccatttttttgagtggattattagatttttcctatagagttgtttgagctccttctgtattctggttatttatcctttatcagatacagagtttgcaaatattttctcctattctgttagttgactcttcactgtgttgattgtttcctttactgtgttgaaacctttaatttgatgtgatctgatttgtttacttttgctttgattgcctgtgcttgtggaatattactttagacatctcttttttcctttatttcttctaaaaaaatgagatacatgtacagaacgtgcaggtttgttacgtaagtacacgtgtgccatggtggtttgctgaacctattgacccgtcctctaagttccctctcctcaacccccagcccccaacaggccctggtgtgtattgttccctctctatgcccatgtgttctcaaggttcaactcccacttatgagtgagaatatgcagtgtttcgttttctgttcctgtgttagtttgctgaggatgatggcttccagcttcatccatgtccctgcaaaggacatgatctggttcctttttatggctgcatagtattccatggtgtataagtatcacatttctttatccagtctatcattgatgggaatttgggttgattccatgtctttgctattgtaagtagtgctgcaataaacgtaagtgtgcatgtgtcttatagtagaatgatttatattcctttgagtatatactcagcaatgggttgctgggtcaaatggtatttctggttctagatccttgaggaattgccatactgtcttccacaatggttgaactaatttacattcccaccaaaagtgtaaaagtgttcctatttctccacagccttgccaacatctattgtttccagacttgttaataattgccattctgactggcatgagatggtatctcagggtggttttgatttgcatttctctgatgatcagtgatgttgagttttttgttttgtttttatttgctttgttttgttttgttttttgagacagagttttgctcttgttgcccaggctggagtgcagtggcgtgatctcggctcaccacaatctctgcctcccaagttcaagcgattctcctgcctcagcctcctgagtagctgggattccaggcatgtgccaccatgcccgactaattttgtatttttagtagagatagggtttctccatgtttgtcaggctggtctcagactccagacctcaggtgatctgcccacctgggcctcccaaagtgctcagattacaggtgtgagtcaccacaccacacccggcctgttgagctttttttcatatatttcttggctgtgtaaatgtcttctttcgagaaatgtctgtttatatcatttgcctactttttgatggagttgtttggttttattttgtgtaaacatgtttaagttccttgtaaattacggatgttaggcctttgtcagataggtagattgcaaaaattttctcccattttgtaggctgcttgttcactctaatgatagtttcttttgctgtgcagaagctcttttgtttaattagatccaatttgtcaattttggcttttgttgcaattgcttttggcattttttcatgaagtctttgcccatgcctatgtcctgaatggtattgcctaggttttctactagggtttttatagttttgggttttacatataagtctttaatccatcttgagttaatttttgtatgaagtgtaaggaaggggtccagtttcagttttctgcatctggctagccagttttcccagcaccatttactgaataggagatcctttccccattgtttgtttttgtcaggtttgttgaagatcagatcattatagatgtgtggtgttatttctgaggtctctgttcagctatactacaaggctatggtactggtaccaaaatggacgtaccttagacatctttgcccaatgcaatgacctggagagcttccccaatgttttcttttagcagtttcatagtttgaggtcttaggtttaagtctttaacccatttatattgatttttatttatggcaagagatagtggcctagtttcattgttctgcatatggatattcagttttcccagcactatttatggaagagattttcctttcgcctttgtgtgttcttagcacttgttttcaaaaatgagttcactgtagatatatgtatttgtttctgcattctctattctgttccattggcctatatatctttttatgccagtaccatgctgttttggttactttaggtctgtagtatagtttgaagtcaggtaatgtgattcctctaattttgttcttttagctcagggtagtcttggctattctgggtcttttgtggctgcacataaattttagaattgctttttctttctgggaaagtcattggtattttgatagggattgtataaaatccatagatttctttgggtaatatggacactttaacaatattcttccaatctatgaatatggaatattctttcattttttgtctcctcttcagtttcttgaatcagtgttctagttttcattgtatatgtttcacttctctggttaattcttagatatttaattttatttataactattgtaaatgagattactttcttgatttttttttcaaattctatactgttggcatgtagaaatgtagaaatgctacagatttttgcctgttgattttgtttcctgcaactctactgaatgtatcagttctaatggtgttttggtggagtcttggatttctccaaatataagattatattatctgcaaacaagtataatttgaattctttctttccaattttgaagcactttatttctttatcttgtctgattgctttagctgggacttccagcactatgttgaataacagtggtggcagtgggcatctgtgtcatattctagatctttgagaaaaagctttcagttgttcctcatttagtatactactagctgtgagtctgttgtatatggctttaatatgttgaggtatgttccttctattcccagtttttttaagatttttgtcatgaagagatgttgaattttatcaaatactttttcagcatcaattgaaatgatcatatggtttttttccttcattctgttggtaaaatgcattgcatcgattgatttgcatatgttaaaccatccttgcatccttgggataaatcccacttggtcatgatgagtcatctttgtaatgtattgttgaatttggtttgctagtattttattgaggatttttgcatcagtgttcatcaggaatattagcctgtagttttctttctttctttctttcttttttttttttttttttttttgatgtgtctttgtttcgtttaggtatcatggttaacagtggactcatataatgggttcggaaaaattccctcctcccctatttcttgggatagttttagagggattggtattaggtcttctttaaatgtttggtaacattcagcagtgaagccatcagttcctggcttttctttgctgggagagtttttattatggctttgacctcattacttactattggtctgttcaggttttggatttctttatgggttaatcttggtaggttgtatgtatctaggaacttatccatttcttctaagtttttgaatgtattggcatatagttgttcatagtatcctgtaataatccttttaatttctgtggtattagttgaaataactcttttttcatccctgattttatttatttgggtcttctctcttttttcacagtctggtttaaagtttgttaacttcgtttatctttcaaaaaccaactttttgtttcattaatcttttgtatttttttcctttcaatttcatttatttcttctatgatctttattatttattttattattctaactttgggtttggtttgctcttttgtagttctttaagatacatcatgaggttgtttatgtgtagtttttcttttttgatgtaggcacttatagctataaactttcctcttagtactgttttcactatattccatacattttggtaagtttagtttcaattatcctttgtttcaagaaatttttcaatttccttcttaatcacttccttgacccactgatcattcaggagcatattgtttaatttccatgtgtttgtatagtttccaatattcttcttgttattgaattgtagttttattccattgtgttcagataagatgcttaatattatttcaactttttgaatgtcttaagacttgttttgtgacctaatatatggtctatccttgagaatgatccatatgctgatgaaagaatgtgtattctgcagctgttgcatgaaaagttctgttaatatctgttaggtccatttgttctatagtatggattatcaaatgtttctttgttgattttctgtctgggagatctctctagtgctcaaagtgaggcattgaagtctctagctatttttatattggagtctatctttttatctctaataatatttactttatatagctgggtgctttggtgttgggtgcatatatatcatcatactgaattgatccctttatcattatatgatgactttctttgtcttttcttatggtttttttatgaaatctattagtctggtttctgtcggcatggaataactttttccatccctttattttcttcttatgtgtatctttataggtaaagtgtgtttcttataggcaacagattactgggtcttattttctcatcaatttagccactctatgtcttttaattggagagtttagtccatttatatttaatgttattaatgacctactctggccattttgttttttgttgtctagttgtttcatgtttttctcttctttccttcctctcttccttttattgaaggtgattttctatggtgatttgttttaatttcttgcatcttattttttgtgtactcattgtatgtttttagatttgaggttaccatgaggcttgaaaatatctgataatctattattttaaactaatgacaacttgacactctttgcataaataaactaacaaaaagaaaacttgtataagttctacatatactatgtcttgaaaagttattgtagttattatttttgattagttcatttttctgtttttctacttaacatatgagtaatctacacaccacaattacaatgtgataatattctgtgttttcctgattctttactattaccagtgacctttgtatcttcagatgatttcttattgctcattaacacatttctttctgattgaatgactccctttagcatttcttgtaggacaggtctggtgttgaaattccagagcttttctttgtctgggaaagtctttatttttccttcatgtttggaagggcctggctatactattctaggatattttttttttccttcagcactttaaatatgtcatgccattctcttggtcagtgaggtttccactgaaaagtctgctgccagaggtattggagctccattgcatattatttgtttcttttctcttgctgcttttaggatcttctctttatccttgatctttggaagtttgactattaaatgcactgaggtagtcttctttgggttaaatctccttggtgttgtataactttcttgttcttgaatattggtatttctctctagatttgagaagttcattgttattacccttttgaataaattttctaccccgtctctctctttctctctactacctcttttttaaagccagtgacttagatttgcccttttgagcctattttctaggtcttgtaggtgtgcttattcttttttattctttcttcttttgtctcctctgactgatgttttcaaatagcctgtctttaggctcactaatgctttcttctgttttatccattctgctattaagagactctgatgcattctttcgtatgtcagttgcatttttcaactccagaatttcttcttgatttttctttattatttcaatttctttgttaaatgtatttgataggattctgaattactttctgtgttattttaaatttcttgagtttcatcacaactattttgaattctctttctgaaagaccacatatctctgtctctctgggattgttccatggtgctgtatttagttcctttggtgaggttatgtttttctggattgtcctgatgcttgtggatatacttcagtgtctgggcattgaagagttaggtatttattatcgttttcacagtctgggttggtttgtacctgtccttgttcagaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccaggtagagactcttgttccctttgcttactttctcctgaatagagtccctctctctgtgctgagctgtccacagctggaggatgggtgacacaatcacccctgtggctaccaccactgagactgcactggcttaaacctaaagccagcatagtactggttctcacccaaggcccactgtaaccactacctggctaatgcctacattcagcaaggccctgggctctaacaatcagcagatagcaaagccagccaaattcgcatccttcccttaagagaaacaagttctcctgggctctaactgggtccagagttgctgtctgggagccagggcctagagtcagaaaccttagaaatttccctgaaaccgtaagacaaagttcttcccacttttttcttttgtgaccccagaaagatgagctggtgtcatccaccaccagctcaggcccacagggagtaccaccagggcattgccaatgtgcacataaggctcaagtgtctcatcggtaagcctgtggtgaatgctgctaggcctaggactcgctcttcagggatgtgggctccctgttgcccctggtaggcccagaaaagccatctaagagtcaaggcctgaaattaaggaccctcagagcccacttggtgcccttccccactatggccaagcaagtacctaaggtgtaagtcaaagtcccctttactcttccctctgcttttctcaaacagaaagaatctttctttctagccaccacagctgtgaatgtgctggatcacacctgaaggcagtgcatctcagaatctcacccaagtcccacagtgcatactacttaattactgctgctgaatatttagggcccagggactatttcatcagtaggtaatgaatccttcaaggaccgggtccttcccttcaaggcagcaggttcccttctggcccaagatgtatctagaaatgtcatgcaggaatgacggcctagaataagggcctcatgactttacccagtgcattatcctactgcggctgagatggtatccaagttgcaaaacaatgtcccctttactcttccttctcctctcatgaagtggaaggaaggggtctcttttggagctgtgagctgcactgtctggggttgtaggaggggtggcacaaggactctcttagccaccatggcttgtgtctttactaggtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacaggtactgtaatttcccacctgatttttggttcttataaaggtggtttttttgtgtagttagttgttaaatttggtgttcctgcaggaaggataattggtagaggtttctatttggccatcttgctctgcctttctccagtaagttgttcttttattagtaaattattattttcatgtaaaatgtgtaattcattgtgaaaaattatgagttaatttttgtcttctattttggttccacatttacaccaactacttgacattatcctgtattggattttgctcagtactccctgaatctcatttacttctttcgaaggcccactttcagtccttttccatcacaaatttcccaaatctgaattcttttatgattcctattttgttgactgacaaatatttttatgcatttgtctttcgggacatttgtattataagtgctgtgttttctgaggttttgaatagcttatgacctatacatatcaatgatatatggtagaataagggtctgatttataactctttctcaaaattccttagttgttgctttattttattttaatttattgttgaaaagtgaaacatgactttttttttttttttttttttttgagatggagtcttgctctgtcccccaggttggagtgcagtggcccaatctcagctcactgcaaccttagcctcctgagttcaagcgattctcctgcctcagcctcccgagtagctgggattacaagcactcaccactgcatccagctgatttttgtatttttagtagagacggggtttcaccatcttggccaggctggtctcgaactcctgacctcgtgatccacccacctcggcctcccaaagtgctgggattacaggcatgagccaccacacccggctgaaccatgactttttatctttgattgcagctgatatttctccctgccaaaatgcttttcaattcataattcaggtgtttttttttttttaacctcatattttcagaggattcctttcttacatttgtgtcaaattagatgaagtcctgttaactaacattcaaagttcttcatggttgtcgttgttgtgttggtagtttttgttttattttacattcatttgtttgcttgtttgtattcagctcaggaaaattttcttcatttgtgtcatggattttcatttgtcttcaattctgcatgttcgtttttacaaaagttataacactaaagcctgcaaatccccttcccttatctccttgaactgtctcttcatcctaggagagcttatgtatgccacatcacctgtttggtattgtaatcataaatgacatttagcattttaaaactttacaatattaattaatttaatcctcttaatcatatgttgaatatgtgatgattcttaccccattttataaacagagacataaccaggttttataatttgctcactataatgtgactagtaagagaaaacgcagtcttgctccaaaccccatgctgttgaacactgggctatattgcctctgaaaaggaaatttttgcttttaattctctttatttttttaattttttatttttttgagcactcactctgtcacccaggatggagtgcagtggcacaatcttggctcactgcaacctccttccccccgggttcaagtggttctcctgcctcagcctcgtgagtagctgggattacaggcacttgccacggcgcctggctaatttttgtatttttagtagagatggggtttcatcatcttggccaggctgatcttgaactcctgacctcgtgatccacctcccctgtcctcccaaagtgctgggattacaggcatgagccaccatgcctggcacttttaattcttgttggggctcagaacacgataccccgaagtatggcaccttggcatgctgaatactttgaactgaaggacatcagaaggctttggaatcaatgtctttctgactttctcccgtcttcctgtctctcatccctctttctcccctgaagcaagtgacaaaaacctgaattcctccttctcactatgggtcatagaaagtacagtccctctccctcaaaggaagacataaaacctagaaaggtcactctcttccttctcccttcttccttgaagacctttattccagaggagtccagccctatacctaggagagaggaatcctacacagagaggccaagaagaattggaacagacagtccttgctaggttttcccctcagtctattaccaagagatcaaactattttgtccaatcacatttttacacaactgtccattcttcatcaacctaagcttaaagatagacagttttctttgggcctttggatcttcatttctgaaggccctcacgtatgtaaatcttcgattaaataaatttgccatgcttttctcttggtcacctgacttttaagagagtcagcatgaccaagtgataggcgaggaaaggtatcaaaccattccacctctacactatctctacactatctacaatgcaaattttaattctgctatgaaatttgtatatatgtttcatataatactttttgattcaaatttcctttgaatttcagtcttcaattactgtgctgccttctctttttcatatcgctgtgttcttccttcattttaattattctttctggaaaccacacttttaatatatttttgtatcctaagcattattctaatttctataatatattctcctggctctgtcctccagatattatccttcctcgcttcaaatactgttttctttgtcttgtagactgtaaatgctattgttgcagcaggtgttttctctctgctcattttcaaatgagtagagatccaccagactgtttcctaacatatatagtgtatgaattgtattaaccctggtataaccatattttatacctacaagtggagagcagaggcatgaggcatgtgtgtgaatgtgtgtgtatgtatgtatgtatctatgtatgtgtgtgtgtatatatatatattatatatatattatatataataatatatatattatatataatatatatattatatataatatatataatatatatattatatataatatatataatatatataatatatataatatatatataatatatatattatatatatataaaatctccttgacctaacttgttcagatgtcattttatgtgctcctgttgcactgagataggatcttctacccacgtggctatttctcagaaatgtaaactgatagaccacgtaaaacaaactattttcttttttttccaacttaaatgctcttacttctatatacatctcccatgataaatgtatcacagccatttcctctgtctcttcatagtaattcagacccattagttatatggggaagaaaaggcaataccttttcctctcccatcacagggtcatggcagacactcataacaaaagacagatgatatggtttggctgtgtctgcacccaaatctcaacttgaattttatctcccagaattcccacgtgttgtggaaggggcccagggagaggaaatcgaatcgtgggggctggtccttcctgtgctattcttgtggtagtgaataagtctcatgagctctgatgggtctatcaggggtttctgcttttgcttcttccttgttttctcttgccactgccacgtagaaagtgcctttcaccttccaccatgactctgaggcctccccagccatgtgcagctgtaagtccaattaaacctctttttcttcccattctcaggtatgtccttatcagcagaattaaaacagactaatacaacagtttagcaggagaaaagcataaaaattttatttagcaaagctctacatgacatgggagccttcagaaatgaaaatatgtagacccagggaaaatggtgtgtttttatgctaagtctgatgaaaaaagtagatagttgtgaagaagtggattaaacaaagagggtatgatctaatagtattaaactaagtggagtttagcaagctcagattcttcttatcctgtgtagcatttcttcctccctggtatgggccaagacccatctggaatgaggattgtatgactcactttcaggacagatgagtaagagagtgacctttctaggttttatggcttgctttgtgggaggggagttctagtttctatgattcccctcaggagagaggaattctggggtctatgacatatcttttgggagaaaatgaagtggaaagaggtcagagaaaccttgcttcttaggccctctcaatatcatgtaccgtactttggggtatcattttctgagtcctgacatttacagaatctgaagtaatgcagaaaaaattgttatttaaataacaaaggaatcatattctgtttgccttcagaaatagtaccctttcagaggaagaaggactgatagcttttgtcatctgtttctattcttgtggggttgggcagattaaaatatcttcccagattctttcggtcctaggttcttttattgggtaacattttaggttgcaaaatatatttgaactctatcccagtttcctgatctctggttgtaggttactgttagatttacaatagaatatttgggggagtttctttttctttactttgatagacattttagtgggaaatttaggaaacccaagtccaaagaaattttatcaacacacagacacaaagcttagagattttacataacttgctgcaagtcctaatgctgaaccaagattggaatctagaaatgtctgattctagtgccaggctgtctcctctcttgtatccatgttcgttatgccatttatagcctaaatatcattttcctttttgaaaaacagagttccatgtaagttacagagaattatctttgttttataatctaatataataaatgttaaatcacaatcccacactgcgagcttgtctcataattattctttttgagtggaatagagcttcaagaattgcacaaactactcaaccattgcttttgaatctaataacacttattgtgaactttatgccctggtcacatttctctagaatccatgctaacacattatggtctccctggttggatgtcctgtgtttaatctccctccttctaaggtttcattgtgtactataatcttttttcctatttgtcaagtgattacataatgaaaataatcccaatgggagatttatgctctaaaattttaacctccataattatataataatatgtactgatttggcatgttaatattgtacattctcactggaaaaatactctccaatttggagtttatagaataacaacccataactatgtgaatagttttccagttttcatattttccaatttgtactttattttaatatcaaaaggttatgatttcttattaaaagcagagtaagaatggaagtttgggcatgtatgtgacattttgacagattccattattctgtggtttaaataaaggaaattgaacctatacccatgtttactaaattctttgaaagtaactgtttgtatatgttgataagtggtttctttatatgagacaaattcagtggaaattgagttacccagtgataacattatctgttacctgtcactaaccgtatctagaagcttgagtggacacaatcaactggtaatactaattttatctctaataaccaattcaaactaaaaacttaaggaattttcattattcgcccccccccccatttcctatgtctgagagaataaaaacagttttgtggatatcagatgttataattacttcttataattttttttcctttagaggaatatccaggaatatgttaaactaaaaggaaaagtaaattttacaaagttttaaactaaatacatgagaaatatgctttagtggaaatttttagttctattgtctaagagaggtattgacaaattttcaattaatattttttatcaaactcaactatcaaaaacattgctgttattattttgcatttgcattggttgttatgatgctttagggttactttttattagtcttttatggtggcaaacagctatccaaatgctctttataaaatttttctttgccttttagcaaccctgatttttttaatgagacctttttccaaatcttaatacttttttattttttatttttttatttttttagatagtcttgctcttgttgcccaggctggagtgcaacgatgagatcttggctcctgcaacctctgcctcccaggttcaagcaattctcctgcctcagcacccactgagtagctaggattgcaggcatgtaccaatacacctggctaatttttgtattttcagtagagatggggttttgccatgttggccaggctggtctcaaactcctgacctcaggtgatcccccggtctcagcctcccaaagtgttgggattacaggcatgagccaccaggcccagcccaaatcttagtatctttatgcctccaacagtgccttctctctctctctctctcataaaaataaaacaaaacaaacatgcattgtttctctgggtcagcttcagggacatccctgctatctttgaatttatcagagactcctcattttaattccgcctgctcttgttgccaccatcaattcttttcttttatcatcctgaagattcctagtggcttccctcttttatgaataccatattataggaatgaaccatgaaatatatttatgtatccatataatactcctgtctttctggaggatcaccatgccagataatggttcagtgatgtgctagggcactaaataggagaaaattagaatctatttactatataggccttataccaagtataaaaggaattctttttgttatgtcccaacacatgttaaaagaaacatcatttacagcctgacaacctctatgctcttcataaatgaaaattacaaatgactcccaattatgccaaatggtccttgtgctatgcaagaatcacttttaaacatgcaaaagtcacttttaactcccagaatattttatacaattttaaaatgtattctttcttacagccccggtaaaatgttgctattttgcaactaagacatcgggctattttcatagcagtttaaattaccagcattttattttgcatttttgctgaaggtaaaaaagaatattgtattaggcagaataatgcaccccagcaaatgtccatgccccaaaacccggaatccataaatatgttaccttatatagcaaaaggcacttggtagatgcgattaagttgggaatattaagataaggaggttttcctggattatctgagtaaacccaatgtaatcacaagagtccatataagagaaagagagaggtagacgagtctaggaggtgtgatggcagaagcagggccagagccagagagaaactggaagaagatgctatgccactggctttgaagatgaaggaagggaccatgagccaagaaatgtagttcagaataattaagatgccaaagaggcatattttagggtgaaatattcctgtctccaacgtcatattttggggtggtatgtcctgagcctcatcagtgttttgctgccgttcttacggttgtaagatgtggtactgcatttctaggcatcatattcatgatcagcaaaggaaaaaaaaaagaaagagacaaatgacaaaaataaaaggccaaagagttttgtccttatctctgatttctttttttttgagacagagcctcagtctgttgcccaggctgcagtgcagtggtgtaatcttgactcaccgcaacctctgcctcctgggttcaagcgattctcctgcctcagcttcccaagtagctgggattataggcatgcgccaccactcccagctatttttttgtatttttagtagagacagggtttcaccatgttggccaggctggtcctgaactcctgacctcaggtaatccatccgcctcggccttccaaagtgctgggattacaggcgtgagccactgcgctgggccatctctgactttatatgcaggaaagaatgtacttccccaaaattgtagcctatacctcattgagcagaactctgtcacatcaagagacaaagttataacagatttaaagatcttaattagcttttatttatgattctagaattgggcaatacctttttctataaaataggatgaatgttccgatgaggtgatcagaggttttatagacagagaagactgaggaaagcagaaacagagcacaagaagctgattggctgtttcaaaattactttccttgtaaaggttaaagcaaaggaaattttcttatgccagctacaacaggctcatttgggggattggctattatctctcgctttcctgattttttgaaagatcagataacccacttagttttggcttggcaacatggaacagaagcatgaataactccattgtggtttgatcagttgcacctagtgtagaagctcagtccaaaccactgccctcttataaattttatttaacagtcacgtggttaccgttaccgtcaagacaatatagaaaggtgttttagctttccaaggtttgtcatagaaaaaaataaaggaagtgagattgtagatgattggaaaagccaatcctcagagactgtgaactacacatttaaatgcatgatttctgtaagatggatttgttaactcttttgtaaatatcaccattcttcaactgtcaatactatttaaaatattgagctgctgagtgcttctatgcagacagttatagtggaggatcaccacacttattaattattaattattagttgaatcttttgctctttgtattctttgattcaaaagaaaatacttgcattgtagaattttaatgaagttattaaaaatgtattttttcctctctacatatatgagaaaacatttttttatgattttttccatctcttccaaaaataccatgttagaatcacaaataaatcctatgaaactgtctaccatatcaatagactttccttatcacaagatcttaggagtgactgatttaaaataagtgatccttattatataggctaatcaagttgcaaactttgaaaacattttgagaagtctctcacatatattatgtagccaaaaacaacaattctaaaatgacatttttttttaaattatggaatgatagttttcttaaaagtgaacatatttcacagcctggaatgtgacattattgttgtacagcagtaaagttgacatgtacagtatgcagcatgcatactaccatgtaacccattgatgaaatttcagggtttttattatgctacagtacaatcctatagtggggaattactcacattttcatgagctaccgtttaaaataactttttgaaatgagatttatgacttcctgctaacagctgtagaaaggagatgaggagggggaaataaggggaaggctcttcctattacgaaaagaagaaacattaaaaaggtaggaaaagaacatttatattggcattctctggaaagagaaagccatgtgctcagcaagctttcagcattccagctttataattactcttgaatatcctgagggcttctaaagcaggccatttctgaaaagcagatgtatactttttgccattgtttcaagtctggataatcttttcatacttggaaattaggaatgcatgttaaaatgttgataggaaataaagagaaggaatttgtatttttaatcgttgactttaataataaccatatataggccaaatctctattaacctactgaagaaaagaactgtggcaattacattgataattgagacaaaaccatccagaagacattatactgttcagttagctggataagaggcttgaaattgatgatgctttctcagaaggcactcagccactcaaaattgaatagaaactttccccctcccacaatctcagacaaactctgacattagtttcccttgctatagaaatcatttaaaaagcaaatgagaaataaacaaaatatttgttaaactttggaaaattaccttgaattttagaaagttcgatcactgctaaatagtttgggaagaaaaaaaaatcctttcaaggtagagtaaggtaaattccataactgtctacatcaacagttcaaatctggaggttgaaatgtgggagacgaccagttagagaaaagtaggaagggcttcttggaagaggtcatctttgagacaggatttctaaatctcaaaaagggctaggattggttagtgagatgggggtggcatgggtcttctggaggaacaacctgtcactaggtagtcctagtgacaatggaagcagaacaaggaagtggaaaattatagtgtgtgttagtgtccttgtttgtgaactggggagtaatgcagtttcgtggaagaatactggaaactaagaccataagctaaaataataagcattataaatgaataaagccatgctgaggcctaagcacattgtaggtctttaactatttctccacacacagcctctgctggtgtctgaaatagacttcatggctctggagaagttcatttactgtcaactaatttatttaggcatatagcatttctattcctgcaatacacacaaaggacatttgttgttattatagtgcttttttggtttttgttttttgattggtttcccttaaaaaaatgagagggggaaagaaagagtatgttcatttgtatgtcacaacccacccctaaaaaaatagtcatgagcatgagagtagtgggttggtgcaatgaacacatagaaagacttaagttggcaagatcattttttcacttggtacaaaaccagtggggcatgacataagggtagtttgtacatggtagtgccaggaaaataagggtttcatattcatgttagacccttggtctacttaattgcttttgcattttcctaatgcatcttaatgtcacttttttttccagaaaaattctctaacttagtagaatgagtaaaagaatcactttaagggaaatagagttaaaaattgaaagtcacttaactgtaacaataatttacatagcgttagcattgttcttttcatgcttataattttgacttacttgttgatgtattttaaaggtttcattatttttctggtttaagatagatttatattgttaggttaatgtagtacaattagcacctttgataattaaggacatatttgtaagtacagggaagtctttcttgtagaccaattatagctgtgtttatagtatcaaattatacatgcattattagaccttcaaaacccataataaatactgtatatcaatgttttggggcttacacctagtggcacaaatattaatataactaaaatctaagttatatgtataagaatttttttttctgaatctctacattctttaggatctacatttcccttaattgtaagaagcagaatattttaacggcaaaaatgagataggatatatctaggggttgaaatcttcctactaaatgatttttaaatttgtaactaagcatttatgttcatttccacagtcttgtgaaacaggtgtgcatcatgtaaaccttgttagggttgacaaaataggaaagcattataacacttcatatgatcaatgaattaagaattgtgtattttgaattttttttccaaaggcaaaattttctttcctgaattcacaaagcttttacaatctagatctttcacatagagaagcatctactggattagtaatacaggcaaggaactaaaaacttaagtctaataacatatcgtagcagatatattgtgcacttttatttgtatattttgaacataggttattttcttggcagtttcctcagaaaaatttggtgtttatcttctgttttattttcacggttttaacagtaagaaccaggagtagtaagaaatagaatgtgtatatgttttataaaaatttatatacatatatacaattcatatataagtagttgattctattggatataccttggcacttatataagtttactaagaagtgaatttttttaaaaaaataggaaatgattatattagatttaatttattttttgccaaactaacattttgtttgttttgttcatatcatcttaaactagttattgtggctatcagtgcattgaaaaatgaattactagtgtaatatgttcatctccttctgcatatgaattgtccttggatgtaagttttctgtatttccagagtcagctaaaagttaaaactaatttacctggaaaaactatgttttaggtgctattattatttttatcatttagagacaggatcctgctctgtcacccaggatggagtgtagtggcagcatcatagctcaatgtaacttccagctcctagactcaaacttcctcctgcctcagtctcctgagtggctaggctacaggcatatgccaccacactcagctaatattttcactttttgttttgtagaagcaaggtctcagtatgttgcccaggctggttttgaacacctatactcaaatgatcctcccactttggcttcccaaaatgctgattacactacttcccaaaaggattgcagaggtgagccaccgtgcctggcctttaggtgccattattgtagacatcttttttttttttaattatactttaagttttagggtacatgtgcacaatgtgcaggttagttacatatgtgccatgtgtaaaaagtaaaatcttaacttcttatatattttaagcaagtttattttttaaataagcagtaccagaggaatgctgatttttgtaatttaatgtttcatatagtttgagaaatggtctcatgaagccagtcatacagaaccgtacaatccacagtgactaatctatgcacttggttcatgttattcacaactttctacaatcctataaaagaagcagctaacccaaaagtacaagacacatcaggagctaccaaaaaataccaagatcaaatccagccccaagattatgaaagccatattattttagtctttcaaatgccagtgtttgtcttttttctcaagtttttctaatgcagagagtcaataaacacccttctaggccgggcgaggtggctcatgcctgtaatcccagcactttgggaggctgaagcgggtcgatcacctgaggccagaagtttgaaactggccttgccaacatggtgcaaacgcgtctctactaaaaatacaaaaattagctaggtgtggtggcgtgtgtctgtagttccagctacttgggaggctgaggcaggagaatctctagaacccaggaggcggaggttgcagtaagccgagatcatgccactgcactccagcctgggcgacagagtgagactccatctcaaaaaacaaacaaacaaaaagaaccccttcttttttggtcaagagctcactatgacctaagttaggattattgtcattatagtaatataatataaaacttataaaaattttaattatttaggaccatttgcaaaagctgtagattgtttatagttcagattggcaagtatgggtggcagtaatgttagaaataagaaagctaaaacctaaaggtcaaaaacctagttgccttctcattattgtcctcatgtcttcagattgtcagaggacagagggttagaaccaagaacactcagcttgcgtaaaggttttctacttcacttgacatttccagtaacttagcagcatgaccaatgaaacctgaagtaatgaatgggaaaagttagcggggaaggaatatccaacacaaaagttttatctcagcctaattaacattcagagatcagatggaaaagatggagtcaagaaggaggagaaaagttactgggaaaatatcataattggtaaaaagggactataattgatagaaaggaagaaaaacagtgatttcggttatctagcagactgaaggatgttaagcaaatgattagggaatttctaacaggtaacagatgattaggtcaataaattaattcatgtgtaatttgaaaaatataacatttcacataatattcataatattcaccatttttcagaaggcaaaattaaatacttcagattataaatctaacgacacagaaaagacattttatgttcttgttttttgatttacgaggacttggacttataatagtcaataaatgctaactgattattaataaggtgtagggtctaaggagcataaatttttttaaattagttttaaatattcatagttatagccagttttttactgtctttaccaatgaaaggaaacaatgtcataaagtaactatttttaatgtttttagtcattcgtctttatgtaacattactttttgaaattgatttgctttccaaattaaaggttgtcgtaggataatggtaaaattattttgcatacatagcaatacaaataaattggaaactgaggatatgatctaaaaatacactaagtggcagtgaagagtgaatctggaattcaacatttttcacaatgcatatgtaacatggtatatttggatgaaacattattcaaatgggcaatctcttctggctccattgtcttgtgactgtgattctaaatgctgtcatttctaaagtaacttaaatactttctcctgagaaaattgtcattaaaaacaagtgcatataatatctaataaaaagtttttatattattactattttgttttatatatctagtgttcttttttttttttttttgagacagagtctcgctctgttgcccaggctggagtgcagtggcacagtctcggctcactgcaacctccatctcctgggttcaaatgattctcctgcctcagcctcccgagtagctgggactgcaggcatccgctaccacgcccagctaatttttgtatttttagaggagacgaggtttcaccatgttggccaggatcgtctcggtatcttgacctcgtgatccaccctcttcggcctcccaaagtgctgggattacaggtgtgagccactgcaagcggcccttgttcttaatcgtaatgaacatgaacagtattaataagttcaaagcaatatgtacacgaagaatttcttctttcaacagcaataaatgggtaaaataagtacagaacaacttttatgatacagtgttataaaatgcatgtgtatcagttacctttcatcaccttaattctttgttaaaaacaaaaacaaaatgccataaaacctcagtggcacacaatagtaaggatttgaatgaagctcaggcatctgatacaatcagctgggccattctgctgtttgtagctgggctcaactggttggttattctcttcttaactgaactcactcagatgtgtggatcagctggtttggtttgaggtgaaaatcaggacatttttactctgctccatgtctctcaacctccatcagactgggacaggtagatatcttctcatgatgaaagtggggttggggtagcagtgggaaagggcaagcctaattatacaaatacttttcaagtctcttgagtgtgatacatttactagcatctcattggctagtgcaagtcacttatcagtcagataatttgagataaattcatgtgccttaattatttttataacttaaaacataccaacaatgatccaaaatattttttaaactactgtgatttttaagattgttgaaaattgttttgaaaattagtttcacatttatcttttagggaaaaagagtttaccattgataatccaaaaatctgataaaatcagttgaagcctgtttagaaagattgagaacttataagtacatacataagtataaattatatataatgtagtatattatatacatgtgtatgtatatatccctgctgaaattacctgccagtagtacctgaagaaactcctcttagaataagatgtattttaacatttcattgtaatggaagtagcttattttactcaccttttttgactacagtttttccgactcaattacagtgttcctgtgtggttcaaaaccaataaaaatgtcattagtaaaaccagtccatgtcataaaattgtattccatctagttaatttgacacaaaataatataattataaataaaataataatggagttatttttataggcaacattctaatacagtgagacccctttatcttatatttaaaatattagaagctataatttcatattccatgtaatatatgtcttttaatttaaatttaatttcctttgttactcactgctagactgtatctgttttctattgctgctataagaaatttgcaccaatttagtgacttaaacactaatttatcgcttcacagttatgtaggtcagaaatctgtgcaggctcaatggcttctgctgcttagaatctcagcaaaatcaaagggtcagcaggtctagtctcttatctggaggctatgaggtagagtgtgcttcccatctcgtccaggctgtgggcagacttcaggtttagtggttgtagaactgagcttcctgcttccttgctggctgtcaggtggagtacttgtcaatttccagaggacatcctgtttcatgactcttgccaacattccttcatcttcaaaataggctaggcagattaagtttcctcatgctttgagtctctctgacctaccctctgtctcatttaatttcccttgctcatagggactgctgtaattagactagacccacccctcaggataattttcctattttaagcatattcacaggttccagaggttttggcatggacattgtgttatgccattattgcactgctatgaagaaatacctgggtattttataaagaaaagaggtttaattggttcattcttctgcaggttttatgggaagcatcgtgctggcatctgttcagcttctgctgaaacctcagggagcttttaatcagggtggaaggcaaagaggggctggcatatcatatggcaaaagcaagagcaagagagaaagactgaaggagggaggtgtcacacactttgaaacaaccagatctcatgtgaactaagagggagagctcacttagcaccaaagggacggtccaagccattcctgatggacctagctccgtgatccaaacaccctacaccaggccccaccttcagtattgggattacatttcaacatgagatttgggtggggacaaatatccaaaccatttgattcttgtgcattcttatgcctacataagttaggtagtgagaggacaacaggatccaggcagagtttaaacaagcagattaaggagagagaaacactacagcaaacacggacctctccttgttactcttgcagtgagattctctctccttgataaggataacaaaatgttgtaatataaacaaatgacacacacacacacacacacacagacatataatacaaaaagtaactggaggcagtgccgtatgttatagaggaagctttgggtaattttgagaggggtatgtgctgcagacattcagcactgaaataaggcaagtaatttgagttatttattaaaggacaggtgattaagctgtgtgattgagagacttgggaatggtgcataccttttatttatttccctgaatttggtaaaactcagtgtagataataaattatgcaactgaatacctgtggagtcactcctgtttggcttgtaaaaatggaagctctacgtcttgtctggattgtagcaagttgctgtttagatgctccctctgtgctcttttcctacccacagtgagtagatgggagtcaatagattatctctttatttttgcttggtttcacgtgaattagaagaaaaaagatgtcagcagaatttaagatgcagagataactgcatggaagtaagagacatctgaagtggtgtcctactgcatcacagattatcaggactcatttcaggtctgttgcttggttttcttaatttgtcattgtttgaacccatttctggatactaagcttccttttttggatttatgtctcacagccttatatgttcattaattttcaccttggctgaattggccgcccaatccttccccttaaacatgtacttttcattccatttatccattgtagttatatctatctggttgccacccctgaattcaagttatttgtgttcatggagtaatttttaacaactttatcaaagcgtttttataatgccagtttatacccctgttcccttcgtcccatccctatatcctttctcccatctaatggaaactgatgcaagttatcgccccttgcagctcttcagcttccccttgccagcatctcaaattacatatagtgagtgccaaacccagacatttgatctattcctcttgttcacaacagtttctgcttgtggcctatgacgcaactgaaatatgataatagaaacttattcagtcttaggaatttttttagtgtagaaattgagactcagattgacatatatatataacttttgttaatttcaatatgtgcctcaaattccaaaccttatgggtttgtgttgctataaagcaatacctgagggtgggtaatttatgaagaaaaaaagatgtatttttctcacaattctggatggttggaaagttcaagattgtacatctgcatctggcgaggacctcaggctgctgtcactcttggcatagggtgacagagagccagcttatgcacagatcacacggcaggagatgaaacgagaaagagtggggaggtaccaggctctttttaagaactagcccatgcaggaactaatagagttagaactaacacatcaccgtgagaatggcaccacgacatccatgaaggatccacccccatggcccaaacacctcctacttaggccccacctcccgacaccaccaaactggggataaaatttcaacatgagatttgttggaaacaaaacatgtccaaaccatagcagtttattttgtgaaagtgctgaagtttgatgagtatacttcaatgataaaaaaattaatattggctttctaatttatttataaaatagatacaaaaaagtcattatttatatgtcattacaataatcacattggcttggtggtatctaataaattggagccacattgaagtgaattctatactatacctcagcatgtaaatttacctgaattttatgtcttcagttgtaattcttccagttatttctagactatatgtagtttatatttctagatattctcctagaaaagagatttttcatgttaaagtccttaccataaggaagtttgactgtcattccaaagaatctactctctgtcattaatataataaggagatatgaaatggaacattttacattcataacaacacaaaattcttataaattgctgaaacatgaaataaccaaataaactttattattgaaatgggtttctttagaacataaatgtgtaatgtatcttctcaaacttgttaaatcataaagaagtgcggtgatttagtaacatgaagcacagtatatataaaactatgtagcataaaatgttcagctgctaaggtagcaggaaggttccaggagatattttcataaatctggaagtagttcacctgtttcattgattgtcctcatttcatttacctaaatagtgggtcgtgattctcctgtctttggagtttacaaatttcctttagttgaatctgtgtgttttgaaatggtatttctttcacgtattagaaagttgaataactttgaagaaaatggaaatgacattgtgtggattgtcggaaaactagaaagatgtgatacctttctttataagggtcaggaccagcactactataacaaaggcatgttaataagagaaaagcaaaacaaatttgtttaatccaagttttacatgacacagaaaacttcaaaaatgaaaagctaaaatccagggaaaactgtctatgtttagatttgatgaagaatggacagtcgagtagaaatgtgattggacaaaaggctgtgctgtagtggtaataaactggaaggggaaacacagagaggcctgatggttcagattcttctggcctgcctgtatggcatttcttctttcgagtacagggcaggacctctctggaatgaaggtctttaaggaaaagaagagaaggttttatggcttgctttgtagcagatgggttctagtttctaagactcaccttcgagaagagaaattctgtttttttttttatgattttcttctgggtagaaaatgcgatgggagacaggagggcaagagaatgtgtgtcgatgaggtttggtcagtggtgacttaggaaacattattaggctgcttatttgcttatatgttgactttccataaatgatttttgagttgaatgttataaaatgtaaatctttatatttttattttcactttggattttttttctcataacataccagtctactaattttcaaggaacattcttattagtatatttaaaaggccaaaatagtattactcttatttaataattaatttaatcacagttagctaaaatttgactttatccaacctgaagacttttcctagagaagtgcttatattcataattaaactaaaattttagttcagaagtataaaatgttgctgtctaatttaagaataaaatacaagtttttagaaagttgtgtggaaagttttacattggacgagaaagaccaaagaattgatacgatgtttaaaaagatttgggttgaatctataaactaataatatgggccagcgtggtggctcacacctgtaatcccagcactttggcaggccgaggcagattatttgaggtcaggagttcgagaccagcctgaccaacatgatgaaaccccatctctactaaaatacaaaaatgaggcgtggtggcggtgggtgcctgtaatctcagctacttgagagtccgaggcaggagaatcactttaacccagtaggcggaggttgcagtgagccaagattgcgccactgcactccagcctgggtgacagagcgagactccctcttaaaataaaagtaaactgataatttggatgaatgttacaatgttctataacatgggtgaattttaatcgcagtaccattgagtatctattaggtctaagtcactacataaggcctttccctgcatttgagccagagtagatattccagtctcggctgcctcttaccttgccaatgattgggattagcactaccagccaggtggcaaggcatatacaatatgtataaggttggaagaacattgaacaagaaaagaaaactgaagctttagcttttatgactaccctctagggcattattaataagtccacaaactgtgaaaaaactgtaagaatgctccactctagtaaaaaatgaaaggacagtgctactttccagatcctaatgatgtaagtcctgctctgctttgaagaaaacctataatttcacaatatttaaaacttaaagtgctagggaagtattaagatttcatctttttcacatttacttagctgtcttctgaaaatgaataagatccactatcttattttgacagattttaaattattgtgttttgtatacacatttgttttgtgacttttattgcatttgcatttcaccttggcactttttaagtacacttaataaatatgttttaatgatgaggacaactgtgagttgacctttcctgaaggtagtggtgaaaataccaatatacaaaagcggcatctgccatgatgatgaggagccgtagtttaaatagatctgggttgctactgtactctccaagttagtgtcctagtttcttctcttgtttcttactttccattttccacagagcagctacagatatctttttaaaatatattaatcatatataattctcctacttaaaaccgtgaaatgatcttaggagaaatttagtcgtctttcttcagtctaaaagccctatatgactttggtactcgccttcctctcgctccctatccatcctcaacacagtcctccttgcttgttctcttcagtcacctcggctttccttctgtcccttgagtgcaccacctccttgcagccttagcacttttgcacttgcagtcacctgtgactgaaaccatctgcccttagaccatcctaaaggtacttcttgcttgtcattctggtctcagctaggaggtcatgttttcaatgtgggctcccctgaccacctcatcaaaaataacattctcccccaaattattatatcactttactacattttctttatagctgacttattttcttcagttattttgtgatctgttctcccctacacataagtaagtttcctgagggtgatgcctctgtattgcatgctacatcataggctataaacacatatttgctggaataataaaaaaattccatgtgaaagtactttatataaatgctaatgcacatcacgatataagatgcagttactagctaagcaacagtcagacaactcctttttatgtatttgttctggcaacctgaataaaagcatatgtaatctgtgagtgtgtattgtctttaaggacaggtaggtaagtggtcatctaatgttcacggggcacacattttgatacggatttattttccacccactgtgcatcttctgctgtggcaataattagagcctgtgaactgaagtgaaggaaacatttacaatgttgaataacctaaagggaagacaagggtatctaattagtctttcttgtgacaatctttttttggattaatattcttttcttttgaaaagtctaacagtggattcttatgtcactgactctactgataattaatagtgttcaccatacacctacacacactccctccaaaatatcctctcgtaatgccactactggaaagaacaatttcaattagaaaggagagcttttgaagtatatatcatgtggtctattataagaaatgtgtcctattataaacgaaaaaaatctctgccagaacataatattttatgtaacatgcctggtatattgtttaacaaaacattttatggatacttcattagggcatgacttgattaagaagcaggactagcattcacccacattgtcttttcttgaatctgtaagatgtgttcctgtacgattttcaccctacttataagcttattaacttaggaatgttgtgacagagcctttatttttgaatcttgtaattataattaatagtaagttaaagggaagtagaaagcttatattcaaagtttgaagtaaaatgactttgtggcacttagggcaggtgccaggaagaaattaagcaaaagcttattattcttatttattagaactttgggatgacatctttgaggatgatagtcattttatggttacaagagggagacctatttgtggacaaagcttgaggaggggtatcctgctatcttcagctccgcatgcccagggtctaaaatgagcttttcccccaagattagcaactactttgtgctagttgcatatgtgcaagtaaggataggagtgaatgtgtacatactctccactacttccctcagtgtgttcctgaaatccctatcatgaaagaaacaaccacaaaatttccttatattaacttgtgaaagtgttatttatgatggctacatttttgccagagagtgacttaacatcatataaaacacagtaatgtacgatgtttatcaaaactaagagaaaacatcgtttaattgtaaatatctacagttttaagtagggaatgtcctacccatggtctttaaaagaaaaaagtatgaatgatagatgttaactatatgaagggccaaattacaaggaagttcaataatgttgaataatagtaataatagttgacatttgtggaaagctgacaaatgttcagataattgttctaagtactttacatatatcaacttattttatactcaaatgccctgatggatcagtatttttaccctgttttcacaaataaaaaagctgggctgtacaacataatcagctagtaattaagttgtgggccattcttcaaatctaggcaggcaggccccagataccctgtctctctgtgctgtgacaatgttcactaaattttcactatgtgtctagcaccattctaagtcctgtacaagtattaactttaaaaattcccataataagcttatgtgatcaatcctacagtagtcccatttcttcaggtgaggtacctgacaaaattcttgataaggaatttatccaagaatgtctagctagctaacactggaacaagaattcaaactcacatcttacttcagagccaacacttttaaacattagtctaccccatgtcatgcaaatgtttagggatcagcaaactatggcccacaggccaaacctagcccacaaactggttttgtaactaaagttttgttggaacacatccttaatcattcgtttatgttttgtctatgtctgctttcatgctacaagagcagagctgaaaagttacaacagataacatatggcccatagcctaaattatttactctctggtccttttcagaaaacgtttgccaacctctgctttagaccatgagtgtttctttagcaattatctttgcttgatccatcccaccaccaccctgaatctagacaattttcagaaaatagcaagtgacaatagttttaactttttacacatggttagaaaatgacaaaaaagaccagttctttagaaacttcaaaatgcatctgaataagtaccctagacacacataaaacaacattctctgctcttgctttcatctaaaaaaggaaaagtcaacagaggtgttgagctaactctacttaaagatatggacttgagacagttcactcaagttcatgtattctggctttaccacttcctagctttgtgacctcgggtggatcacttaacctctatgtatcccagttcctccacctggaaaaatggggatagtggtaaacgtaactcataggagaacaggaatatctcattttatcgcatttcactttgttgcatttcatagttactactttttttttctaactgaagtgtattggttaatatgctgttataaagacatacctgagactgggaaatttatgaagaaaagagatttaattgtctcacagttctgcatggctggggagaccgcaggaaattcacaatcatggcagaaggcaccccttcacagggcatcaggagagggaatgagagcagagtggagggggaagccccatatgaaaccatcagatctcataagaactcacttactgtcatcagaacaacatgggggaaaccacccccaggattcaattttctccacctggtcctgcccttgacatgtggggattattataattcaaggtgagatttgggtgggtacacagagccaaaccatatcattttactcctggtccctcccaaatctcataacctcaaatttcaaaacacaatcatgtccttcccagtcccccaaagtctcaactcatttcatcattaactcaaaagtccaagtccaaattctcgtctgagacaagttccttctgcctatgagcctgtaaaatcaaaagcaagttagttacttcctagacacactggggatacaggcagttggtaaatatacccattccaaatgggagaaattggccaaaacaaaggggctacaggtgccagacaagtccaaaatccagtagggcagtcattaaacgttaaaattccaaaatgttctctttgactccatgtctcacatccaggtcacattgatgcaagaggtggactcccatagccttgggcagctccacccctgtggctttgcaggatacagccccctcccagctgctttcatgggtattgagtgtctgtagcttttccaggtgcacagtgcaagctgtcagtaaacctaccattctggggtctgaaggacagtggccctcttcttacagctccgttaggcaatgccccagttgggactgtttgtgggggctccaaacccacatttcccttccacactgctctagcagaggttctccatgaggaagccaccctacagcagacttctgcctggacatccaggcatgtctatacatcttcggaaaccttggcagaggttcccaaacctcaattcttgacttctgatcccccacaggcccaacacatgtaagctgccaatgtttgggccttgcaccctctgaagcaaaggcctgagctgtatgtttgcccctgttagtcattgctgggatgcagggcaccgagtcccaagactgcacaaagcagcaagtacctgggcctggctcatgaaaccattttttcattttaagttttgaggaaagaagctatctccataacataaaagtatggtgaagcaacaagtgctgaagtagaagctataacgagttatccagaagacatagctaagataatgaatgaaggtggctaaactaaaaaatcatcagcataggatgggtggctcacacctgtaatcccagcactttgggaggccaaggaggatgggtcacctaaagtcaggaattagagaccagcctggccaacatggcgaaaccctatctctatcaaaaatacaaaaactagccaggcatggtggcgggcgcctgaaatcccagctactcaggaggctgaagctggaaaattgcttgaacccgggaggcggaggttgcagtgagccgagatcactccactgaactccagcctgggtgacagagagagactgcatctcaaaaaaaattattcagcataaacagccctttattggaagaacatattatttaaaactcttaaatctagagaggtaaagtcaatgcttggcttcaacaactccacctgacaggctgactttcttgttaggggctaatgcagctggtaactttaagttgaagccaatgctcattgaccatgttgaaaatcctaggatctttaagattatgctaaatctattttgcctatgatttataaatgtaacaacaaagcctagatgacagcccatctgtttacaacatggtttaatgaatattctaagcccacctttgagacctactgttcagaaaaaaaaatgattctttacaaaatattacttcccatttaaaattcacctggtcactcaagaactgtgatgaagatgtacaaggagacaaatgttattttcatgcctgctgacagaacatcaattctgcttcccgtgggtcaatgagtaatttcaactttcaattcttattttttaaaaactatattttgtaaggctatagctgccatagacagtgattcctctgatggatctgggcaaagtaaactgaaaaccttctggaaagagactttcatgatttataggaagagatcaaaatataaacattaacagaagtttgaaagaagttgatgcaaactctcatggatgactttgagaggttcaagacttccctggaggaagtcacatcagatgtgatagaaatagcaaaagaaccataattagaagtgcatcctgaaaatgcgattcaattgctacaattttatgataaaacttgaatggataaagagttgcttcttattgatgagcaaagaaagtagtttcttgggatggaatctactcctgggtgaagatgctgtgaacattgttgaaataacaatgaaggatttaaaatatttcataaacatatttgataaagatgtttgagagggttgactccaattttgaaagaagttccactgtgggtaaaatgctatcaaacaatatcacatgccacagagaaatctttttgaaatgaaaagtacatcaatgtggcaaacttcattgttgtcttattttcagaatttgctacaaccatctagccttcaggaaccacaactctgattggtcagcagccatcaacatcaaggcaagaccctccaccagcagaaagattatgactggatgaatgttaagatcagccccattttttagcaataaagtattttttcattgtcagtttagacataatactattatatacttaatatactatagtatagggtaaacataacttttatatgtactgggaaaccaaaaagtttatatgatttgctttattgtgatattcactttgttgagattgtctgaaaccaagattgcctgatacctggagtatctccaaggtatgcctgtattatagccattgaatgaatttatgtatgcaatgttgggaagaggaactgaatcctataaagtattagttattactcctattcttcagcttcttcaaaagactgattcagaggtaaacagaatggtcgaaggtgagccctaagtataactgggtaaatttttaatgaatgaaaagcctgtggaatcaatgattattaagtattgttctacatttatttttagagacctctatgaaaataaaaaataaaaagtccgccaggtgcagtggctcacgcctgtaatcccagcactttgggaggccgaggtgggcggatcatgaggtcaaaagtttgagaccagcctgataaacatggtgaaattccatctgtactaaaaatacaaacattagccagacatggtggcacgcacctgtaatcccagctactcaagaggctaaggcaggataattgcttgaacttgggagggggaggttgtagtgagccgagatcacaccactgctctccagtctgggcaacagagcgacactccgtctcaaaaaaaaaaaaaaaaaaaaaaaaaaaaaaaaaaaaaactcaatgtcctctgacaacttgatgtataataccggacttctactattagcacaagaaaatgaattaaagatcttaaagatcttggtaagtgcagcatgtacatctgcacaaaaacttatgtagacagattgtgggagaggctctcctcccttggtttctctggcagtaccagagcatattaactgtaaagaacaggttcttctaacccctctaacactattgtgtctggtggtacccagctctgatacaatacactggcaatttctaaattggttctttacctcagggcttaataatgactaaatgacttaagcatttactgggaatgataatagttacatccaagctctgtaacaggaattattgatatttatagtacacatagaaataataaatgattgaagattcatactaagctggagtagctaaaattatgagtcttaaagccaagccatcctgggttcaaagttggcttccgttcactaccaaatgtaagcttgggcaatttatgtggtatctctactaactctgtttacaatggcataaaataataatactgatagtaccaacatcagtcactaagtcatgtatttgatgaatgtttattgaatagctactatgtgccagctactattggggttgagcatacagcaaataatacagatatgaaccccagctcttttgagctttcatttcacttgtgagaactaagcatttagtaccaggtatggggcacattaaattttcaaacaatgttaaatatcattaccattagttgatgatgatgatgatgatgatgatgacagttatgtctcattatggagttgagaataacacaatttctgtacgtgggaaatatttctggtccatagcccttaaactgcttccctcccacaggagtgatttgaactgagatttggaactcctccctgggggtctttatcgctatgtcccagtatttgctgatgcacttattccataataattcaaaaccaggtatttattaatatattatcaaagcattaaattcctttctatatatgctgaaaatatttctattcagctaaagaacattgtatgccttgctgaaatgtgtgtagaattacccacaaaagtcatttacagatatatatatatatatatatatgtgtgtgtgtgtatatctataaatagacagatatttatacatatataaatatatgtgtgtatatctatatatttatagatatatgtatatatatacagatatatctatctatatatatatatacacacatatgtgtgtgtacatgtatgtatctatgccagtgttagaaaaggaatatatggacaaatcagagtgtgattaggaggatcagttcatgtggaataggagtccaagttgtttaaggtgtcacagaggaggccacatagtggaggggatgagaagagtcagaaaaaagtacttccaaatctgattagctatcagtgggtttgtatttatatttttgccttaacttctacaaataattcctctcacaaaagtcattttggaaacttatctttcaaagttcgtaaaaacatcaatgattttagttatcttcacttaaagagggtaatttatcatctggtcaagggtgcatgtgtctgccaggaaagctgtgagccaacatacatcatactcagtagcttcaaggattcagtttgccttcttgtgtgtatttgaatacagaattcattttaatctgacattttttacctctcatcatatttttcttctaattaagttctataaatgtatcttctatccggtttgagctgtaataaattctttacttgaattggccttctgaaagtcacaaaccaacattatgatgaattgcaaaatgaataatttcccttccactgtgtttattttgagcagcaaaatgctggagaaaaatgaaacaatgtttcactagaaagaaggccatgcccatagtggttacatggctttgacctgaatgctgctaatgctgaagccagtagattcccaaaactgtgtaggtctaatttaaaaataatttttcagttgataattttagagtttaatgatattaatgtaagatataaataatgagaaatgttttgctctcatataagcctggagttagctagccatgttggtgtggactagagccatggtttctttgggaaatgtgtttcttaaaatccatattgcagaagaaaagaacaaggccatttatagaatagactaagggaaaaatgaacatgtgatcgctgttttttaaatcatcatatgtcttaccgcaccacattggcaagtaaatgtattattgtctttgaatttagatggccaaattgaaattgaacaatttgttactaatatttaggttggaattttaataggtgcttaacattggacacatctgttcccattacattgtaaggcatagatgaaactttatacaaataagattaaagcattgccatagctaaaatatcaggcattaaccttgtagacttttgattttaaaatagttgagctccagtattaaaatagccacagtgatcagagtccagttcaaataatagtgcttaatgtgttaatcattaatcttacatacttctttctcatttccctctatgcctttatagagtgggaattgccttatatcttgaattcattactgtaatttgtgtactgtgcattgactgaagccaatttaagtggtaatgtaggatagaattttagttccttcactttgtgtagatagtgggccatggagttaatgtttcatttatagtatttattacagaactatgataatgtggttatgattcatgatcttttcctggataatggctgatttaagacatattatagtttgaaaacaatgttgatgttctatagtaaccatgaccactggtccaaatatcccaacataaaaataccattggcataatttttcttcccttaaagaaaaaccataattactcttttcaaaccagaattagatatgcacaatcacctaaaccaactactttgtcttgcaaatgaggaatccgagatccagtgaagctgactagattgatggagatcagaaagctactagtgttagagctatagcagggatgcagaacctgcttcctcttattttggggccagtactctcaaaactatcctgccttgctaaaatcggataatcactgccatttcatttattcatattctgaaaacatttgctattatctccccataactcttttttctttctcctcgcgcagtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccaggtcagtgcacaggacccctagaaatagcctaatctctctaggaatgtgctcctttactctgtctgctcactctgctgtctttgatgatgtttttctttctgcaacaacacaccctgcactgaatttcaaagtgtatagacaaattcccctttggttttcagtatattgacttctgattgtttttgatatttggtacatgtaaaacttagtccacatgcttatgcatttaaccaaagtaataagcttctcaggacaagcattattaaaattccttgtgctcacgagccctgacaaggcacagagatttctagtcaataatgcatgccagaatttacctttgttaatctttggagttttccttttagaattaatttatgtaccaaaaaggatcagatagctgcgatcaatttctctaaaaattcagtgacacacaagatattaaaaagaacaaagcaatactgagaacactgggccctgtaatttctgaaattcactgaacctaaattcatttgtacctaaaagaccaagggcacagaagggagatcattcttaaagacacagatggaaaactgcccatagttccttgtggcccattgctactgccaatcctgttttctgctcatcatacttcttggatctgcttcgttctaaaactctctggcctgattacttttttaacccatagttcttggtgcttttctaaaccattcttttggaaattttgttcttgggaagatttcttatgatttattttcatgttttcactaaactccttttttaaatcagtttttattttatctttgctatgaatgtctatgaaattagataaaaaaattttatttaaatttagaaatttgtaagttaatgacaagggtaaactaagtttgtttttaacttttgaaaatctttccaaaatataatttatctttagtactagatgtttgaccctactttatgaacatgcagtgtattccgtatccagtatataaattaaacagagccttgccaccctctcacctcttaggaacataaaacccatgttgcaagcagagacaatacaattagaagaatagccaatcgcttatgtagctactgggcatactaatcagattttgataatgccctgttaccatgacagccagtgactcagagattttctcattagtgtttgaccagcaatggtccttttaatagatcttcctgttttcccattcaattactgaaattaatatgaggtgagatacatcattattcactcataatatgaatttacatttagcactttcttacggcagaattgtagtaaaatactgctatactgtttgctttttttcagtgcatgagacaaatataaggggagaaaataaatataaccataagtgtttttaaatgagagatattgaatagcaaatgttctttttgtagaattaataaaaaagaaaaaatgatcattagaaacaacaacaaaaaaagctctattttggtttatttgtggtgaaacacattctgaaagagtttatatctcagaccacaaacattttataatccttgtatgcaaaccaacactaaatagcaaatgaatatgaaaaaatatatatgtacctacagatagtgttgatagattaaaagttgttggaatttatgtttcctggaatttaaatttgtaatatttgacttttgctttggcttatgtgatttggtaagaaaagatagttaattaatgaagataatatatttcctatctcatggtatacttcatctataatttaaaatcaaacctaaaataagtttgatttaaatatgatactctaatctgtagttgattttttaatgaatacagttatagtcttcagagtccagctctgggctctggttgattctgctttcttgggagaggcctagggtggacacagtatatactaacatttactgtcctcctatgctcttcacacaagacacatatactttttcttatttttttctttcctttgcttttaacatttcctttatttttaatttcagttgcttctagttgaatattttctctaactgttagctggatgtattcctgactacaatggtagctgacactgtcaggcactctatcttctgcaatgatgacatatccaaattttgtttgggggtcaattattcttgacatgattgtggtttaccttgactgaccccaatcaatcttctttgtcctatttctcgtatcatagcagacatctcaagtgcctaaataataaatacaatagacatagtaatactcatatcagacaaaagaagattaataggtaaaaaaataaactgaggggataactaacacttgagaatccagctaatatgatgtcgaaatatataaaacaaaaaatctcgtaaaacaagatgatagtaaaaaaatgtaataatcagaatcaaagacttcaaggtatctctctcaacttttaatctgtcaagtaaacaaaatttgtagtggaattagaagaattaacatggtagtataattaacagtatatatttacctctgtacaaggagagaatataaattttttgagttcatttatggttcaattttcaaaaaggcataaattctttacccaaaatctagcataaattcctcatagtataaattatacaatccataatttatgaccaagattcaatgataaaaggaagtgatatgaaattaataaccatgaatgagattaatcacaaatttttaagacacatgtaaatgaatactgagtcaaagaggaactataaactttcattacatagttggtaaacagttaacaactacaacacttacgaagtttatgagatgtatccaaagccgtattcagagtaaaattcatagctttaaattctttatcattaaataagaaaaaaagaaaataagtggattatgaattcaaattgaaaaaacaatgaaataaaaaatgcaaaagaataaatcaatgaaaattagaaattaataatgagaatagaaaaaggatgtatatttatgtatgttatatacctatgaaaacttctgaacttatatatatataaaatatataaacatttgtatataaattttttatatatttatatacatataaataatatacatatatacatgcacatatatgtgtaaattcagaatttgtctgtcctcaaggggaaaaataatgaggaggtacaatacattagatatcctggaaaactgctgaaaatatattaataagtaagaaaacagtaatatacatagcaacttggaaggagatagtactatatacacagaaacttatattatatatatatactatatatatatgtgcttaaattttttaggaaataataaatctctgtgaaagtaaacattctcaatgctaaatcaagatggaagaaaaacctggactagattaaaaactgttgaagaaactgagttttaaagttttaccttgcatgcccatctttagcagttttatgagtgagtttttagaaacttaccaaaaagaaagaaagaaagaaaaaaaagtgttagaataaaacaggtaatttttagtttcattacctagcccaaggacagaaaaaataaaagggaaattcattactggttttaaaaataaagcataaacataattttaaacctaacggatacagtactcacatggtaacagagacccatttcactattttgaatgcaaaactttaaaaaatgatatagaaaatgaaagcagttgtatgtttaaaaagagcaatataccatgaccaagtaagaattgtactaggaaagcatgaaatatataaatgatccgactatgaggacatcatataataaattatacttatagatattggaagttactttaaaaagtggcataaatctagcaactatacctgttaacacacgtttgcatatattgttaggtcccatgtgttgaaattgattaggggaatggattttggaacagctaaaactcttaataagatctgccaggtgaatgtcaaacctggatgccatgaagcttaatgagtcaaaagcagaatggtgcttacaggaaatagttcaagaggggaacataaaaccaaccaggtaaaaatgtagacaatccccaaagtcaaaacaggagcaagggtccaagctaacatctgtctatggaagcttaattacttctccagttggtgtttactctctttaaatgttgactacatattttatttttttcccttaataataatgactactttttgttgaacactaacaccgtctaacatatttataactcaaaaaatgaatgtggaaatcctttaagttttatacaaatataatgcagactatacaaacagaaggcatttaaaaattgcaagtcttcaaaatactgcattgcctcaaaataataactatacacataactgattatttctatctattgtttacagtggaattggttctgtttttatctaagtttttaatttcctcagtaggacttgtctgtccagatcttttttaaggacatggataactttcgtcacagtgtaactcatcattattacatatttaccactagattaaggtcatatattggtaagataaagcactctttgcatttacttggtagactgatggaaatgttggtagctgttgaaagtgattcatcaatcattgaaaatggtaaatgaatggatcaatgcagggaatgtgcattagcactatctttgtactactgaaagaagaaaatgtacattgccaaaaagtgggagcataaacatacccttgtgcaaggtagaggtcatacgagtggctcgttttagaatgctagcctcaccattgccagtcttttcaggtttctcttctgcaaaatagaaagaataatgatgcctactttatagtttgattgtgaagactagtgttataatatctgaaaaacacaaatacggttgctaggcacacatatgttcaataaatgttagctatcatcatatttttcattgatagaaattttgagaacttaaaaagatagctcggccgtgttcagtggctcacgcctgtaatcccagcactttgggaggccgaggcgggcggatcatgaggtcaggagatcaagaccatcctggctaacacggtgaatccccgtctccactaaaaatacaaaaaaaaatagccgggcgtggtggcgggcacctgtagtcccagctactcgggaggctgaggcaggagaatggcatgaacctgggaggtggagcgtgcagtgagctgagatcgcgccactgcactccagcttgggtgacagagcaagactctgtctcaacaaaaaaaaaaaaaaaaaaaaaaaagatagctcaaacgttgttataaaactgtcagccacacagtgggctacgaagggaagaggcaattgtgttttctggattataccaaactctgttggaaaaatgatatgcaaccatcaacattagttggtaaaatcatgtctaaaattcatacccagtaaatgattaagatagttataaactgaaaaccaaattcaattgcttcaaaatgtatgttatctaactcttctcagctcataaaatgtaaatgttactttaaaattgtgccaaactcatcctatttttttttataaaaatgagaattttttttttattttagattttagattatgttttagaaagaaaacaaacttggccagaaacatcaacagaattccattttaaaatcatctttttgatttgtttttttgcacaatataaaaaatacagtggttgaacttccttatccacaggcaggttctatttttgtcccatttagaccagctttgggcaacaaaaacacagagttacataatcaatattcaggttaataatgttatatcagtaaaactcatgctacattacttaataatatattaattggtctttacctacaccagacgactgcttcataatagtaacataattttgaatgtaaatacaatgtccagttcaccagtgcttggagttgcattttcttctgtatgaccacagcttattatgtgaaacagcatgtaactcctcacatatctctataagtgaaagcagtgggattagtggtttaaacaatttcacagtgccacattttatcctgagttccctgcctgaggcagaaatagagctgacagcatcctgttaaacagaacttctacccttaggagctgattcatgaattgtgaataaatggacctctccaaaatacctcatgttctctcttcactgtacaggctacctattcacatatttatgtagtgcctaaaaccatagtatgaaaaccccttgacgagtacattatttagatttttaaaaatatatatacatgggactgggcatggtggctcacacctgtaatcccagcactttgggaggctgaggcaggcggatcacctgaggtcaggatttcgagaccagcctgaccaacatggtgaaacctcatctctactaaaaataccaaaaattagccgggtgtagtgacaggcacctgtaatcccagctactcgggaggctgagacaggagaatcacttgaacccgggaggcggaggttgcagtgagttgagatcgcgccattgaactctagcctgggcaacaagagctaaagtccatgtcaaaaaaaaaaaatatatatatatatatgtatatatatatgtatatatatatataatatgtatacacacacacatgcaaaactttttatttggtgtaagctggaagttaagagtacaaatttcaaattatttttaataatacagatattgatatactgtctctctaaaaattatgatgtcctctttcttcctgagctgcagaagtagctgttttcataatctggaaaacatagtagacttttattaagacaattttgacatgcctctgttaagtaataatattcaactttatattctttgcagaggtgtatattatgcttctgttcttaatatagttatcacctttatgtgaaagggctaagcattaaaaataacagcatactgctttgagtagtttttttttttttttgtctaattccaaaagtaatacaggatcatcatagagaaaagtgttaaaaagaaaataaatatttctcacagtcctacaactcaatgaaaaccacattttctttgtaaaaccaaccttgcaagtattaattttagctttatacacatttacaaatgcccttataataatgtccgtacgtatagtagttacctgcttaatatttaatcaactaatgttaaggagggaaatttggaatggagaggatctttagacatatctgtattggggaaggcctggtttgaatgttgatggcagttaccttttaaacagcaactaccatatgtcaagtattgcaattgtacgtagcaattataatgctatgtatatttatgatgctgctttctcttcctcagtttatagaaatactacatcctctgtgtcgtttgtattcatagttaaattgaggccatataactgatctctggccagcgaaatgtgaatgaaagtcacattttcagctgttgcacattgaagagcaaagtttacctccttcaggctctcttcccttctcttcagaaccacatagctttatacaaagacatagctttataatggcataagactgcttgctttctgttgaaatgggattataaccaagacaaatcaagatatctttgttatattaagccttataagactggacggcttgtctattgtggcttgctagtgttaactatcctctgaatttatgtattatgtattatagataaatttatgtattatagataaataaataaatttcaaggcactgcccaagcgctttcctccacgaagtggcagaatctggttatacacaagatgcgacttttaaaatcagacttattttccagtatgggtgtggaagagtatttgctctgttattttacttaaactcccagcacctcagttgctcatttgaaaaggatggtaatatatatcaaaaggttttcatgaatgttccacgagaaaatatatataaagcattcagcacagttctgatctcagaatcagcatttggtaaaaatagcattattatggttgttgttgtttggcagaagtaggattctaacctaggtctggtttgctgtaaaactagtattgcctctaagtctattggcctgtctctctttttgtagaaagaaaataatttttaaaaaacccataggaatgctataagctctttaagggcaaggtctagatctcacccatctttgtatccctgggacacagaaggtaaactgaaacattatagagaatgagaaaatatttgttgaattagaataaacagaattgaagatgcgagaccagaaatgtagtcactttctttcatgctcccagaaggtattatgtaattttagggacatactcacaaatatacacatacacaaacacacacacataccattcattatttctgaaatcactttatcagaagaacctacaacctagtattagtcctgcattggacaaaaaatcctaaaatacaaaatcttctatgaataatattacaccaagaataaatttcagtcaaaacccaataatagaagcacttccagaatggcagaataaggacgttcaaaaatatattccttcataaaagcagagagaatatggggggagaggagggaatgttaaaatccacttttttggaacacaggaacttaaccaaaggcttacatcaactcaaggagcacttattcaagaaaaattgctgaaacttactaagaagagtgaactcttttatgttttaactttctccagtcctaaatagaaaagctggagagtgaaatgtccaaaggggatttgaagcacactgacatatttctaagactatggaaggacacatacatgcaagcggagggctgtgcacatgcataggaaagacttgagaagggtctaatctcttgcatctggttgacctcaaggacttgcacaagcaggaggtaaaggctaaggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgactttaagataaggagattatctttgattatctaggttgacccactgtaatcacaaagttcccttaagtgtggaagatgaaggcagaatggtcagagtaagagtgatgtgacatgaaaaagggattctcccctagagagacaagagagaaccagctcttataacaccttgacttcaatccaatgaaacttattttgtacttatggcctccagaactgtaagagagtaacttcatgttatgttatccactaagtttgtggtaatttgtcacagcacaaaaagaaaacaaatacactattcttccacaactatagttgagttttctatactaacctcctgtcaatatacaactttgatgagctcatttattaatttaaaaaattttagtatattttttagacttctctatatacaagatcatatcatctctgaagagagatcattttactttttcctttctcatctagatacctttgattgtttttttgttatcaaattgctctggctcgaacctccagtgcaatgttgaaaagaagtgacaaatgaagacatccttgtcttatttttgattttaggtaaaacgtgatcagtctttcaccgttaagtatgatgttagttgtgggatttttgtagatgcttttattaggttgaagaagtttatttctatttctagtcgaatatgttgatcatgagaggatgttggattttgttaaatgctgcttctgcatctgttgaaatgatcatttggtttttatcttttattctatcagtgtggcctattacattgatttttgtatgttgaaccaaccttgcattcctgaaataaatgctagttgcttatgatatacagtcatttatatatgttgctggatttggtgtattagtattttcttgatgacatttttatctgtattaataagagacatgggtgatgcctttttcaggttttggtattagaacaatactggcctcacagaataagttaggcagtgttccctcctgtcctattttttggaagaatttgtgaagtagtagtgttaattcttcttaaatatttgggaaaattcatcagtgaagccatctggtcttgggcttttctttgtggaaaggttttgattactgattcaagtacaagaatttgtctactctatccaggttatctaatttgctgccatttttttctcatatttgttgccatgttgttaacaatttcccttataaatcctttataattctgtaaatctggtaatgatgcctttatataattattgattttaataatttgagtcctctctatttttttgttgctcagtagagctaaagtcaattttgttgctcttttcaaaaaatcaacttttattgttgaattttctatatatttttaaattcttttatttatttacattcaatattattttcttctgcttgatttggatttatttttctcttctttttctacttgcttaagatagaaggtttggttatgatttgagatatttgttctttttaaatgtaccatttacatctgtgaattttctttcaagcaatgctagaattatcctataagttttcatatgttgtgtttttgttttcattcatatcaaaatattttcagatttcccttataatttcttttttggccgattggctattttaaagtgtgctgttccatttccatatatatgtcatgtgctgcttaatggtgaggatacatttgataaatgcatcattaggcaatttcatcactatgcaaacattggagcgtgtacttacacaaacctagatggtatagcctactgctcttccaggctatataccatagactatacagactatagcatattgccattgctattgctcctatataacaaacttatatagttactgtactgaataccatatacaattgtaatataacaatattttatatagaaacacagaaagatatagtaaaaatacagtataaaagataaaaagtggtatacttgtttagggcatttaccatgaatggagctttcaggaatggaagctgctctgggtaagtcagtgagtgagtggtgagtgaatgagaaggcctaggacattactctacactactgtagactataaacactgtacacttaggctatactgaatttgttttaaaatcatttttcttcaataataaatcaaccttagcttacgtaaccttttactttataaactatttaattttttaactttttgattattttgttaacagtttgaaacacaaactgtacagctgtacaaaaatattttgtgctttttctataaatttttctctattttttattttcaaactttttgttaaacacaaagacacacacattagcctaggcctacacagggtcaggatcattaatatcactttggcccacttccacattttgtcccactggaagttcttcaggggcataataatatgtaatatacccttaaacaactagcagtgcagtagatttgtttacaataacatcaccacaaacacatgagtaatgtgtagccatatggcattatgaaggttatcatgtcactaggccataggaatttttcagctccattataatcttatgaaaccatatcatatatgcagtccatcactgactgcaatgactttatatggcacatgactgtgccttattccattggccaaagctcagagggagggattgtggggactatgaagctacagggttaagggcttggatgcaggaagaagtggagaattaggaccatttttgaactctgtcatttatatgcatgggatgaccatacatctaggtttgcccagaaaagtcccagtttattcctgtcatccttatagaaatattattttttaagaaagagaatcttgctctgttgccctggttggagtgcagtggtgcatcatagctcactgcagcctagaactcctgggctgaagcaattttcctgccttactctccatacgacctgggactacaggcacatactaccacatcaaactaattttttttttttttgagacagggtctcactttattgcccacgctggtctcaaactcctggcctcatgggatcctcccactttgaatcacccccttgttactctaaaaagtgtcccaattttaatgataaattatatgggaactctacatttggagggttttaaatagaatggatgcactcattgaaaaaatctgtgaagtaagcagaagaattaagataagtttagagtccatcaaagaggttccaggaagcaagagatgagccaaaacagaatgggtctgaagaagcgaaaagggatacatgaaagagggctaaatgagaaggtcaacagcatcaaggcatagactatcaaatgaatgtgtctgttgtgtttgtcaactagaaagttttttactgactatgatgagaggcttcataggagtggttgcagtgaattaaagagtcaactaattcttgctctcacactgatttaaaaataaaactttaatttcactcttttgggtcttacatttaaaacaaaagggaccagactctgcggaattgagatcctctgagtgttaacattttcaggatctgaatactaaatacagatgccagactaaaaccaaatgtgtaagaaccaagacctgtagcttacatttattctctatccatcatttttgacactaaataaaaatgatctggtgtgtattcattgggaattattctgattttattttattacggctgtaaattcattttccttcacgtatttgatgtctttgattgatgcaaaactcaataagacttactgtagttacattaaatattaaccagaacattattttgaaacatttgggaagctgtgacatctcaacctgatccaaaaccttagtatatatattaaacacagcaactaaaagacttgccaagatatgtttgacaattgtcctaactttgatgaagaaaataagaaaataccagtttccccagtagagagtttactgtgaaaagcattgcagatttgacattgcgtgaaagtttccaactataagcaaatgcagacttaatggcagtaaatgacattaaattttttaaatgacaaaacctgcatttgaaatgtaggtacataacttttagttatttgaaacttcaaggatagctaattggctaatacataaggggacagaaaatctgactagtattaactttgaaccaaaaaaaaaaaaaaaagaagaagaaaagaaaagaaaaagaatctttgtgtagttgaatccttatcttggctgttacttacacattgcaaacctattttgtatgagtgcacatcaaattccctttgggattctcaatttcatttattttatcaataaaaagagcctccttgtggagaaaggaataagtcacatataaatgaagtagaagagattacaccagtacctgagcttttactttgactaatccaatagctttggccaaatatctcaatgtcaaaagcattataagtattctacgacgtaagtctggaaaagagaaattaataagaaagtattggattgattaaaatgtttacttttcccctccatccttccccttctcaagcttaatggctctttctcataccaatctgatctttgttatggttattggctggccttgtttcttgttataactccacatctagaactcatttctgcatcatatacttttctgtctctccataatttcagtattagggtcctcgctcagatgcatgtcctttgtcactgaacttgacgacaggctttaaagagattttacaagtcccatttacacaaattatttattttggtcttcaacaatgttaaaatgcatgatgtaatttttatagaagagaaaacatgcttagcaagataattctgccaaagatttctctgcttaactatatagttaagtcttttcaactattttgctcatcaaagatcttgtacatcatagaagattctagaaaagtgaccttgatatttatcttgcacctcagtgcctttaacatgtactttttctgcttagaatataccccaaactcttttcttcatcctttttaatgtgtcttcagggctgagctttcaaatccacttattaaggatatctttccccaacccttaaattattatttaagataatttcccagataagtttttctgtttatatgtctttatcagaattatgatacatgggtttttttgtttgtttttatttttgagacaaggtctcactttgctgtgtagtcaggagtgtggtggtgtgatcttggctcactacagcctcaacctcccaacatcaagtgattcttccacctcagctccccaaaaagctgggaccacagtcacacgctaccacacccaactaattaaaaaatcatattttttgttgagatgagatctcactatattgtgcaagctaatcccaaactcttgagttcaagtgatcctgctgtcttagcctcccaaaattctgggattataggcatgtgccaccactcccatccacataaggcattttttatgaatgcctgtgttctctactgggttgtgaacttagggagaggatgaggataccataatatccacttatgtatttccaacaccttatggcactgaaaaactattgtcatctgactaatggtctagttgccattttagggcctcatgatctcatttatgaatcatgacacaaactgccttattttccatgtgccaatctcaattccatattgtccaggcctgactgatttgtgatcttaaaacatggattttatcatgttacattctgcaaccacactgtcactatctgttatttatggaaagacaaaagtgatactcagtgtatcattcatgaccctccatagattgacctagatcaaatttctgaccttgtcataccctcttctctccaacacaagcactttgtctttgccatagtagctgatagaatggattcagaatacttcttcctgttcatctttattttgactttctacttgtgttcttactcattttgaattctctctaccttcttactagtttatattattgatataataatttcttttcatttgggtagatacctagtagtgagattgccggattgaatggcagttctatttttagttctctgagaaatcatcatattgttttccaaagaggttggactaatttacattcccaccaatagtgtataagcatttcttttccttcttatcattgccaatatttattttttgacttttaaataacagaccttctaactagtttaagatgctttctccttgtgtttttaacttgtatttgtcaatatgctttttggccacttgtctgtcttcttttggaaaatatctattcattttctttgcccactttttattggggctattgggaatttttgttattgcggagttttttgagttccttgtaaattctggatatcattaccctgtcagatacatagtttgcaaatattttctcccatcctgcaggttgcctgtatactctgttgattatttatgtttctgtgcagaagcttttcagtttaattaagtctatttgtctagtttggtttttgttgcttgtgcttctgaggtcttagtcataaattctttgcctaaaccaccatccagaagagttttctctgttttcatcattttaatagtttcgagtgttacatttaaattcttaatccatcttaagttgatttttgtatatggtgggagataggggtccagctttattcttctgcatatagcaatccagttttcccagcaccatttttgaaaagggtgccctttccccagtgcatgtttttgacaacaactttgtcaaagatcaggtggatgtggatgtgtgatttaatttctgggttctctattctgttctgtcaatctgttgtctattttgataccagtacaatgctgttttggttgctgtagctttgtagtataatttgaggtcaggtaatgtgatgcctccaaatttgttctttttgcttaggattgctttgtctatttgagctctttttttgattccatatgaattttaggatttttttttctaattctgtgaaaaatgacattggtattttgatagagattgcacttaaactgtagattgctttggatagtatagtcattgatattcattcttccaattcatgcgcatgagatggttttccatttgcccgtgttatctataatttctttcatcggtgttttgtagttttctttgtagagatgttttacctccttggttaaatatatccatgggggtgtgtgtgtgtatatacatatacacacacacacacatatttgtagctattgtaaatgagattgctttcttgatttaattctcagcttgatgattatcagtatatagaaatgctactgatttatttttaatttcagcttttattttatacatagggagtacatgtgcaaggttattgcatgggttcattgtaactaggttgtgagtgtagtacagaacaggttgtttttcaaaccatgaccttctccctccctccccctccttgtagtctgccatgtctattgttcccatttttatagcagagtgtgctcaatctttagttcctacttataagtgagaatgtgtggtatttggttttccattcttgcattggttcactttggattatgacctccagcttcatgcatatagttgcaaagaacatgatttcattcctttatatggctgtgtagtattccatagtgtgtgtgtaccatgttttatttatccaatccaccgttggtgggcatctaggttgattccttttctttgctattgtgaaaagtgcagcaatgaacatatgagtgcatctgtctttttggtataatgatctcttttcctttgggtatatacccagtaataagatagctaggtcaaatggtagctctgttttaagtttttgagaaatctccaaactgatttctacagtggctgaactaatttatattcccacagtgtataagcattcccttttctccacaacctagcaatagctgttatttttttacttttagtaatagccattctgaatggtatgaaatagtatttaattgtagttttaatttgtatttctctgatgattagtgatgatgagcattttttcatgtgtattggctccttgtatgtcctcttttgagaagtgtctgttcatggcctttgcccactttttaatgaggttacctgttatttgcttgttgatttgtttaagttccttgtagattctgtatattaaacttttgccagatgcattgtttgagaatattttctcccatttctgcagattgcctgtttactctgttgatactttcttttgctgtgcagatctttagtttaattaggtctcacttgtcaatttctgtgtttattgcaattgtttttggcaacttagccaaaaattatttgccaaagctgatgtcaagaatggtatttcctaggttttcttctaggatttttatagtttgaggtcttaacatttaattctttaacacattttgagttaatttttatatatgatgaaaggtaagggtccagtttcattcttgtgcatataactagccagctattgcagcaccatttattacatagagagtcctttccccatcgcatatttttgtcagctttgttgaaaatcagatggcagtaggtgtgtgactttatttctgggttctctattttgatgcattagtctatgtctctttttgtagcagtgccatgccatttggttactgtagctgttcagtatagtttgaagtcagataatgtgatgcctcaggctttgctcttctttgtttgaatgacctgttaaggctcttttttggttccgcatgaatttttgaatagttttttcctaattctgtgaagaatgatgtttgtagtttgataggaatggcattgaatctgtaaattgctttgggcagtatggtcattttaatgatattgactctcccaatccatgagcatggaatgttactttgtgttgtctgtgatttgtttcagcattgttttgtagttctctttatagagatatctcatctccttggttagctgtattttcctaagtatttcattttctttgtggctattgtaaatgagattgtgttcctgatttgactctcagcttgcacattattggtgtataggaatgctactgatttttacatattgattttgtattctaaaaccttactaaagttgttttatctatcagttctagcagccttttgacagtcttcagattttcctatatgtaggatcatatagtcagtgaagagagatactttgacttcttctttttctctttggatgctatatgtgtctgtttttatactgctataaagaactgcctgagactgggtaatttataaaggaaagagatttaattgactcacagttcagcatggctggggaggcctcaggaaacttacaatcgtggcagaaggtgaagaggggaacaaggcaccttctccacaaggcggcaggaaggagaagtgccaaggcagggggaacaaccccttataaaaccatcagatctcttgtgagaactcaccatcccaagaacaacatgggagaaactgcccccatgattcaattatctccacctgatctcttccttgacacatggggattatggggattacaatttaagatgtgatttgggtggagacacaaagcctaactatatcagatgccttttatttctttctcttgcctgttttcagtactatgttgaataggagtgatgagcataggcatacttgtcatattccagttctcaagggcaatggatccattttttgtctattcagtatgaggttggctgttggttcatcatagatgattcattattttgaggtatgttcctttgatgccttgtcttttgagagtttttattataaagggatgttggattttatcaaaagctttttatgaatccattgaggtgattgtgtgatttttattttaattctgtttatgtgttaaattatatttattgatttgcacatgttgaatcagccttgcattacaggaataaagcctactacatcatggtttgttaatgttttgatgtgctgctggattcagtttgctagtattttgttgggaatttttgtgtctatattcatcagggatactgacccaaagatcctttttttatttttgtttctctgccatgttttcatattaggctaatgctagcttcatggaatgagttagggagcagcacctggtcctcaatttttggaatagtacctgttcttctttctatatctgttagaattcagctgtaaatataacttatccatggctttttgggtttttttctgtattcaatttcagattttgatatttacctattcaggattttaatctgttcctggttcaatcttgggagattatttggttctagtaagatatatttcctctaaattttctaatttgtggaacagaattactcacagtattttctgaggatcttttgtatttctgtgggatcagttgtaatctcatatttgttatacctgattgtactgatttgtatcttctctttttttgttaatctagctagtggtctattcatctaattttttcaaagaacaaacttttggtttcattggtcttttgtttgcatttttgctttgcaatattatccagttcttctctaattttaattgtttcttttcttctgctagctttgtggttggttgtttctttgtttttgtttttctttttgtttttgtttttttgagacggagtctcgctcctcttctcccaggctggagtgcagtggcgcgatctcggctcactgcaagctccgcctcccaggccattctcctcctcagcctcccgagtagctgggactacaggcacccaccaccacacccggctaatttttttgtatttttagtagagacggggtttcaccgtgttagccagttcctttaggtgcaaaggtagattgttaatttgagatctctctaacttcttgatcaaggtgtttagcaatataaactctcctcttaacagactgcattagttacatcccagagattttggtatttgtttgcctattttaattaatttcaatacttttttatttttgccttaatttcagtgtccacccaggagttattgaggaccaagttgttaaatttccatatatttgtgtagttttaagagatctttttgatattgatttctatttttattgctctgttgtctgagagtgtgcttgactcccagatgattttaatctttttttaattgagacttgcttcatgaccaattatgtggttgatcttagagtatattccatgtgcagatgaaaaagaatgtgtatgttgtggttgttcggtagaatgttcagtagatgtttattaggtccatttgcttaagtgtcaagtttaaggccagagttcctttgttagtattctgccttgatgatctctctaatgcagtcagtacagttttgaagtctcccactattatagtgtggttgtctagaccttttgatatgccaagaagaacttgttttatgaatctggatgctccagtgttgggtgcatatatatttggggtaggcaagtctgcttgttggattgcaccctttatcattatgtaatgccttccattgcccttttaaatttttattggcttaaagtctattttatcaggtatgagaatagtgactcctgtacttttatgctttctgtttttatagtagatctttctctgtccatttactttgagcctgagtccttacatgtgtgatatatctcttgaagacagcagatggttgggtcttctctttttatccagcccaccactctctgccttttaagtggggtgtttagcccatttacattcgggattagtatggatatgtgagatttttattctgtcatcatgttgttagctggttgtcatgtagatttttattgtgtgattgtttcctagtgcctatgggctatgtgcctaagtgtgtttttgtggtagcaggtgtcattcttttgattccacatttagctttcccttaagaacctcttacaaggctgatgtagttgaaatgaatccctcagagtttgcttgtctgagaaagattttatttctccttcccttatgaagattagtttggtggaatataaaattcttggttggaatgtctttcctttaaggatgctaaaaattgtcccagaatctcttcttgcttttatggtttctgctgataggtctggtgctagtttcttccatatgtgatttgacccttctctctagctgcctttaagatgtttttctttttcattgaccttgatgaacctgatggctatatcttagtgatggttgtcttgtgtagtatctacgctgttctccatatttcttgggtttgcatgtcaacctctttagtgaaattagggagattttcatggactgtatactcaaatataatttccaagttgtttattctctctccttctctctcaggaatgccaatgagttatagactctgtctcattatataaacccatatttctcagaggttttgttcatgttttaaaattgtttatttttatcttactgtgttgatttgaaaaactgatctttgagctctgagcttctttccttagcttggtctaatcttctgttagtacttccaattgtattatgaaattcttgtagagaatttttcagctttagaagttcagtttggttatttcttaaaatggctatttcatctatcatttcttggatcattttactggattccttggattgagttttacctttctcttgaatatcaatgaccttccttgccatccagattctgaattccttgtttgtcacttcagtcatttccaactggttaagaatcattgctggggaggaactggtagactcctttggaggtaaggagaccctctgtctttatgaattaccagagttcttgtgctgatttttgtacccttaactgtagtttaaatatagtcagttggtttcatttctggatgtttttagacagccaatatgctctctgtagggtctttatctgtggctgatttcttgcctttgtttcacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtaagaaaaatggcttaatctatgagataaaccttacagtatccatagttacacatacctgtcatgtgattcagaccctgtaattcacattcccttgacgctcaaaataattcagagatccaacagctgagattctgaattacatatttttacaggattatagttttacatgacctggaagtcttcagaatgaagaccaaaatatacaggagaaactctatttttatgcttagcttcaataaattatagacagccatgtaaaaatatgattggataaaaagggtatgatctagtgctaattttctaagtagggaaacccagcaaagcatgcctgttttggtttttcgtgacctctctgtgcagcatttcccctttctgggtatggtagaagattctgtcaggattggaatcttatgacctacagtcaaacaaggtaggtcagataatttctctgtggccaatttttacacagaaaggctaggagaaaattagagtaatatttttaggttttgtggttggcttttgagaaaagacgttctggtttctatgtcctgcctccatggggaacggatattcagaaactagaatccctttggcctgggcaggaggagagtggtggcgggtagaatgagcagctagagaaagaggggcattaagcaggaataggtcagagaggactattgattctgaggctgtatttgaggactgcattttaaggtgtcactttctgatccccaacactggccttgttgaaaaaacaaccacagcaacagtagcagcagcagcagcaaaaacatgagaataaaatccacccaaacaaatgatgaattgagatgcagtgacgaaaggattggtgtaatgcttaatgccaaaaaatatgagaggagtgccaacaaacttctgaggggaaacaagcaactatcacagcaacaagtagatctcaaatgtattagaacttgagggcatatgacttataaaccgtttatgaaaaaaaaaacttggaaatcaaatttttccaaccaaaaaaaatgaatcaaaataacacaggtgaaagaaactgtggataaaggactcatgaagatgactaaaaccatttaaaattagaacaatggacactatgctggtatatatcataacagttggagagaaatattaaaattatcaaaatctggtaaggagtagaagtttaacaattctgatttttatgtgctttcagagctgggagttggaagaaatgttataaaagtgaaatataagattttttttctatttttaaaactttaaaattttgttaatattttagacctacataagagttgtaaatatagtacagagagttctgatattgtcttcagtctgtcttaccctaatgttgacatattacataaccacaatacaattaacagaataagaaattaacactggcatcatacttttaactaaactatagacttcaatcagagttctccagtttttccattcatgttgtttctctgttcctgaatcctatcaagcatctattgttgcatttaatagtcatgtttctttcatctccaatctgtgacagttcctccattgttttttcgttttgttttgttttgtttttgacaatgttgacatttttgtagactactggttatgtatttcgtaaaatgactctcatatcgtattcgtctgatgttttctcctgattaaaattagagatttctgagatgaataacataaagatgatgtgtcttcaatacatcctatcaggtgatgaaacatgtaatttaaaaaatattaactactaaatgttttcataatttaaaactggaggggaagaaaaatgcacttgttcaaaactttctgcagtttaatttaccttttttcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaaggtaattgcgacagttacttttgcaccaacctaatatgtacttttctgttctgatttattttaatttgcttttagaaagatagagttattgtttaaacaaaaattcaatgtttttgagcatatattatttattttgcatttttatttagtttgtatttctttcagaaacacaattctggaaagatacaacagtgtttaccttgaaggagcaagaactgtggatgctttgaatagacttatgttttcttatttgtgatgtgaacttttctacaagggaattatattacctttcaaataagctacatatgttactgtttcataatttctttatttttccatggaaattatttaacattttattttctgacaaagctcctgtttataagttatattttctgacaaagctcctgtttataagttagagcattcagagatttacttagaactatcctcagcttggccacttctatatggttttgagaaaagttaggtacattattatctcttaaaaaacttaaattagaccacaagctagttttgaaataactcaactgaggttattctttgatgactgacagtacaagagaattgtcatacactcagttattagttctttagacaaataaatatttaataaataaatatgttatatattatacatattaataggacaatgtaagtacacatgaaagttggtggtggaaaaattgccattgttactaatgctgtctcatgtctaataatgatagagctggaaaacagatgtttttctaaggcaaagaatttactcctaaccttttcttttatattgacatcatattgccattgtatgtcaggtaactgagtggaaagagagaatagagctgagggcacatacaattcatttagaattattctagtgagatgctcattagactagaaaataaaaacatatttggaggaaaacatttcttccctcactcctacaagggataaaaatgctaatatagttctcaatgcacagaacgtaatcaaatctacttcatagaactgatatactactggtatgaatgacctgtgatgatatactgaatttttgctttaatatttgttcttttcattgtttactagttttaaaacaccataaaatatttattaaaaaacctttaagggatttttttaaaggccatattgtaaatgtctttgcattaaacatttcataaggtatatttccaaatcttaaacaactttgctgtttgagtacaatatcagtaaatggcactttaagaagatagaaagccatctgcatccaaaatataaattaaaattatatgtaaaataaatcattttaactttagatagaaagtaacaacttaaatcaccttctatatagtgtataaatatatcatctaaaagatacctaaattttgatgtaaaaatgttctcaatatattttaccaggctgagaaaatcttacaagaattatctaggtatgtaatcattatattaaaatgccaaagacatattagacttgtggttatatttccttgggcaacaaaatagattttttttttaaatctatgtgtcttttaaggtaggggaaatagtaatgctgacaacaaagttttctcactaaatatatctgttcttctttgttaatatttacagtcaaagggggctgttctctggccaacctgcacccaggtgaaataaacagccttgttgctcacacacacacacacaaaatatatatatacatatacatatacacacacacatatatacatatacatatatacacacatatatatacatatacatatatatacacatatatatacatatgcatatatatatacatatatatatacatattttttaaccgcccacctatgtaaagtactctaccacatctgacaagttgagaaaaatgatgacatcaaatgttgcctatgggaagcctctaatcaactaaatatctcgacttcaacactcaaatatactgctacagcattgtaaagtgttttgtaccctctgaatataatactgtaaaatgttctacattattatttgaagaaaattgttgaggaataattttacagtgtgtaaggtggtagatgcagatgaaataattataatatgaaaatattgagatcataaagtaatttcccttgtagttacctttatgaaagttgtacgattgagtttaatttcaataaagcaacatcagccataatttagtgtcctttaagtgaattaagcaatttcaagccttataaacatgttcaagttcagtgagaaggacactttttagaaaatttctaagctaatgactttagtggcattggtaaatatccagagactgtgtgaggaaaacacccgaatatagaactgtaaaatctaaatagagaaaccattgtgttaaatctgaaaacatattagtaagtgacattttcctttaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtcgctattaagagtttcaggtagtgctaatataattacaattcttaagtcaattgatggacactttgaatagagatttaaatgaagaagtttatcattggcatgcatgctgtatagtcccaaatatctcaatcctattatattaaggatgagtattatattggagtaatattttatggctttcaaaatatgttttaaattgttacttttagagataccaaccataatacctaatacctaagtaggcagagctgtagatacaatcattctgaggtgatctgaccctacactgacaataacagttgtcagtagagatcattgaaattcatatttttctactttagatgaaatgtattttgaatgtcttagctggtattcaaagaaaaaagaaaagatgattaaaagcaatacaatcataggaggcttccagttccaaaattgtgatgtagatggaacctggcttcacttcccctaacagaaagccgaaaacaaatatacaatgccaagattatcaccagaaatatcccagaactcaaataaggaaatgagaattcctggggccacaaagaagtgtaatattaataactctaaggagatggtaagataataggacttccacatctgcaatatctgtcccctcattctgcctgcctccaggtgaagagaaaaatttttcccaattcactgtttctgcactggcaaaactgagatcaagatggacaaccatcttccccatcatattgggtagcctggcaggagacatgtttctgtttttactcacagaaagcattacaagtacttaaagggataaatatcactgagaatagccagtgacaaaggatggaggtagaattatcatccccagacctggaaaatgtaatctgtaatttggagatgtaatttgccaaaggagatgccaaatcagaatgactgtatagcagcaccacacgaaaggaggttcatctaataggtccctagaacacaaaaccctagacagccttcctccctgccaggacatcccctttaggaccttctccacttgggaaaggcagcactttgagcttttactagagccaaggcaaacctgggctgaaggctaccacccagagctgaaaaggaggtgatgacctagcagtaaaaatctgtgaggaaatgtatccaataaaaatcaaaacaagcaagacagagaagactgaaataaatacctaatctttcaatgcaaagacacacatatgtgtctacaagaaataatagcaaacaggaaaccatgatttccccaaacataaaaaacaaggaattaataagtgactccaatgagatggcaatatgtgagctctctgacaaagaattcaaaatggtagttttaagaaagctcagtgatctgcaagataacacagaaaagaaattcagaaatatatcagaaaaatttaataaagagattaaaataattaaaaatcacacagaaatcgtagagctgagaaatacataagctgaagtaaaaaattcatcgaagactctcgatagcagaatgaccacgcagatgaaagagtcagtggactcaaacacagcctacttaaaaatatacagaggagaaaaaagtctaaagaccaaaaaagatcacctaaaagatatagaagagtacctcagaagactaaatttaagaattattagtgttcatgagaaagttgaacaatagcaagtggcagaaagcttactaaaacaaaccagcatatttttccaaacttgtgtggagaaaacacatgcatgtaagttacatccaagcacacataggcgaacaacatcatacagatttgacaaacaagactacccaagacctatgataatcaaactctcaaaagtcaaggaccaagagtgaatcccaaaaacagaaaaagaaaagaaggaaaataaaaaggagttccagttcacctggaaacagacatctcaacagaaaccatacaagccaggaaagagtagaatgacatttctactaaagtgctgaaagaaaaagaaaatcaccatacaagaatactgtattcaacaaagctgtccttcagctatgaaacagaaaaattctttcccagacaaacaagagcttaaaagagttgatcaccaccagatatgtcttacaaaaaataccaaagagagttcttccatctgaaagaaaaaaaaatgtgaaggaaacaaacaaaaacatctgaaggtataaaacccactgttataattaagtgcatggccaaacccagaatactgtaatgccgtaattgtggtgtgcaattcactcataactctagtatgaagcccaaaagacagttctatcaaaaacaataatagttacaggaacctgttaagagatatgtaatataaaatatgtaaactaacacaacaaagagccaaaatgtatgtgtgtgttgtggggatggagttaaaatgcagatttttcctgttttttttctttgtttccattttttctttgtgatctaagataacttgtcatatctgtaaaataactttattatatctataagatatttttgtaagactcatggtgaccacatacaaaagcctataatagataaagtaaaaataaaaagcaacaaattaaaccatactagcagagaaaatcaaaatcttttaactacaaaagaatacaacaagaaagaaaggaagagatgaattacaaacaactaaaaaacaagcaacgaaatggcagtagtaagtccttatttacagtaataacactgaatgtaaatgaacttaattatccaattaaaaggcatagaatagctgaatgagtaaagaaacaagactttatgctgcctacaagaaacttcatctgtgaagacatatatagcctgaaagtgaaaagattggaaaatgatattctatgcaactgaaaactaaaaaagagcagaagtagctatacttatatcagataaaataaactacagattaaaggctataaaggaggccaaaagtgcccactgtataatattagtgaacagggtcacaaaaattctcaagaaaatattagaaaacttttgtcaagaacacattaaaaagatcattcactatatttaagtgggattcatctcaggagtgcaaggatggttcagcatacacaaatcaataaatatgtacatcatattaacataacccagaacaaaaaccatatgattattttaataggtgcccataaaagcacttgataaaatttaaatcactttataatgaaaaccctcatcaaaatggatgtagaaggaacatgcctcaaaataataaaggctgcatatgacaagcccatagctaacactttactgaatgggggaaaattgaagacctttcctctagatttggagaaaaagacaaggatgcccacttaccactttaccactcttattcaaaacagtactggaaaccctggccagagcaattaggtaagaaaaggaaatttaaaagtatccaaattggaatggaataagtcaaattagccttgttcacagaagacaagattctatacttagaaaaacctaaagacggcctggcgcagtggctcacacctgtaatcccagcattttgggaggctgaggcaggaagatcacgaggtcaggagattgagaccatcctggctaacatggtgaaaccacatctctactaaaaatacaaaaaattagccaggcttggtggcatgtgcctgtagtcccagatacttgggaggctgaggcaggaaaatcactgaacctaggaggcagaagttgcagtgagctgagatcgtgccattgcactccagcgtggcaacagaacaaggctccatctcaaaaaaaaaaaaaaaaaaaaaaaaaaaaaaaactgaaagactctaccaaaaaacagtaagaattgataaatgaattcagtaaagttacaggccacaaaatcaacatacaaaaatcaatagtatttatatacactgacagtgaagaatctaaaaaagaaatcaagaattcaattccattaacaatagctacaataatataaaatacttagcaatcagtttaaccaaataagttaaatgtctgtacaaagacaactataaagcattaatgaaagaaatcaaagaggacagaaacaaatgaaaagatatttcatgctcacggattggaagaattaatacttttaaaatgacaatactacccaaagtgatctacagattcaatgcaatccctatcaaaataccaatgccattttcacagaaatagaaaaagcaatcataaaattcctatggaactaaaaaaggccctgaatagccaaagcaatcctgagcaaaaagaacagagctggagtcacactacctgacttcaaaatttattacaaagacatagtaaccaaattattgtggtaaaaatagactcataaaccaatggaacagaatagaagacccagatataaatccgtgcatttgcatccaactcatctttggctaaggtgctaagaacataatggggaaaggatattctacatatgttctcactcatgtggaagctatatttaataaatggtactgggaaaactatataattatgtagaagaataaaactggatccccatcttttaccacacacaaaaataaaaatggactaaagacttaaatctcagacctgaaactatgaaactgctagaagaaagcattgggtaagcaccccaggacattggtctggacaaagattttgtgtttcatactgtaaaagcacaggcaactaaagcaaaaaataaaaaataaaaaaaaatgaaaagaaaaaccaggattatatcaaggtaaaatcttctgcacaataaatggaattatcaacaaagtgaagagacaacccatagaatggaagaaaatatttgcaaattatccatctgatggaattaataaccagaatatataaggagctcaaacaactcaatagcaaatgaataaattgtccagtaaaatggcaaacagacctgaatagacgtttatcaaaagaagacatacatatggccaaaaggtatatgaaaaaaatactcatcactaatcatcagagaaacacaaatcaaaactataatatatcaatcctgcacctgctaaaatggcttttattaaaaggacattataaaaaagacagatgctggtgatgatgcagagaaaagggaactttcttatactgttggtgggaatgtaaatttgcatagctactatggagaacagcatggagatacctaaaaaaaaatagaactacatatgatccagcaattccactactgggtatataatcaaaagaaaggaaatcagtatatcgaagagacattacactctcatgtttactgcaacactattcacagtagccaaaatgtggaagcaacctaagtgtccatcaatggttaaatggataaaatgtgatatatacacacacacacgcacacacacacacacacacacacatagatatgtacatatatatgatattctattatgtgtgtgtttatatatacaattcaccatatatacatatatatgatagaatatcatttagctataccaaaatgaaattctgtcatttgcagcaacatggatggaactggtggctcattatgttaagtgaaataagcctggtacatgttctcacatgttctcactgtcttatgttaaagccaaacacatgttcttactcatatggaagctaaaaaagtgaatctcataattaaagggagtagattggtcattaccagagagtggtgagaaggggaggggtaaagggaggatgaagagaagttgattaatgggtacaaatacatagtttgatagaagtaataagacctagtgatagatagacttgtacagtgactatattgtacaacaatctattgtatatttcaaaatagctagaagagaagaatttgaatagttccagcagaaagacaagacaaatattaggtgatggatatcctaagtacactgatttgatctttaccaattatatgagtgtattaaattattatttgtaccctgaaactatgtacatatgttatgcatcaataaaaggtaataccatcatgtataatttgatgtattgaacagaaaatcaacattgatgcatctttggctatgacttacaagtatgagtttattttggaatatcaataccccttcaaccttcaataagtatattataataattctataatgagatactagtctttatgctgcttattgtgcagactgggtttcttcatgtttttctttgaatgttgcaatatattttaaacttcattactttcttgacactttatgattttgtatctatgactttattgttttcttggatatattttaaaatgtgttttttctttatgtttctacatccacccatatgcatttccttatggtttcatctttaagctatcttattttctagagattgtaccctcctcatctgcctatattggtctcagggcatttcttgtgcatagctcgagtgggtagcatccccagtcactgagctcatcacacgcggtgctaatctataccttcagatgatgtgcatctaatttctaattccagcttctgctatagctaactgttccatagccagtaatttagtccttacttagagtgattgcccagtggggttcacatttattctgctcataaaatcccatcttttctgcaagaaaggactgacttcctggaagatgaaaacaatagcaatcatcctcctataaaaaggatttcctatctttgggttacttcttttgtaaaatttcttcaaagcattgggctccaggcaagtgacaatttttaaaaaactattatatgaagatggacaaattttatctcttagtacccacaactgtgttgtaggttatattttggcaaacggccttagtttgatctaccctatagaatcacagtaaggagatctcattttttccttttattgatgagaatactgaaaaactaagtgtgtttcacaaacaacagaaaggtccagaaagactatgtatgtttcagaaacaaagcttttaaatggcaaagatgtgataagaacatgaacgttctgatttttcctgatgttctaatttatcttatttccagaacaactaagagccattgggcacttgatttgtatacctaaaatatcttatttacttaatcttgtaaaactttgggtaaggaattcacacagaaaactaaatgcttacctgagggttatcaattccttggtgaatagtacagtcctggtgaagtatatctgatctatagagacatgtgaaattcagatgaaaactgtgatcttttctggagtttattagaaacgtgatggagaatctgctggggtcatgactgttgctcccccactgaatttatggtggaacagatggttctcccagaaagaccaacaaagttttaatgattataaaatctttgtcagaaaattcacggacttggttatgcatgcattgttatcactgcttctttcttttatttatactttaaggatgaagagcctgatttacacagctggattttaaacatggtttaaatgaataaatttggatttctgaaaagtgacttaataaactgaaatactcagttggattcttgagtaggaatacagtatagctcaaaatattagagacggtcttacttgtcctgaaataaactgatcttatcaatagaaattcaacctgaatgtgagtctggttattaggaaaatagtatctctcatggaaaggaaaatagcaatttggaaatgaaacatgagaggtaattagtcaaaggataagaaagagtatctgttgccgcagggaatgaaaactaagtaaagtgaatctcatatttcagtgtgtgaaaatacatatgatcatatattttcttaccaagacttgaagggataggataccagattagaatagaataatggaaatatatgccttattcaatataaataggccagttgtgagttaggatagtgtggatgtgagctgcttagaacttggtgtacttgtaaagtggaaatggcctgaagaataatatttgggtgataaaggagatgaacggagtgtctttgtaggacatgatagctttcctcctgtactctaaaggctactgagtgaaagaggaattatttgaattctgaataatgccaaggatgatatcccttatatagaagaaaaacatatcaataaaaggaagactttctaacagagctacttgcaaccaaatgaactgtgttccctcttactagaagttttatatagagactgcatgataaaattataaaatcaatagaatattagtagaaaaaattaaaatgagagatccgtgattagattaaatggatttaaagcctcttccaggcttgggattctagaattctgtgatacatgacacatgaattcagtttcaccatgctagatttaaatgttttcaaattgtcactataatattctataatatgaccattgatggaaaacaaccacgtttatatgagaaacagaggcactattgcttccagaaccatagagctatcctgctcttcctcatcctagggccttcaaatagtgtggctttgtcaggtgtgcaataactgaaaaaatctgagccttaatattgaatgcttcttctcaaatatgcaataaagaggtttttttctatttttaccttccaaatgttatctagagaataattatttaaaaaatattgacctgagttttacttagaaccttcacaagtttgtgaaaaacaattctcttcactatccttgtcttgatgcagctttgtacaactcttagtaccaaagcagagattgcgaagaaagtattgcattccatatttagtcagagactacagatgatgacaaatatattctgcctttgttgacctagaatgcatcaacaaatcaatcctccttagacttgaactcagcatcacactcacatattttggttaccatgtattcctaaaatgcagaaatgggtacactgacaaattttgcaattcaagatttttaccagttcagctcagaggtcaaaagaagacagagaagcagatgcatcacaggggggatttttcactgcaagaatggcgtgtctccatttgttacaagttagacttggaaaaatcctttagttaaatgaaaaagacaaatgtgagacagactgcctcgagaatcatttaccaatatctcggaacgactgtgattatacaaaacaccgatattaaaataattaagttcaaaaactaagtgcaaggttgtaagataaattgttagcaattctttaacataatttctgtcctctccctgcaacaaaccgggtcttcatcatgcccctggagttattctaaaattaatacacgattatttttctaactccgcttaaaattctttcatctctcctcttggcctacagattaaaacttctcaggactgcctttcctaagcccttttattatttgactattgcttatctatttagactaattgttctgttactcttctcttcctgaatgcaaattacttaaaaatttctgaatgtaatgtccacatcctggacattcatcatttttcctctcctatttttacattgtgaacacctactcatatgtatagattttgttcagatgtgttcatcattttaaaggccatagccttcataaccaccttttaggcctagagaattgattacattctgctctgtcccataactatatcctgtgttttcatatattaaaatacacatgaaaatattacaattaattcattctaaggcagagtttattcaatcatctgtatatttctagaacattgtacaacttctaaattttaaatattttgtatcattcattttccaaagaaatttagaaggcttgatagcatgtatgttttttaaagaaataattgctgtagaggataacataggacatgtaaaataagataaagctaggagtcagattaatatttaaaatgcatgtaatatgccttaaatattttctactttatggatattcattaattaataaaagccaagagttttctaaattaccagaggagggcttcagtttgggcctaagtatcgtagcagcctacaaaaagaaggaggcttagtcagctatgtgattttcattgtcattgaaagaaatggtctcagactgtcagcagctaaataattatttttgctagtaaggcctgaacgcatttcaccctggtccattttaagagtagatgatactcttatttaaaacctattgagcaatagcctcaacaacaacctttcagtaatgcccataagaccatgtcttataacttttgttattgtagtgaaaaggaataataccactggtaattcagtaaaagtaattctatgctggtgaaggtgaggaggaaaaaatgatctctgaatgtactgccttctaattctcaatatttagtccaaagaaaacatgtaaacttgtacaggaatgtatgtatttttatatttgtcccacttattgtagtgaatattaaggaatggaataaattcataaattaaaaaatacaataatctatagcacagcatctattggaagatacatacccaagcagcagacaagaagttgagttgtagaattttctcagttgtataagcagactcagtgatgtgcagggccaaggttgagtgtaaagaatgcctggagtatatggttaaaaaatcattctgaatagagtggctttcttgtcctatagaaccatgtgaacacagggtgagaaacagacaaggggtttgtaaatggagagctcttgcctctggagctatcacaagctctggatcctggtctgaatgaaaatgaggcatctcctagagtctcgtgaaaaacaggtataacagctgggttttcatatttaggcccagagatctggtaatttaagactttgcaagaggataagattgaagctttcaataaaaaatatttttctgtaagaactggattcaggcagaaaatggagcctaagttaaaggcatttattttctgtggatataccaaagaataaagaagtaggtaaagcagaggcccacaaaactgtgggagcttgaggaaagcaaataaacaagaaaaatcagtaaaatacatagtacatttatgtattagtctgttttcacactgctgataaagacatacctgagactgggaagaaaaagaggtttaattggacttacagttccacatggctgaggaggcctcagaatcatggtgggtgctgaaaggcacttcttacttagcagtggcaagagaaaatgaggaaggtgccaaagcagaaacccctaataaaaccatcagatctcatgagacttattcactaccattagaacagtatgggggaaccacccccatgatgcaaattatctcccaccaggtctctcctagaacatgtgggaattatgggagtacaattcaagatgagatttgggtggggacacacagccaaaccatatcactctacccctggctcctccaaatctcacgtcctcacatttcaaaaccaatcatgccttctcaacagtcccccaaagtcttaactcatctcagcattaacccaaaagtccacagtccaaagtctcatctgagacaagcaaagtcccttctgcctatgagcctgtaaaatcaaaagcaagctacttcttagatacagtgggggtacaggtattggctaaatactgctgttccaaatgggagaaattcgtcaaaacaaagtggttattgggcccatgccagtctgaattccagtgaggaagtcaaattttaaaatgtcaagatgatctcctttgactccaagtctcacattcaggtcatgctgatataagaggtgggttcccatggtcttgggcagctccacccctgtggctttgcagggtacagcctccctcctggctgctttcacaggctagcattgagtatctatggtttttccaggggcacagtgcaagctgtcagtggatctaccatgctggggtctggaggacggtggccctcctctcacaactccactaggcagtgcccccgtagggactctgcatgggggctcagaccccacatttcccttctgcactgccctagtagaggttttccatgggcatcccacccctgcagcaaacttctgcctggacatccaggtgtttctatacatcttctgaaatctaggcagaggttcccaaactccaattcttgatttcccttcactcacagctcaacaccacatggaaactgccaaggcttggagcttgcaccctctgcaagccatggcccaagctctacgttggcccctttcatccgcagctggaacagctgggatgcagggcaccgagtccctagactgcaaacagcatggggaccctggccctggtccacgaaaccattttctcctaggcctctgggtctgtgatgggaggggctgccatgaaaacctctgacatgccctggacatattgtcctcattgtcttggggattaattccgctccttgttacttatgcaaatctctgcagctggcttgactctctccccagaaaatggatttttcttttctatcacattgtcattttttgaacgtttatgctctgcttcccttataaaactgaatgttttttaacagcacccaagtcacctgctgaatgtttcgctgcttagaaatttcttgctccatatactctaaatcatctctctcaagttcaaagttccacacatctctagggcaggggcaaagtgtctttgctaaaacataatagcctctttgctaaaacataacaagagtcacctttgttccagttccccacaagttcctcatctccacctgagaccacctcagcctgaaccttattgtccatatcactatcaggcttttggtcaaagccattcaagtctctgggaagttctaaattttcccacatgttcctgtcttcatcttagccctccaaactgttccaacctctgcctgttacccagttccaaagtcggttccacatttttggttaccttgtcagcaacgtcccactctactgataccaatttactgtatcagtctgttttaaagctactgataaagacatactggagactgggaagaaaaagaggtttaattggacttacatagttccacatggctggggaggcctcagaatcatggcaagaggagaggggaacttcttacatagtggcagcaagagaaaatgaggaagatgcaaaagcggaaacccataatgagaccatcagatatcaagagacttattcactaccattagaatagtatgggggaaaccatccccatgatgcaaattatctcccacttggtccctcccacaacatgtgggaattatggaagtacaattcaagatgagatttgggtggggacacagagccaaaccatatcaattaataaggataaattttgcaaaaaaaaaaaaaaaaaaaaacaaagtaggtaaagggcatagtgttagggatgagactggaatttagataggcctctcttctctgatgtgtctttctgtaaaggtctaaatgaagggaaggggccttgtcattggttttctgggaaagaacatttcaggaagaaagatagcaagagcaagtccttatgtggctagagtagaaggaaatgagatgagtagaaggagaagaagtcagagtggtaactcggtgggtggtaggcagattgggcagtgctttatttcgttgttagggtcttgttgttagggtttttaggtcttactgtgagaaatgagaaaccattggagagttttgagcagacaagtggcataaaaaggattcttcaggtttctgtattgaaaatagattatagaaagcaaaagcattagaatgaagaccagtctggaagctacttgtacaattcagatttaatgcttggaatttggtccactaacatgattttgtgaaatatcctattgtgatgatcaaaagactcgatggatttgacatttcactggtaaaagaagataagacatatgatttttacagtttattttatgggagcaaattgtttattcattaaattcatttatgtcatgcatctatccaaaaaaaaattatgtggttggggatatgctatttctcaaggttatgtgataatatcttccagcatagtcagatattttatacgtataataactcgggcaaaattcaaaagcaaatagtttaccatgttatgaaataaagcttctgtaagaaaatattcaaattaaatgtccagtggcaaatggcacatacaatccactggcatacatctttcttaatatttataaaacttgaagaagtgtttgaattatctacttaaaacaggattttagggaattcaatattgtgtttcattcatcaaatcattgattcaacagctgtttattgggagtctctgtgtgcaaagcagcatgctaggctttggggaaatagcagcaaatttaaaaatttcctgccccctatgtattacattctattggcagggagagagacaataaataagtgctatataattccttagatggtagtaagtactatgaagaaaaataaagcagggaaggatggcagggagagggcaaatgttgggaagataaattttaaaggggttataagcgatgcccaccctccaagataaggtgaagttagagaaaatgtcttcactgaagtcatgggcaagccatgggaatatcctagtagcagaggcagagaatgtgcctagatgttctgaaggaagcatgcttggtgtgtttgagaaacacaggaagatgctgggttgagttgtctagcacattgtaatcaactttgagatgaataaataaatttcctgtcttgaaatatcttagcacctacgctaaattccaaatatcttaccagcaacagacaggaaggtcttatgtgctttggcctctcatacttcagagacctttatttttaaccttccccactctatgtcccacccccacctccctgccacattcacccttagctccttgagcaagtcatgtccacctcagcagcctttctatgcaccaataatgaaccagctggaaaagaaatcacgaaagcaatcgcatatacaatagaaacaaaataataaataaatggataagatacctaagaataaccaatgaggtaaaaaatttttacaatagaaacctcaaaacactgatgaaagaaattgaacaggacacaaaaaatggaaagacatctcatgctcatggatgggaagaattaatattgttaaaatggccgtaatacccaaagtgacctacagatttaatgcagtctctatcaaaataccaattacattattcacagaaatagaaaaaataatcctaaaattgcagagaacacaaaagagcctaaatagccaaaataattctgaccaaaaagaacaaagctgaaggcatcatactacctgactgcaaaatatactacaaagctatagtaacaatgacagcttgatattggtataaaaccagacacattagaaaaatgaaacagcttagagagcctggaaattaatccacatatttacagccaactgattttcaacaaaggcacccagaacatacaatagggaaagggcatcctcttcaataaacagtgctgggcaaataatatccatttgtgaagaataaaactagacttctatctcaccacatataaaaatcaactcaaaatggattaaaggcttaaatataagacttaaatctataaaactactagaagaaacataagagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaaaaaaaaaaatctaaaaatagaactgccatataactcagcaatcccactactggttatttattcaaaggaagtaaaagcagtatatcaaagtgataactgtactcctatgtttaatgcatcactattcacaataaatcaacctaaatgtccatcaatagatgaatggataaagaaaatgtatatatacacaatggaatactattcagccataaaaaagaatgaaatcctattattcacagcaacatgtatgagcctggaggacgttatgtaaagtgaaataaataagtcaggcacagaaagacaaatggtgcacattctctctcatgtgggagctaaaaaaacgttgagcacatagaaatagggagcagaattatggttattacaggctgagaaggggagggagaggatagaaagaaatggtacaaattacagctagaagaggaataagttcttgtgctccatagcactgcagaatgaatataattaacaataatttgctgtaagtttcaaaaatctagaagataggattttgaatattcccaacacaaagaaatgataaatgcttgacgtggtgaatatgctaattaccctgatttgctcacttactgtatacttatatattgcagtatcactctgtagcacataaatatgtacaattattatgaatcaactaaagataaaagagaaaataattcagttgaagatgagtaagcaactgacccaggtgaccatggagctctacacaatgcatccatccaagaagaggtaatagttctggcacaaggcatgggagaccttagtctggaggttcactctttttctgtgctgttctgcacatcattctccttttgaactccacctgccctgtttggggcatttaaaggagacatctagagtccctctgcaagaaaactcattgcaaagttattacaaatattcttagagctttcttggccatcgtgcaaatatttttcaggtttgtgtgtttctctatttctttcttgggttcagtctccctctgtgatctcactgaacttctttaaactactcaggcagtggctattctttccttaacgctgaaatctacctctctcattcgacgagaattcataatacctatatatagtgctgtcctctcagctccttttgtttgtgattcttggttgattctagattgctaaacaaaggaagagtatagtattttggagtgaaggcaggaacacttggatatagtcactgattacttcaggaaaccaaccaagatcattctttttttttgtctttttttttcctttttttaattattattatactttaagttttagggtacatgtgcacaatgtgcaggttagttacatatgtatacatgtgccatgctggtgtgctgcacccattaactcatcatttagcattaggtatatctcctaatgctatccctccctcctcccccccaccacacaacagtccccagagtgtgatgttccccttcctatgtccatgtgttctcattgttcaattcccatctatgagtgagaacatgcggtgtttgtttttttatccaaaatcaatgtacaaaaatcacaagcattcttatacaccaaaaacagacaaacagagagccaaatcatgagtgaactcacattcacaattgcttcaaagagaataaaatacttaggaatccaacttacaagggaagtgaaggacctcttcaaggacaactacaaaccactgctcaatgaaataaaagaggatacaaagaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggagccaaaaaagagcccgcatcgccaagtcaatcctaagccaaaagaataaagctggaggcatcacgctacctgacttcaaactatactacaaggctacagtaaccaaaacagcatggtactggtatcaaaacagagacatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagttgaaactggatcccttccttacaccttatacaaaaattaattcaagatggattaaagacttaaacgttagaccaagatcattcttgatgtgggcttgtacttactttactttgtgcgagtgccctcactttctaccctcaaaccctcatacagccagaagtgctgtatcaaggctaagggtttaaagaaacttgcatgaaaacaggccttttatttcaactcataaagattggagggttttcacaaactgtacattaaaggtatctcaaatatgccttaatatttttatgtaatctaaattctaagtgtttttctaatataataattttatgactcagtgaaaccaaaatcataccttttacttatacaaatacaatgcaagaagatatttgagcttaattttattagattttggttgtatgtaattctgctgcatgaaattaatacatacatattctatggtaacagaacattgtgactaatagcctttttatgaattcaaatagttctattgaatagatagacacaggtcaatgagactacaatataacgatagtaatttattttattccactagttacggaaatagtgataaactattctacataagaacttatattctgacttctcttcagatcatataaatctattactttttactgaagattttctaggagaggaacaactcatttcagcaaacaaaacaaaacaaaagtcttaactagagataacaagagaatttttacaaaataatcccaaatttgaaaggtggaaataattaaaaatttgcttttgtaagaattcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtagttttagtagagacagggtttcaccgtgttagccagaatggtctcgatctcctgacctcgtgatccgcccgcctcggcctcccaaagtgctgggattacaggcgtgagccaccacgcccggccaagaattcttttactagatctacaaaacaatcattaaaagtatatcaaccagaatttattatccatatttccaaataaagacagtaagtttcagagatggtaaatgtaaatattaaataaactgtccaagatcatgtggggacatttatgcagagccagaatgagaagccaaccaagtcttcttgcttctacactttccacttcctacttagtgatgtaagaactattgagtcctcctgttccaccccctctcataaaaacacttcagtacatttctttaaaaaaaaagtgattaccatcaatctggcacctgtaatatatttgattttcaaaactaaagtcattttcaatagaaacaagtttttgttttgttttgtttgagacagagtctcactctgcccaggctggaatgcagtggcacgatcacagctcactgcaacttccacctcccgggctcaagtaatcctcccaccttggcctcccagtagctatgactacaggcacacaccacttcactaggctaatttttgtattttttctagagacgaggtttcacagtgttgcccaggatagtcttgaactcctgagctcaagcaatctccctgccttggcctcccaaaatgctgggattacaggcatgtgccacggtgccctgccaatagttacaagctcttatgtttctatagttatgtaaagtctgaaaaatgccaagaatgcacatgaagagcatgtaatacgtgtaatgaaaccattataggaaatactatgtgttgctaaatataatgcttattatttgcaaattataattttggttgtcccaaacttgatgattatttgtatatttttcataaactgcaaaaagaattttcagaggacttagtgacaaacaaaaggtatgatataaagcacacaaaaacatattctccatggaaagaaaagttggaattgagaggcctaggagaggcagcctccatgtattgatgaaattacagttaaattagaaagcagagaacaattgagtaggtttgaaaaatgagaaacagttagcaaaaaaaaaaaaaaaaatacacacacgcacacatatatgtatgataagaagttttaaaaatgattaaaagaggtatccatgaagagatgaacacaatttgaatatgcacttagcacataaggatgtacaatcaatatgcaacatagtgttttgaatcctaactgataataaaataactacaaaatcctgcaaactcataatatttagctaggttattctgtaaactgtattttactgataattaaaagtaattttagtgagaataatagtgtgtattttatattatcaataatttgttttccttgcttatttctctttgctgcaaaatgggttagtaaaatactttgggcgtcagttaatgtacacttgaaaatgcttttagttttattctgaaaaagaaatgatatcaatatacatttataaatgttatgaatagttatacactttctgattaaacaataaaatccaacatctttagctttctaaatggtgctttttcttgtacgtatctatatttaatttttgtaagaaatatttgctatataagagagaaactatgagacatttatgtaatttataaataataaaaattaaacaaatagctgagaaactctgcctataattagatcaaaattatttttgtaaattatatggctcttcaaaatatttcttcctcgcttccttactttcctggaaatagtgtgctttcccacccctagaatttctgtttgtgcatttgacttgttttggccagtggatattaaccaatatcaagcattccaaggcttgctatgtgcattcggtgtagagcttgctgtcctgtgtttcctcaatgttaaaaatagccattgagtagttactgtgccttcagactcagccccagaatgtacctgtgtaggacagagttgctctagcagacctgaattgagaagcaattctaccccgactaccacagcctgaagctaagtggcccagctgacctacaaatcataaacaatacccccaaaaaacaaattatcatgttaaatcactgaaatttgaagtcatttgttcacaatagacttcaaatttcaaatagctaatcaatagatttaatcatttataggatagaaatcacctacctatttgacccattcccctacttagcacctagagacaatcaatcaacctgaacattttgaatggcactatctgtttttctaaacataattttatgtcacatacatgtattcacatatataatgatatatatagtatatctgaatattttatttttacttcattaagatatgtcagaatgtatatggtcatctgagtcttattttttcctcaatatagtgtctctacattttatccacattgttatgtgcagctgtagtatattcattttcactgctctataatatccattatgtgacttttcccacatattatttatccatgtttgttactaacatgttatttcgatgattttcattgtttgctaatacaaacaatgctccaaggagcattctgcatatctggagattgtatatgttgaagcacatgtgtaaacgtttctctagggcatcagttctcaaacttttggcctgaggatctgtatttgttaaggtttgccagagaaatataatagaacgaatatgtgtgtgtgtgtctgtgtgtctgtgtgtgtgtgtgtgtctgtatgttgatgtgtatatatacatatgtattgtgtgtatctctctgtgtgtgtatatatatgtacatgtacatatatgtatatgtacatgtacatatatgtatatgtacatgtacatatatgtatatgtacatgtacatatatgtatatgtacatatggatatatatgcatacacatacatgtgtgtatgcatatatatacaaagagatacatgcagagacagagataaagagagagagaacagactctctttggctcacatgattgtggggactgttaagtccaaaatttgtagggcaggtgagcaggctggggatccagggaagagtagatgtctgattttgcagcttaaatctgaaggaattccatcttatttggggaccttagtgtttcccttttaaggccttcaactgattggaagaagcccactcatgttgtagagaataatcagctttactcaacatctactgatttatgtgtttatttcacctaaaacatacctccacagagatatttagactgatgtttgaccaaacattgtggtagcatagcttagtaaaactgacgcataaaattagctatcaccatacccctttattaccttaaagattattaagtaccctaaagagatttggttaggggcttatatctattgatgcttattgtattataaattaaaacttagaaatcttaaagatatttattaatttaaataactatagaaagttcattgcatgttaactaaacattttaatgcaaaatcaatataatgcctaaaacaaaaaaattaatgaaaagtgtgacattattttatacttctgtaaaaatctttgtggcacctggctcaataaattgccagtagaggaaaatttttctgttcttgtcaaccttagcagaaatttatttattttattactcttcaaagaaccattttggtctttgttgatcttccattctattattctatcatatatatagtatacgctttctaacctcaaaatatatgcacagcacaatgattttaagtctgttctcttttcattataaccagttaaaattaaattcccttcaaaatactgatttgacttcatgtcagagttttgatgtgttgccattcagttctattttaaaacatttcttctcttatgtatgttatttaaaactgttttaaaatttgcacaaatatactttatcagcatatttgtatactgatcgatgagtgatattgatctttatttcataagcttgttggccacatgtatgtcttcttttggaaagagtctgttcttgttatttgcccattttaatggagttgtttgttttttgcttgtaaatttgtttattttccttacagatgctggatattagaactttgtcaaacacatagtttgtaaatattttgtcctattctgtagtgtattagcctattctcacactgctgataaagaaatacccgagactaggtattttataaaggaaagaggtttaatgactcacagttccacatggctggggaggcctcataatcacggcagaaggtgaatgagaatcaaagtcacgtcttacatggtggaggccaagagggcatgtgcaggggaactccccccacctcttttttttttttaattatactttaatttctgggatacatgtgcagaatgtgcaggtttattacataggtatacatgtgccatggtggtttgctgcacccatcaacccatcatctacattaggtatttcttctaatgctatccctcccctagtcccccacccctcagcaggccccagtgtgtgatcttcccctccctgcgtccatgtgttctcattgttcacctcccacttatgagtgagaacatgcggtgtttggttttctgttcctgttttagtgtgctgagaatgatggtttccagcttcatccttgtccttgcaaaggacatgaactcatactttttatggctgcatagtattccatggtgtatatgtgccacattttctttatctagtctctcattgactggtatttgggttggttccaagtctttgctattgtgaatagtgctgcaataaacatacatgtgcatgtatctttatagtaaaatgatttataatcctttgggtatatgcccagtaacgggattgctgagtcaaatggtatttctggttctgaggaatcgccacactgtctttcacaatggttgaactaatttacacacccatcaacagtgtaaaagccttcctatttcttcacatcctctccagcatctgttgtttcctgactttttaatgatccccattctaactggcatgagatggtatctcatagtggtttagatttgcatttctctaatgaccagtgatgacgagctttttttcatgtttgttggctgcataaatatcttcttttgagaaatgtctgttcatattcttcacctactttttgatggggttgttttgttttcttgtaaatttaagttccttgtagattctggatattaatcctttgtcagatggatagattgcaaaaattttctcccattctgtaggttgcctgttcactctgatgatagtttcttttgttgtgcagaagctctttagtttaattagatcctattagtctattttggcttttgttgccattgcttttggtgttttagtcatgaagtctttgcccatgcctgtgtcctggatggtattgcctaggttttcttctagggtttttatggttttaggttttacgtttaagtctttaatccatcatgagttaatttttgtataaggtgtaaggaagggatccagtttcacttctctgcatatggctagccagttttcccaacatcatttattaaatagggaattctttccccattgcctgtttttctcaggtttgtcaaagatcagatggttgtagacgtgtggcattatttctgaggcctctgttctgttccattggtctgtatatctgttttgataacagtaccatgctctttgggttactgtagccttgtagtatattttgaagtcaggtagtgtgatgcctccagctttgaaattccctttataaaaccttcagatcttgtgagacattcactatcttgagaacagcacaagaaaaacctgcaaccatgatttaattacttcccacctgctccccccatgacacatggggattatcacaattcaatgtgagatttgggtggacacacagccaaaccatatcatataggttgtctgattactctgctgacagtttcttttgctgttgagaagctcttaagtttaattaggtcacacttgtcaatttttgtttttgttacaattgcttttggcatttttgtcacgaaatctgtgctaaatcctacatccagagtgatatttcctaggttatcttccagggtgtttagaattttatgtttcacatttaagcctttaatccaccttgagtttatttttgtatgtggtataagggaggggtccagtgtcaatcttttgcatctggctagcacattttattgaatagggaatactttccccattgcttgtttttgttaggattgttgaaaatcaagttgaacatgtgtggcattatttctgggctccctattctgttccattggtctgtgtgtctgtttttgcaccagtaccatgctgttttggttactgtagtctagtagtacagtttagtcaagtaatgtgatgcctccagctttgctattttttcttaagattgccttagctatttgggctctttttttggttctataggaattttaaaatattttctaattctgtgaagaatatcattggtactttgatagaaatagcattgaatctataaactgctttgggcagtatggccattttaataatattgattcttcctatccatgagcatggaagatttttccagttgtctgtgtcacctctgatttctttgagcagtgttttgtagttcttgttgtagagacgtttcatttcctgggttggctgtattcctaggtattttattctttttgtggcaattgtgaatgtgactgtattcgtgatttcactctcagcttagatgttgttggtatatagaaatgctagtgatttttgtacatcgattttgtatcctgagactttgctgaagttgtttgtcagatcagggaacttttgggccaagattatggggttttcaagatatagaaatacatcatctggaaacagggatagtttgacttcctctcttcttatatggatgccttttctttctttttctttcctgattgctatggctggaactttgaatattttgtagagtagggatggtgaagaaggcatacttgactggtgctggttttcaaagggaagacttccagcttttgcccattcagtatgatgttggttgtgggtttgtcatagatggctcttattattttgaagtgtgttcttttgatgcctaatttattgagggttgttaatgtgaagatgtattttatcaaaagacttttctgcatctattgagataatcatctggtttttctttttagttctgtttatgtgatgaatcatatttattgatttgtgtatgttcaaccgagcttacatcccagggataaagcctacttggtcatgatggattagttttttgatgtgctgctggaattgattggcaattattttgttgaggttttttgtatcagtgttcatcaaagatattggcctgaaattttattttttgttgtatctctgacatgtttttgtgtcaggaaaatagtggcctcataaaatgagttgagaaggaatctctcctcctcaattttttggaacagtttcagtaagagtgataggagctcttcattgtatacatatggtagaatttggctatgaatctatctggtcctgggtttttttctggttgataggctgatatggtttggctgtgtcctcatccaaatctcatcttgaattatagctcccataatttccatgtgttgtgggagggacctggtgggaggtaattgaattaaggcaggacttgcctgtgctgttcttttgttagtgaataagtctcatgagatctgatggttttataaaggggagtttccctgcacaaattctctcttgtctcctgccatgtaagacatgccttttaccttccaccatgactgtgaggcctccccagccatgtggaactgtgagtctattaaatctctttttctttataaatacccagtctcaagtatgtctttatcagcagcatgaaaatggactaatacatagactttttattactgattcagttttgtaactcattttttttgtctgtgcagggattcattttttttcctgggttcagtcttgggagggtgtatgtgtccaggaatttttccatttttttctagattttttagtttgtgcatagaagtattcgtaatagtctctgatggttatttgtatttctgtgggttcagtggtaatgtcaggatcagtgtaatgccctttgtaatttctaattgtttttatttggatcttctttcttctttatcattctagctagcagtctctcttatttactttttcaaataaccattgattatttggattaattaatcttttgagtgatttttcatatctcaatgtccttagttcatctctgattttggttatttcttttgtgagttttggggtcagtttaatcttggttttgtatcttattaagttttttaaattaccattgattatttggattcattgatttttttcagtggttttttcatatctcaatctccttagttcatctctgattttgcttatttcttctgttagtttttgggttcagtttactcttggttctctagtccatttagttgtgatgttaggttgataaattgagatctttctaactttttgatgtgggcatttagtgctataaattttcctgttaacactgccttagctgtgtcccagaaattttggtatgttgtgtcttggttctcattagtttcaaataacttcttacttcttgatttctgctttaatttcattatttactcaaaagccattcaagtgcagctattcaatttccatgtaattgtatgtttttcagtgattatttcagtcttgatatgtaattttattgtgctgtgatgcaagagagtagttgatatgattatagttctcttgcatttgctgaggattgttctgtgtctcattatgtggtagagtttagagtatgtgcatgtggcaatgagaagagtgtatattctatttgttttgggaggggagagttctgtagatatctatcaggtccttttgatccagtgctcagttcaggtcctgaatatttttgttaattttctgactcaatgatctaatactgtcagtagggtgttgcagtctccactattattttgtaggagtctaagtctctttgaaggtctttaagaacttgctttatgactctggttgcttctgtgttgaatgcatatatatttagaatagttaggtcttctcatcgaattgaaatctttgccagtatgtaatgctccccttttttcgtctctatctgtttaaagtctattttgtctaaaattaggatagtaacccctgcttttctctgttttccatatgcttggtagatttttctccatccttttatttttgagcctctgagtgttactgcatatgaaacaggtctcttgaagacagcataccaatgaatcttggttctttatccaatttgccactctgtgccttttaattagggcatttagcccatttacatttaaagttattgttgatatgtgtgaatgtgatcctgtcatcatgatgttagcttgttatgcaagcttgtttgtgcggttgctttatagtgtcactggtctgtatactggcaggttaggatgcatgcacacacacgttggcatgggggaaggtaaaacccacccacgtacacacatgttggcaatgtgatatatgtggtggctctgggcctggaggaagctgcagtgggggtagggaataggcaggctggtgtgtggccatgggggctgccccattggacctctctgccagtcaggcacagttcaccactgcaggagctattatgtgggctcccagagcacctgcttgttctacaagcaggcatggccaggctggggccctggaagaggccagcagaccaaggggtgctcaagtcagactagccccatctgatgggcaagaccaccatgcagagttcaagtctgagagtttccctagggataatgtctcctgtggtagcatgtcgagcctacagggatggacatctcttgtcatactctgccacgagtgcttaggcaccaaatccttttggctctgcatcagctggcatgctgcccctaccaattctctaagcagctctttgttccaactcaagtatccgtcatagtttaggggtctcctcctgccaagattccagaggcctgtggcaagagtaggttgatccttgtcagttcaattcacccattcctttggagttgttggagggtaggaattagtcccctgcctggtagcctcctgtagggttcccagcttcctcccacttgagcacagcttttgtatcttccctccatccactctcacaggcttccctctgaagctctgtcaggagtgtgccaattttcttggtcccttggtggcagttgttccacctggttgtgtcaagttggccatcttctacttaatcaggtcttcttgttgaattgaaactattgccattatatagtgctcttctttagcttatttggtctttgttggtttaaagtctgttttgtctaaaactaggattgcaacccctgcatttttgtgtttgttgttgttgttgttgtggtggtggtttacttggttgatttttccccattcctttattttgagcctatggatgtcattgtatgtgagatgggtctcttgaagacagcatactattgggtcttccttctttgttcagcttgccattctgtgtattttaattgggggattaagctgtttacattcaaggttactattcatatgtacgaatttgatcctgtcatcatattgttagctggttattatgcagacttgtctgtgtggttgctttatagtgtcactggtttgtgtacttaagtgtatttttgtagtggctgataatgatctttctttttcacatttagcactcctttcaggaccacttgtaaggcagttctggtggtaatgaattcattcagcatttgcttgtttgaaaatgatcttatttctccttcacttatgaagcttggttgggctggatatgaaattcttgtttcaaatattattttaagaatcctgaatataagcactcaatgtcttctggcttgaagagtttctgctgaaaagtccagcctgatgggattccttttgtatgtgacctgtctcttctctctaattgccttttacattttttcattcatttggaccttggagaatctgatgattatgtgtcttggagatggtcttcatgtataatatctcacaggagttatatgcatttcatggatttgaatgttggtctctctagcaatgttagaaagttttcatgtacaatatcctgatatatgttttccaagttgcttactttccccctgtctctttcagggacaccaatgagtcatagttttcatctatttacataatcctatatcttttggagattttgctccttccttttaaattcttttttctttatttttgtctgactgagttatttcagagagccagaatttgagctcttagattctatcctcagtttcttctatcctgctgtttatacttgtgatttaattatgcaattcttgtagtatgtttcttatctctattagatgagtttggttccttttttataatggctattttgactatcagctcctgtatcattttactgtgattcttagcttccttggattgggttttgctgtttccctgtatcttgatgatccttgttcctgttcatattctgaattctatttctctcatttcagatatttcagcctggttaagaactcttgctggggaaatagtatgattatttagaggaaagaaggtactctggcttttcaagttgtcagagttctttcactggctttttctaatttgtgtgggctgatgttccttcagtctttaaagtttctgtcctttcaattgatttttttgtttttttcttcattgatgcccttggggattttattatgttataattgagtttggttgactggctttgattctagtacactactgggtcttggtggcaccctctatgattactgtctgcatgcccgcatttcttctgttgggctttctgatctattgagtttcctcaggcaagggctgcggttgacagacaagctgtattcttgccaggttggccttaatttgatgtccatgtgctccctggggaaacatggggttgcacttgcctgcagagttcaggcagaagtgggacctctgggttggaagctctagcaggtgtggtccatctggctatgggaggcaggggtgagtggagttgcctaccctgacctcctggtgtttccagggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcagggtcagtgggatcacatgccttactgtccaggtgtttcctgggacaacaggaggcttgtgctcctcagctgagttccctctgaagcaggaccactgagccagaaactctatcatgtgtcgcttgcctggctatgagtagcagggatggatggggttgtctgccctaccagctgggtgttttcagggcagcaagaggctgtgccctccagctgagttcaacaaaagtaggactgctgggcgggaagctctagcacacattgatcacctggcaaccagtgatgagggcaggtgaggtcacatggtgctgtgctctctgggtgtttcccagggcaacaggaagctgcaccttccagctgagctcacatagaggtgggatgactgggctggaggctctagcagttgttgcccacctggctgtccatggcaaaagtgggtggggtcatgtgcagcctcctgccacctgagtgtttcccgggacatcaggaggctgtatcctgcagctgaatttacacagaagtggaacaactgggctggaagctctagtaagcattgcctgcctgcctagcagtggtgggggtgggtggagtggcaggccaaattcaggctgaagtgggactgatgggctagaagctggtgctgagccccatctggcaagggggtgggtggagcaatcttactgctcccaggcactgcaactatgcctttattcaggtgatggcactggtgctggtctgctctggggttaaaggcttgtagtccccttggacttgatagttgcccctgcaaaatgtctggatggctctctccctcagtttggaagcacagctgggggccaggcagattttcctactcccagtcttgtacaggtctctgcagagagcatgaatctcctggggagctctcactctctcaccctttcccatttttgtagaggttcttctgcgccacattgatcccagacagatagctttgctcctctctgttctctgtgttctcctgctgccttcatggatcccagcatggtttctcagatgattggcctgcagggtcagtgttgactagccttttagttcctctctgtgagagcagcacatacaagctgcttctcgtctgccatcttggccctatccctcatctttattttcatttcctttggcctaggtaactttttttggtactttttcattttgctttgctttgctttgctttgtttactctcaatctttgtatctccttagaagtttagtgtgcctcgtgtaaaaatcatatagctgaatttgtttctttttagccaaactgaaaaatctttgtcttttatgtcttttagcttccactttagtctatttgtgtttgttggatttgttcatatgtttgtatttctatctaaaaacttatttttaaaattcattttctatttgtatcatttattctagtgcttttttcctcctttcctattttcttttagatatattagatgtttataattgtaagtttttcttacccatttctttttttcttatactggtttggaagtcatatgctctattactattcttatagtgctcactcttaacattttaccatgctgactgaatttagtaaagcctaaattgatcaaggttttacttctcttcttaatagcacatgaactttattaatactatatcattattgtttttttttatttttacaagcatttttgttttatttttgcaagcattttatttatctacacaaatatttctatatacttacatgtttaccaaattgtttgctcactatttcttccctttcagatcttctgtccctaaaatatatccttagtaatttctgtaggagaggactgctttgtttagttggaacattaatacttgttcttgtttcttttcttccttttttttttttttgaggtggagtcttgctgtgttgcctaggctggagtgcagtgtcacaatcttggctcactgcaacctctgcctcctgggttcaggcaattctcctgcctcagccttccaagtagctggggctacatgtgtccactaccctatccggctaatttttgtatttttagtagggatatggtttcaccatgttggccaggctggtctcgaactcctgacctcaagtaatctgtctgccttggcctccgaaggttctggaattacagacatgggcctctatgcccagccttgttcttgttttgagagagatttttgataattccagagtaacattattttctattagctctttgaagaaatttcacccctgtgacttattttctctgtgatgttgtttaagtgttttagagataatgtagtcatcttatgagtcatagtgaagatcaaatatatataaagagcttattagtgtttctaacacatatttatcactatataaataaataaccttatttttcttttttccctcctttttttcttataattcttattattgccaatgctgctcagcaattcactaaaatgcatctaagtaaaaatttctttttattgacaccactgtttatcctgtttggtatacatttttctttccaaacatgtggttctaggtcttaaattttctagtttctgtacattctcaacccttaattctttgaatgttacatctatcttttatttccattctcttctggaattttgattaggaaaatatacttttttattgtatcctttataattttaaccacctatactgtgttcagttcctcatctgtctatagttgggataattttttcaaatatgtactttatttatttttattttttatttccataggtttttgcggaacaggtggtgtttggttacatgagtaagttctttagtggtgatttctgagattttggtgcacccatcacccaagcagtatgcactttacccaatctgtagtcttttacccctcgccccacttccattccaccctttcctccaagtccccaaagtccattgtatcattcttatgcctttgcagcctcgtagcttaactcccacctgtgagtgagaacatatcatgtttttcattttttttccggatttatttcccaattcatttactctgaattttgctgtttctcatatgctatttaacccatccattgatttcttaatttcaataattttatttttaaaatttctaaatatatatttttttcagatttgcagattcatgttataaccttacgtcgtttgatctttttattgtagctgttatttccttatatactttacttatagttatattttgtaccctttaattataacaactagtgtccttcagggtatttgttaattttattagctcatcctcagtcatggcttcttatttcccattatgtgtttgagaataattttgtaagctcatacttggttgaattttatttgcagaattttgagtagctaatttctaataacttgggctgtataccaacagcgtggatctacattattagtcagctcagtctgccataacaaaataacagagactgggtagctcaaataacagaaattaatttctcacactcctggagcctagaagtctaagaccagagtgccagcctgatcaggttctggtgagggcccccttcttgccttgtaaatggctgccttcttgctgtgtcctcacaatgcagggagcgagttaactccagtctctttctctgattataaaggcactaatcgtattacagggttcccgtgctcatgaccttgtctaaacctagttatttctcagaggccctacctccgaatactgccacattggaattagggcatcaatgtacggatctgggaaaggagtggcacagtcagtcagtccataacattcacttgtgctctttttgagagctttggttccttctatttgtgtggagcccagggaaactctgatcttttgcatctcttaaaacacacttttttgattttagtgtaccattctttttctctctcttgatttctctcagccctcagaaatggcctttattttttcatgaaccaaagttatacagttttccatatttcaggccatgtttttgaaaggcaaaaccatttcaaaagaatgttcagaaatttatatttgatatattttggatttagtatatgagctctgactctatatattaaaaacttatgggaatattgtttatatttattgttgactaaatatcagttacagcactcacaaagaaataatactgcttcattctagttgtaattattccagtgtgatttgttttttttgcctggcacatggtttaaaacacaaaataagcatataaaacttatatgagagggtttttcagccacaggcagaaacataccacaataatttttatcctatgctaagattttggtccataataacatgatacccattggaaagatagatttgagaaagaagcatgcttaaataatttttaaatttttttacatgcatgtttttggataagtgtattgttcaatctttaatattaaaaactaaaattctgaatgacaaacatatgtgcaaaccaactattgtggcaaaaacagtttttgttggtgaagggactagctgccatttggtgatttttcagatagtcaaatttgaaaaatcaattggatcttctcttctcttctcttttctctttttgagatggagtcgcagtcccccaggctggagtgcagtggcatgatctcggctcactgcaacctctgccttccgggttcaagtgatttcctgcctcagcctcccgagtagctgggattacaggcacacgccaccatgcctggctaattttttttttttttgtatttttagtagagacggggtttcaccatgttagccaggatggtctctatctcctgacctcatgatctgcccccctcgacctcccaaagtgctgggattacaggtgtgagccatcacacctggccccttggatattcttttctaactcaaatgagaatatcctcattatataatccaccttctctccagaaacttcaagctctttctctctaatggtggctgtttctacgctgcagatagaaattacatttccctcttagctgaaaaatacccaagcctatgagcaagaaaacaaaatattttttgattctactattccctctgtcagagatgccagaaactttttcttcttcatttatagcataatttcattcatgcttgcatgcatttctatatttacttactctaaagcatttactaagcactttaattggtcagtcatgaggcttggtgccgtagaaacagagatgaaatgcaattctccatcataaaacagtctggcagggaggaggaggataaataagtggtatattacaattcggtgagagaaagtacctaagagaacacatttaaaaagcatgcaatgcagaaggatgtgtagaagatgatggaagtaaaattttcttgcagctgatgttacacacacacacacacacacacacacacacacacacacaaaaccaactagatgtttctgttggtgtcattgacacctacccatttcttttcttttctttttttttttttttttttttttttttttttaagactgagtcttactctgttgcccaggctgcagtgcagtggtgcgatctgggctcactgaaacctctgtccccggggttcaagcaactctcctgcctcagcctctcgagtagctgggattacaggcgcacgccaccatgcccggctagtttttgtatttttagtagagacggggtttcaccttgttggccaggtttttctacaactcctgacctcaggcgattcgcctgcctcggccacccaaagtgctgggattacaggtgtgagccaccgtgcccgagcctgacgcctacccatttcttaaactagcttttgtgtccaccacttggaagccactgctttaagatctactgattaccgaaatgcaaaattgaatgagtcatgctcaaccacccagcacttaaacatctctttgatctctcatgatctaactcaaaggtatctcattcctgattcacttcttccttcatccaaactgcactcctgaagcatttaattaatctaaacataagcaatgctgacttactgtttcatattgtattatgtttttgaaactgatttagcccatgtctgaatctttattgttctgaagcccgatcatccagagcctaatatatacaacgctgaaccaaacaaacacatgataacaaaaacactaatttagtgaattaatctagaagaatctagcagaattaatctagaaactgcacagcagcagtttctctcttcagcttgaattactaagcaattcaagttagcaattgtgtagacccaaataagataataatatttagtcatttagatatgccactacaagtaaaaataaatcagatacatacacatacacacaaattactcatagaatgcagtattcataaaaattatgttactttttaaacaagctgtctttttatgtttttgcaaatagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaataggtaagaagtactttaaacattactaatcctctgtgctgatacatatacgtgggtaaagtggtaaagttcttttttttttttccttgatgctaccccagggaaacattaaaagaaactgttagttgataagattatagagagctacttaaataatctttgtgaaatccatttctaactccattaatctttgttgattaataatttctttctaaatgtaagtatcaagatcaagcctatgtaataagattagaattgcttcattggaaagctgtttgtttcaagcaggatagaaacaaatacttcttttaaagagttggatttttagttccgctttccacaggcttgttattgctctgtactattaaatgtaatagttcaacgaacgtaaatataacagaaataattattttctttatgcttaatttgttatgtcgtgatattcttgattaaatgtttcttgtcgattcacaaattgtaggaaatagtatactgtattgtatgtaaaatcctatacatatcatgtggatttggaagttttatgttttgattttaattcaaggtagacaaattcattatgtttcaaatattgaaattactatcacccatatatttttggatgctcattaccttctgttaggtttgcagatatgatacaaagaggtaaatttagctactatcaaatatgctaattccttcagctaaggggttatatatcatccatcaaactttctcagtagtctgtggtcctagctctggaaggacctccatccaccagaggaacacccataacagcagagaagtgccctctcctcggaggactgaggttccgttttgaaggtcctcccttcaagggtctaagttttaatattctaccttattccctgtgttcgctcagtcctaggggtggtagctctttcttgaagttgttatctccatgatattttaatgttcttttcccttttttagttacttagttagcaactttattcagtttttaccatcctgcatgtgaaattattattgttacaatgataggtgcaagttccgtttcctgacaagtccttgaaagatccagggcattagtggataaggagcataacccacctgagttataaagctatagctaaataaaattagcctgccccataggagaaaacatgactgtgaataacatattttagacctatgtctatctgaaatagtgacaatttcagatagcttttaattctcagatgggtacttactatttatctggaatatccaatcatttataattctttattatatttctataatgtgtgactggatttcataaatatttttataatagattaatggaattttagcactagtatttaatttgaattttgtatcacttttgacttggttgaggatcgtaatagaaaacagtgatcttttctaaaatgtaatatgtctttagaactcttaactacccagggtgtttaaaagcaaactatggttaaaaaactcagtagtctcagccctacttggaatgatttcaaacactttgacttgacaacttttctttatgaccctggtatctaaatactgacttccaattggtgcccagtaaatcttgatattacagatcaaaattgcttctgattgatgccaaaattctttaaacttcaagtttcccatcactgtcaagagttcactttcatcatcaaggacaaaataaattgtactaattttggcattgaggtggtggataagtattgacaaataaagtagaaattgattgtttctatagtggctattgatatacctttcagagtcacaatcaaagtaccaagctctaatttataattactctcagatcaatacaatatagatatgtctaaaactagtgtctttcttcaaaatttcatagattacttgaactggcttagttacttaaggcaagagattatttgccttggtaagatggatggtgctggagctatgtatgctgtgtcatatattcttggcttgatactgcatatatatatatatatatatatatatatatatatatatatatatatatatatttgttgttgttgttgttgttgttgtttttaagactgaatcttgttctgtcacccaggctagagtgcagtggcacaatctcagctcactgctctgcaacctctgctttctgggttcaagcagttaacctgcctcagcctcccgagtagctgggactataggcacgtgccaccacacctggctaatttttgtatttttagtagagacggggtttcaccatgttggccaggctggtctcaagcttctaagtgtttgagaaactcccaaagtgctggggttacaggcgtgaaccactgcgcctggccatgctgcatagttcttaataaataccaaatttatattggtagacagtattagtcaccagagaaggaagagtttagaatacattcttctcttttcacacccgtcctttccttcaagcttctggctcagtcttgaacagccttgattggtgttctatctctagctctgcagctgtttctgaattgggcaatacttggtaagaccatccatttagttcctcaccaaaaagttggatcactgtgaagcatcaacaatatagaaaatttcagatcaagattcatatttactgagtgctaatcagaatctatgaacaattatctatgacactcagtctgaataattccatactctacaaggtttctgtgaataattaacagtagcttttttattatcttctgaatgatcaggtatataaattgttatgtatttcacttaatggttgtttgaaaacacacacacacacacacacacacacacacacacacacacaccagtgtaacccagagagtgcttggcacatggtggtttacttacataaatgaataaagagtgattcaacaagtaaatatggcaaaagtattctaaatattctccctgacccatccacatttaaactacaatataattatgctgtcttatcctacacaaatcaataaaatgatgaaaatggggtagaaaaatcagaaaatagctataaaaaataatttgtatttctttagaggcatttagaggcatttgtatataacattaagcagtaagtattcatgaaatgacttaacaatgttggtctgtgttatagatctaagacaattctcatactcaaccattgccttcaatgagattacaagtaatttaaaatgcagcaattttaaagcaataagggaatatgcaatgcatctaccatttatatttataatatcagatcaggtattctagttgactcctggctgcttttcttccaaggtagctgggtatttgactgagcagttatatcacactgttactctgatatttggaaggcagaccatgtgcctgcttagcttgtagctcgaaggagaaggggtcggaaacagccaaaatgttactgaatgttgctattccagctgttttaacaaggtgttacacagacaagaattgggtggtttgtaccaaggatagtaggaaacagagggacttgcaaaattcaacagcttcttgacccctaatgttgggagataaatctgtggcccttatttctaagtgtattgtgtccaatactcttgtaattacatgggaagaggaaaataaagaaggtttaagaactgtgtttactttaatttgtggttactgtggcattgcgttgcctggaagcaactatattagaaacctaccaagtttttgagagaattgtattgacaaggaaactatgagcctatccttaaatcccgttgactcttcaaacagtgaaacagtcctcagagccccaaacttgcatccaaaaaaagtggacttgtatttttgcacagttcagaaggaaggcagagaccatagcaccaatctcaatatggccacagaggataatgaacaagaaggaacctacagtggaactaagccagaagctacaaagaacaatggggaaaggtgctcctctgggggacagccatggtccaatcaaggaactttcttcagtaccacggcaaagttcctcatgatgcctgcctagtttttcactatttggactagtgatgcttatatgtttcccatgtttccgttttctgtattacagtttatactgcagttattctgtccttacttcacaattgtgcattgtgttcatggtggtgatggtggtgggaagcagaaaacttgtattttgttttgttggttaccataatgcaagtgacactgctgaaccaaatgatgcagattgtgtgtcagccacagatcatgaactgtgagacatgcagtaactgaagaagagatctggggatgtttctttttttggttgtggagagaagaaagtcagtgaatattctaagtgtggaagaaaggatgacagatatttggtgagaaaaaggccaaactgtggcagagactgttagcttttcactagaatccactttttcctccttccatattagttaggcacttggctatatatctaaatgatatttattagcctcaattagttaagtatgtctgcatcactaagttctatacaatagaatattagttaaagtagcaggtactatttcctcattcttgcccccttgtggtggaatggaataccagtgacaatgaccacaataatcttagaagcctattattgaaactgaaagaacaattgtcaagctgcttgaagtaaagccacccctgttttgtaacttcagttaggctgcaacattctctggactctccagcaataagaaaatacacttccaggcctggtgcggtggctcatgcctgtaatcccagcagtttgggaggctgaggcaggccgatcacgaggtcaggagatcgagaccatcctggctaacacggtgaaaccctgtctctactgaaaatacaaaaaattacctgggcgtggtggcaggtgcctgtagtcccagctacttgggaggctgaggcagaaggatggcatgaacccagtgggcggagcttgcagtgagccgagatagcgccactgcactccagcctgggcaacagagtgagactccatctcaaaaaaaaaaaaaaaaaaaagacacttctatttggtttgagacattatatttccagtatatttgttacagtatttttgcttgcctagtctactataggcacccatgaatacttttcaggtgatatgtttttccctcatgacatattattaaggcaaccaagacaagctctgaagtgttctcaaattatttgaaggagtagtaatggaaattttctgctgataatagatggctagtctactccctcttttttcttcccttgccccttctttcttcccatctttattgtctatcgcaatgctgttggagtccatgaaatcctgcttgccaatagcaacatatgcaagttagtttgcatggaggtaatgcttgtaagactagttataaattataaaaacatgcaactgttgtaagtgtctccattagtaggacactgtttcaataatgaggatttcactgaaataatgaaaaacgccaaggatttaaattttatgttagcattgaccacatttactgataggaatgagttttgctcattgtagttaagctgatggaataaaaacagtaccttccacatggttgacctcacaggtttatttatttgcttatagatccaacaaatatgcattgagcacttacttcgttctatgccttattctagttactaagctataatagtgaaaaacttctgcccttatgtcattggcattctttcaggaggcagaaaataagccaaatgaaaaatgataataattaataattacatataatatttagagatgacaaattttgtagaggaaaactagagcacaggtgaaaagggatagcaggcattggaaagggttgcaattttaaacaggaaggtcgagaaaattcttgttataaagttgacatttggataacctgaataaggtgaatcagcaagccaagcagatacttgggaggagaatattccaagctcttctgatcaggaagctttcctatggtggtagcatgacccatgtgactgctaagcagcaaagaggccagcatgactggaataaagtgagcagatgagagaatggtaggggtaaggtagttaaatgagtatgtacatataatagagggccttataacccctgtcaattactttgacctttattctcaatgaaatgggaaaccattagtgggttttgagcagaagagtctcaatctgttttacactctaataagatgactctggctactgttttgagattagatggtggcagaggtggggtgaaagcttaaaagcaggtaaaagcagaaagaccaattggggaactattgtagcaatccaggccaaagatgtagaaggtttcagccatgagaatagtgaaagtcataaaaattgtattctggatagatttgaaagataaagacaacaggagtttctgaagtactgtgaattgtgagagaaagaggaaacaaatgacctgttacattttcatacacctgaaaggcaaaggctcattctccttatactgggacactaatataaacattataaaaggcttttccaaccaggtgtatcagctggtgatccagaagccatgacagaatgaggaatgccttctcattgttcatctaacatttccattaaagaaaatggaatgtttcccttctgcccacttcctagcatcacttcctttttattttaataattctgtagccaatcataacccctgtgctggatgagatgacagaaacagaagtctatttgtaaagaaaacagataaattaagaaagaggaaatatgaaatgttaagattgttatgatgaattaccttctgttaatgatatatactattattttgaaggggaaggcaaataatgcatgaaagtggactctaaaataaaagaaattttcttattacaaaaccaataatgataagatagcaccaaactagtaatacaatggagtttagtatttataacacaaaatgttccgttaatatattttatgttctttatgtttcatttgcaaagttggctatgctagcaaaggaggatatattgtataatattaatgggtttaaaacacgataatgtaagaagaagtattaagactcaagggcatggattattggtacattaatacctgtcttatattgccaagatccccactttgccttcttatacttgaaagggcacccaaggtatatattaatagactgccaaagtaatgcttaaaatataattatgttacagtataagaaatggtaagatacttaaattgacctcttgtgatcaatttctcctgttacaccaggataattaattattatatcttcttggattttcaagtacattcaaatgaattgtttccccttgacatatgggcttgaaatgatgtctgagtattacggagcatagacacataaataagcacaaaaaagtgaagaaaacagaatatagcatgtatttttttattttcctttcccccccaaaagtgcataattaataagcactattcaagaaatatctaccttatgaagaaaattgtattaaagccaaagttcagatttcatttagcaagttctgtcatgtttgaaaaattgagaatctctcacacattcaatatggctttgtatgtgtgaagaatggctcaagtaagtgtccactgcaataaacttgatgtgaacgttctttgataccaatatacatggatcaataataaaaaaggtaaatgtccttaggattttaaaattcatccctattcctttccacagcaaatgctattacatatcaatgaattgtataatttggatctgacatgctgtataatgtacactttctgtttgttatctcatacaccaaaaaagctatttattagaaataattagaatgagtataaatgaaactaaagatattctgataaaagcgaatatatatatatatattttataacatgatacatttctgctttattactgccaatcaaagcaagaactttaccatgttaaatatgcaacaccttttctccaactctgcacaaaataatctggtcaatgcataagtcttagtcctcctcaatgctgatgactaaaagggtttagtatatttctacactaatgtatggtaaaataaaatgatatgtagccatagtccatctgaggtaaaaaatgaaaatcacgtttgttttatatttaagatttacttgtacatgtatgtgtgtgtgtgtattctcacacatttatgtatatatacttatttgtattgatgaagtgagtttattcagctcaaaattaattttagagtggcaaaaactgtaattatttgactatcttaaatattttaaatttcaatcaaaatatttatttatgtgttatctatgactccaaaaccaagcttgttttaaaaccatttatttcagacaacaaccactattattatatccctaaaacattgtttttggaattattaaaataattttaatttaaataaaaatttaagatttgattcaattactgtggaaacaaatcaaatgtccaaggacatcaaatcaaaataaaagaagtaaactggttactaaatataaaaaatggcaagcaatacaattttggcagcattaaactaaatattttcttattgttaaacttactgttatatggaaaatcatttctatttagataataaagatgaggtttttttttctcttaaaggactaggaaatataattttgatagaaaatttaagtaatgtttcctcccattgtctgacatgagtttatgcaaaatcctaacacttaacaaagagagcagaacttgttaacttgtgttctgggtaaaaagaccataccatcttcagtcaaggaaccatggaataatctttggtctccacacaatctagaatgagccatgagggaagaaatacctccagcagaattccaccttctagaaaaatatcccttcctgattttttccatacttttatccttcactagatttgacaactaattactaaaaatcactactacttagaaactgattatttatttatctaatatttaccaactatgtaccaagtaatatagctggagctggggatatagcactgaatggaatggtccagacccttgcccttgtggagcttacattacagaaaaaagtgtcactggttacctgtgccttataaatcattagacaagctccctgacttggtcattgatcaaaagattaattcctttctgctagagatgacaagggggtatcactgagagtgactgtctttctcagatgtcatgtgtgaatcctagttctctattaacggaaagaattaaaaaccttcagagtaataagccaccaatgaggtgaaccttaaaaatggtgccaagccttcttatctttacaaagatgatttttgttttcacttgcattaggattcttttcaggtacctgtcacacataaaccacccaattaagatcatttgaagcggttttcacatgaaaagaaaactttcctgtgatggttctatttcagtttattttggggttattgtgtcagtttgctttttgttttaagtaaggaagaaaatagtgaattttagaaaagtatacattagcaagaatcaatataaaatgctattcaagcaataacaaatagagataatatacaaagatgtgctgtatctcaacctgtttatgttcaaaatttttatctctgggtagtaaaaattatgtcttatatatgcagacaaattcagagggatccaaaaatagtgttttcttctttaatgttgaagatgtagagtgacatagttgtttttcatatttcgtttcaatacatgtcctagtaaaatttcttatctacaaattcaaggcatacacctactgttgaaaatttatggtaattacataaatatgcatttgaaaaggtacaaaattttaaactagaaacacaaaacatataattatataacagccataactaccattaaaaaagtgagcatttaactttttaaaattagctgtgctaaaatatctgacaagtttatgaaaacctgatggttccaattttagaggtgacatataatttatttcattgcatatttttctagctattttgtgaaaatgtttaaaaagtttttttagagatgacatcttgctgtgttgcctgggctggagtggtacaatcatagctcactgtagcctggaactcttggtctcaagcaatcctcctgcctcagcctcctgagtagctgagagtacaggcaggcacaactacatctggataattatatatttatttttattttttaggaatagcgttctccttatgttgcccaagctggtgtccaatcactggccccaattgatcctcctgccttattctctagagtagagagaattacaggtatgagccacctgcttctggccacaaatcaaatgcactttttagaaaatattaatgccagtatctccagaataaattaacttcactactttacatacataaattaatatagcatatgtctatgcaaaactataatcataaattatgtatctgcaccccaataatactacctatgttcctaatctttatgaattgtaaatctcttatacaaataacattttagttaacaaacacacataaattgtatatgcaataacttcttacccctaactcttatttcctcctaacttatttataaacaggctacattatgtttgacttgaggctttcagtgatatcgctaacaacaaattatctcttcattacctgagttataatgattctcattatctatgttcatattcttacaaaccactgaggaaccaatccctaaattgaaaatgattgttcaccttctcttgaggccattgggattaatctcattaaattaacagccttatttatgtgggtcaccgcaaaatgccatcccttatattctagatattgttcatatatccaccagtcagactctatctctcacttacctctgatgtccttccactgtatggtttggaattaaatacctgtcatcaacaaaatattctatgtcttcaatcccttcaaggtacaatttatcttcttgcttatactggctatccatcccctgagaatatcaatttccttttctaattgagcctgtaactccttctttttaatccttctctggagatttataacttgtaatgaatgttaagcatgtagacgctatcactgaggtacataaatataatttattttagaattttgcatacatatatattaattgacacacacacaaacacacacatacgcatacatagagagagagagagattgttcttgggatcgtgacataaatttcccctaccgctggatctgcaggtttattcactaatgggtttccagtaggcaaaacaatgagcttggaacatactgggaaagtagtaaacatttgttgaattaatatcttaactaataacttatgttccctcctactcttcacttacttctagaccactttacttcctctctcctcccacaaaattacaacttcttataagtacatgctttgtgactataccattagcttcccttccattttattcatatactggcctcttcatcactctcatcatattttgaataacatagcacttgacttgctgtcatccttgtttgcaatgtggatattgaatccaagcagaaagtccagccaacaccctagcctcacagctccttcctcccttggtcccaacaactttcaagtcttaattgtaggttttctactctgtgagcaccatttcttatctctccagcttgtatattctaatcactcactgcaacaattctttgatgccagtggtattaataattaattgtttacaccattttttttgcccttgataatagccttcctcttcttttcttcttcccctgagtagatgccaaggtcttcctcacagagtttcaatttcttgcccctctcttcttccacatttcttgcctgtcaaaaccccaactctggttaaacctaattctctgcctgctttgcctacatctgttcagctgagcatagctatggaaaaaaatcagaatcaggctgacctgtttcatttcatgtttataacctcaactcacaagttgaattcaactgaattttctctatcaattaacttactacaatgtgagatgagtatttcacaccttcctcctccatattcaaatccctaacactctccccactcactttttctctgagtgacaacatggattttcatttcactgagcaaatagaagaaatcagaagaacatttttattcttccaccaccaaatccatcaatgatttatatttcccttttctctggatgttgcctcggtatttcttctgtattgacttacctggagctgggtagtctggaatagtcattcacgtgtttgaagcttcagttgggacagctggggaaagtttctctgtgatatcttattttccacatagtggcagaaatggtccagcagcaagaaaaagcaagctccaatgaacaagaactcatttaaacctttacttactattatatcattgaccaaagcaagtcacatggccaatattagagttcatgtgggaggggaatactcaaaagtgtgcatataggaaaagaaataatggcgactgctatgaactaagtgcttgtgtccctccaaaactcatatgttaaagcctaaatctcccatgtgatgatatttgaaggtgaggcctttgggaattaattaggtcatgaaggtagagccctcgtgaatgagattagtgcccttatataggaagggacaagagaccttactttctttgttgtccaccatgtgaaaatacaatgagaagatggccatctgcaaaccagaaagtgggctttcaccaggcactggatcttctggccacctcatcttagatttcccggcctccagaactgtgagaaataaatgttcattatttaaatcaccccgtctgtggtatttttgttgtaacagcccaaactgactaagatagaaattggtacttagaagtggagtgctactatttcaaatacctgaaaatgtggaagtgtctttggaagtaggtaatgggtagagtctggaaagattttgaggtgcatgctaaaagaatataatactgctatgaggggacttttaaatgtgaatctggtaagagctcagaaagtaaagaagagagctagaaaggtctctttcttattagagaatatataagtgatcatgtaatgtcagcagaaatatggacaataaaggccgttctcatgtgatctcagacaaaaattgggaaacatgttattggacaatggagaaaaggcactccttgttatacagtggcaaggaacctgggtgaattgtattcatgttctagtattttatggaaggtagaatttgcaagcaatacatgtggatatttagctaaaaaaaatttctgtgtatagttttaaaggatcagcttggttcctcctgactgcttatagtaaagtgtgatgagcaaaaggaattgaagagaaagaaggaatcattaagcaaaaaggaaccaaaacttagagatttggaaaattcttagcctatccatgttgcaggggaacacaaggggtgtggccaggctaccatttgataagaagattagtatgagtgtgatccaagaacctaatcagacatctcaacagaagccagttatagagacggaaatacaccacagaaatactggcaccaaaatggaataaaatgaagaaaagttgttggacttcttagacactacagcactggaccatagagctattcaactgcaaaaacatgttattcttcaagacaagagaagaatgaccctcaagtcattttcagagtttatcagggctgccactctcaccaaaggtccagagtgtatgggcctgggggacagggctgcctccatctcaactttaaagggcaagaccaatatgtgaacccaccaatgggtggggtaatattcttggttccaataggccatacagaggctgccctgagccatggagtcatgacctccacttggcagagcaactggggcctgtgtttcttgcctagcagtgctgcagaggcaaaacttacatcccactggatccagaggcagagcatcatcaagtcaagaggattattgcttaggtgtaagctcttacagagtttgccttgctaggttttggagtttcttgagacctgacacatctttctttcttctgatttctccattttggaatggaaatatttatcctatgcctatcccatcactttattttggaagtacataacttaacgggtttcacacgttcacagggagagaggaattttggctcagaataaatcatacctcaagattcaaccatatataatttagataatatttagataaggctttgaactttagatttgatatgagactaggtaaaacatttctgttggcatggaattaatgtatttttattgtgagaaggacatgaattgtggggggctgggaatggagtgctatgggctatatgtttgtgtccctccgaagttcatatattgaagcttaaattcccaatgtgatagtatttgaaggtggagccattgggaggcaatttggtcatgaggatggagccctcttgaatgggagttgtgcctttataaaaagagacatgagatggcgaaaccccgtgtctactaaaaatacaaaaataaattagccgggcgtgggggcgtgcacctgtaatcccagctacttgggaggctgaggcaagagaatcgcttgaacccaggaggtggatgttgcaatgagccaagatcgtgccattgccctccagcctaggcaacagagcaaaattccatctcaataaaagacaagacatgagagactttgcttctttcttctttgttctctgccatgtgaaaatactataagacagtgtattagtcagggtaccttagaggtacagaactaataggatatatatatatgtgtgtgtatatatatgtatatatatctttttatgtatatatatgcatgtatctatatatgtatctttcatatatatgtgtatatatacaagtttatacaagtatatatatatacacaaacacacacatatatatacacaagtatatatatgtgtgtgtttgtgtatatatagtatatatatatgtgggaatttattaaatattaacttacacaatcacaaggtcccacaacagactgtctgcaagcttgtggagcaaggagacccagtccgagtctcaaaactgaagaacgtggagtcagttgtttgagggcaggaagcatccagcatgggagaaagatgtaggctgggaggctaggccagtctcgacttttcatgtttttctgcctgctttatatttgctggcagttgattagatggtgctcaccagattaagggtgggtctgccttccccagcccactgacttaagtgttaatctcttttggcaacaccctcacagacacacccaggatcaatactttgcatccttcaatcccatcaagttgacactcagtactaaccatcacagatagtcatttgcaaagcaggaagtgtgcactcaccaaacattagatctgacggcaacttaatcttggatttcccagcctccagaactgtgagaaataaatgtttattattttagccacccagatcctaatatatttgttacagtagcccaaactgactaagatagcaaccgttttgcgaacaatacaccttctttttagccctttgtttctcttataatcactttcttgcaaatataaatgtagcattgttatatttttaccatattttatatgacagaattgatgcttcttcagttgagctaggtacttacatacttttcacatcatttctaggagaaaagttgacctgactttttgtcttaatttttatacgtagattgttggggaaatttttttgtgtgtgatggagtctttctctgtcacccaggctggagtgcagtggtaccatcttggctcactgcaacctctgcctcccgggttcaagcaattctcctgcatcagcctcctgagcagctggaactactggtgcatgccaccacacccatctaatttttctattttgaatagagacggggttttaccatattggccaggctggtcttgaactcctgacctcgagatctacctgcctcggcctcccagagtgctgggattacaggcgtgagccactgtgcccggcctgttggggaaatttttgcaaattgattgttagaatgatttaggctaactgtatttctctgctctgtatattttagattactcttagtactcttttatgtctctttattttgaattcgtttaaaactaagaataaattttaaaatggtagtttcagagtatccttcacccaaattttcccggtgataatattttacataaccattgcctattgtcaaaattaggaaatttgaaattggtacaatattattaactcaagctcagacctcattcatatttcaacagtttctacatgcagatttttggtatgtgtgtgtatagttctacaaaattttatcacatgtgtagattagagcaatcaatgcaaccaacaccataatcaggatacagatttgtccacaaccatttaaaaactctttcatgttaccccttaattaccatactctcccgcctactcttaactgttggcaaccactgatctgttctagatcactgtcattgtcaaatcaaaattattatattaatagaatcatatagtatgtgaccatctgaagtttgctttttttttcatttagcataatgcccttgagatttattcaactattgggtgtatcaatagttccttcctttttattgctgaataatagtctattgtatataaacatcatagtttatttattcactccttgaaggatatctggaatatttccagtttgggaatatcacagataaagctgtaatgagcatttacatataggttttgtttgaacataagtcttcatttctctaggatatgtgtccatgaatgcagttcctgggttgtatgttaaatatatgtttaacattattttaaaaagtgcaaattgtttttctagtctgtggtattttacacaatgattggcaataatgagaaatccagtttctctgcatccttatcagcatttattactatcagtatttcttatcttctctattctaacgtgtggtggtatctcataatggttttaattggtatttctaccatggctaataatgttagacatcttattatgtacatacttgccacctatatgtcttttttggtgaagtaactttaatttctggcctattttctggttgagttgtttgttttcttaactgttgagtttctgttgaaagtgccctgtgtattctggatatacatcgtttgtcctttaggtcaaggacattttttttggcttacaaatttctaatttttccaataccatatgatgaaaatttgtaagcaaaactaaaacaaataaagtacctaattttcgagaaaggcacagaaacaattcccttgaggaaagaaaaaatccatagtctatgtggatctgtttctggttctctgttctattctactgatctatgcacagtctttcacaaatatcatatagttttgattattataaccgtatagtaagtcttaaaatcagatagtgtgattccttcagcaatttttctttttctttcaaaattgttttgactgttctattttccttgtcttgccagtcttatttttcctcttatctaaaaattactttaacctgactttgctgatcatcaattgctgtattccttttctagttaatttctgcacttttttaaaatttttgactctcagtagtatctaatttattcctgttatttactcatgctaacttctcagaattagtttccctgtaggctcttctccagcaatccacctatagtttttccttcaaatttgagttggagactatcgtttcctaagaaatattcctgtctaacctcaaagtgtaatagctacactttcttttccccttattagggtcaaactgtgagtttttatgaccttaagcacacacacagataaacagacacgcaaatgcatttctgcatataattcaaaatttaaaaattaaaacaagcaataaaggaagtgtgtaacaaatcccatcaaaatttgacttctcctcatgaagaccccattgatgctactctatttgctcgtatttggaatacgaaattctttttaaaaattctctctctcactctctaattttttttgtttttatctttgcctttaaccacctccccaatttgatgcagatgctttgctggtggtttaggaatatgcattatctttttattgagtaatccaacactagcttttatgaataatttgttctatgtcattaagcattcacatttctgctctagctctctttatctttgctgtctctgccatgtgacaatcacctgatttgtctctctcttttaaattactccatggagcccctaatctgatgccatattattttattctctgcctcacattttaccttagaatttattcttaaatcttcatcccttttcaaaataaatgtattttacacatattcctgtatatatttctgttacattttttgccaaagattgcaaacagttaaattacttctctaatactcttctcttttttaaaaggtatatttccctcagtgcttgaacttaactaaatagtccctcagaacttcttttcataattaaattatttgatagggtctcttgggccttgtgtttgcacagccatactgaatgtgaactaaataattctgagtactttttgaaactttctttttacaaacagtaatgtattatttagaagacagagcaataggattgttcatattgaatgaaaataatgtctacagttatttatcattttaaggagcagagacactacttaattacaacagttttttttttttttttttttttttgaggtagagtctctgtcaccaggctggagtgcagtggtgtgatctcggctcactgtaagctccacctcccaggttcaagcgattctcgtgcctcagccgcctaagtatctgggactacaggtgtgccaccacgcccagctaatttttgtatttttagtagagatggcatttcaccattgttggccagatggtcttgatgtcttgacctcgtgatctacccgcctcggcctcccaaagtgctgggattacaggcatgagccaccgcgctcggcctacaatagttctttttaatgtgcgttttttactcatccaacatggctaatctctaatgaattaaaaacattttgccaaacagatcacaacccttcaccttcaaatgtacatttgttggtattgtgaggtctttggtactcaaccttggtcatcaaagcaaataagttttgactgaggactgacagaatattctcactgaatatttaactcctaaattatttaccatgcctacttaggccttcatttttattgcataatgaggcgtatgaaagcacattttagtctgacaaaataaaatccacacagaaactatgtacaaagatgcttgtgaacctacatgctggtaaggaattgtgaagcagaatattcaggttattttataaaattaacattaattgaaatgacttctttctgctcctttggcaaatctttcctgaataagtatacttcagtgagtacaattcttacacgtgtgaacaaaatgtagcctttgttcagatgacagaaaaatctataatgtaggatcagaagtaactgcagcttccttcactgcatatatctgtagttaggtgacatgaactgacacatatttcttattcatgagttctacagtgtgagaaggaggattcacctgaatattaaactgttataaactgttaatatattctagctagaattaattaagctggtcacattatttcaaagaaaaggttcgtgtagtgtctgcttcatacatatcaatgcttctcatttggattccagttcctgtggcccgcagcagtctttgcaaatgtatctttatttttctttattcttctaagaattaagaaaaacgagatttggaaaaaaaacctcaaactttcaagtgaccttttcttctgttcacatagttacagacattttgctgtaacatgtatgagctttttgaggggcacatatgcacagtctcacatctcatgtttaagccctttcctcttctttgattgtttcagttgaaataagaacacaggtcacaccgccctttaacagtggagtctgctgtttaaaaggtgtgtggggcattgtactaacatcagtagcttctaaattgcctttgtactttaagattattttacagatattatttagaacagccatagtttgtttgcttgcttccttccttccttgcttcctccctctctccttccctccctccctccctccctccttccttctctctcttttcttttttctttctttttttttttttttttttttccctcaagacggtcttgctctgtcgcccagactggagtgcagtggcatgatcacggctcactgcagcctcaaattcccaggctcaagtgatcctcccatattaaccttctgagtagctgggaccacaggcttgtgccaacatgccctgctaattttgggggaccttgaaggtagagacagtgtctctctatgttgcccaggctggccttgaattcctgtgcttaagtgatcttctgccttggcctcccaaagtgttgggattacaggtgtaagccaccacgcctagcctgacatagtttttttttttttaataatacatttagcataaattgattaatatttttcctctgaagcacttttagtttgataagcaagatatttaaaataccaccccaatatacaaaccttcaagccttaggagtcaagttctcctatttgaaattcaggatttcataatttaggaatgatgtaaatcctgattaagtaaggaaattgaggaaaattttaggaagtataaaatgtactttccttcatatttataaaagcttgtagcatttaaaatttggttgtcataatgatacaaaataaacattcaaatagaaatgtcaattataaactaaattttaaaattcatctaagaatagcaaaagtaatagaatatacatggattcagagtcataatagtaacatatctcttaaaggtagagaaacattcaagatcaagacaacaacatagcagagcctgccatgatttctcctgttctcaatttaaatagttatacaatatgcaaaagacaaaagcacataaaagagaaaatatgaataagaggcaaaagaatgactgagccagacttcattcccacttcatttgatttatttatattctcttctttcaagaaaagatttaaaccagtttacaaggataaacaaaatatgacaaaagagtataaattaaagttggaagaaataagaaaggataaacattgaggagataaatggagccaggaatatgccaaaatgcatgctataataactcactggctgacgttgagtcacacattcatatttaagctttcaaatagccaagcaaaagacatagttattttcatttgtataactgaggatgttttgagattcgctaaaaccaaatattaaaaacaaagacacacaactatattggtactaaggaaggattttaactgatggagcgcatcaaagaacataggcaggtgcattaaatgatgttataaagaatatccttgtaatggtaagtttcatagagtggctttcatgataaattaatatattctaagaatattacttatggacaatcactgagggatgatctaaaggattaccagttggaggtacaatgattctctacagaaaattgttttgaatcatctttagactatagataatttaaggaaacctaaatatgagaagaatacaaaaatgcatcgaaaacaaatgaagagtgtaactgatactgaagaaaattgaaatagtgatatggagaacacattttaaagggcatggtagaatgcagaaatacataaaaatgtaattaataaagaaaatagaggatagagcatcaagcttcagaaaacaaggagacgtttatagagatttttggtcataaaagacagttgtaaccattcatagaatgctatgccttccatattttctattaaaataaaaacatataaataaaagaataaaattagatcaacattgaaaaataagatgctgaaaatgtacatgctaaaaaataatggctatccaatttataaatcttcacatgcaaaattaaatttgtctgaagagaacatagaaaagagtcttcactgggccaacacacagacatactcaaatttgaaagagtcagaactaaattaaagataggctctggaatagtttttcttagatcagcccctaatgctaatttgggaaccatagaatgatagatcatggaacccattctaaccgtggatggagggctaagaaatgtaaggaatactgtccatcgtagatccccttaaggataatttggacttcaaagaaataaccaatagctgaaatatgggtgtcaagtctttaccagaatgagaaagctccctgtcaaaagacaaagttagctgtagcttcattctcatttcttatgtgtaagtagaattttaaaataacaagtttcaatcaccagatatcttaaaatctcctcagcccttttggaataaaactaacaaactggacaggtaaacacataattgtagaaaccttcccaaagaaaatgatatagaacacatataattgctttctactagtcatgaaaaaagtgagaaatattacatatatgatgaaaaggactagtagttcaaaagaaggacactatgaagaatcagcataaaggtctttctgtgaatattttttcaacaaagcaatgtttaaaactatatttttaatcccccaaaacttagaaaatatacttaatacttcaaatgggaacaatctgaaataaagattactttaaataaaaatcaaaatgtctgaatattcagagaaaacaagaaacaacatactgaaaacaagcagaacaaaaaatattttaacatccaaaggaaaattttaaagaataaataggttgggggccatttaggaaaaggagaaaaacttacagaagaaaaagtatataaaaaagtaatatgtcaaaagaaattcccagagctaaagaaacatttaggtcttggaacacaaatgtatcccagaatacttagaaaaattaaggtaaaaatctttatacacacagagacacatacacgtgacacatacatcatggtgaatttggaaatttttaaaaaatgaaattgagaaatcaatttaaggaaaaattaaaaagaaaaaaatttttaaattattagcattctgaaatgaattttttcataaagtttaccagatttttttactatgtaaagtattaacagaaacgttcaagtagaagtttaagaaggaagaaattataattcaagaattccatatccatacaaactgacccaaattatcaggataaaaaggcatcctttacataaaaaaatgaaaaagtactcaaagcaattcattaaatgaaccaaaagattgtatgcaatgatgaagaaaaggcgatgtaatgaaaatggtgaattgtggaaactgcaaaatagaataaatgtctaaatgaatgttgtcaggaaacacagcccatgcaatggatatagatagatataaatataatacacataccacaaaatttactcatttaaagtttacaattcagtatttttagtacattcagacaattgtgcaaccattgctataatccaatgttagaacaatcttatcacaccaaaaagaagctccactctcataaagagtcactcctattttttttttttttttgagacagagtctcactgttgccaggctgtagtgctgcggcacaatctttgctccttaaaaccactaatctactttccattttatagatttgcctattctgagcattttatataaatggaatcatataatatgcaacctttggtgactggtttcttttatattttgaaagttcatcaatgttgtagtatgtatcaatagcttatccatttttattgccaaatactgttgtgtcatatagatataccacatttgtctatctagtcatttgaaacatttctactttttggttattatgaattatgaaatatttatgtacaggtttttgtttggacatatgttttctcttttaatttttattttactttaagttctgggatacacgtatagaatgtgcaggtttgttacatagatatacatgtgtcatggtggtttgctgcacctatcaacccgtcatctaggttttaagccctgcatacattaggttggacatatgttttcattactgttgggtatataactaggagctgaattgctggatcccacagtgactgtaggttaatgtttaaaagagctaccaaactgttttccatagtgctatttttattcctaccagcagtctatgagaaattcccaattctccacattgttgctaacacttgttattatctagttttaaaaatattatgattattatagctgtcttagtagctgtgaagtcataaaacattgtgattttaatttgcattttcctgatagtaacgttgtgttttccattcacattttattcatgtgcatgtcttctttgaataaatgtctattcatattcattgcccattttaaattcatttatgtaagttttattcagttgtaagatttctttacatatttcttttatttctttttttattaggcaaataattttcaaattttttcctattttctggctcgtctgttcactttttatggtatattttgcagcacaaatgcctttaattttggttaaatgatttatcaattcttcaaagaataaatttataatttcttcattgcttgtactttgggtgttgcatctaagaagtcattaccaaacacaagataataagcatttactcttatttttcttatgttttcttccaggagttttatgattttgacctttaaatttaggtctatgatccattttgagttaattttggtctatgttataaagaaagttcaactgtattcttttacatgtggatgttcacttgttcaaactttagttgaaaagacatttgatgaaaacgctatttcatccttgacttgttggggtacgcttgttgaaaatcatttaactataaatatagtagtttattattagactcttaattctgtcagattgatctacatgtctatccttataatagtaccacactgtcttaattactgtagctttatagtaagttttgaagtcaggattttccaactttgttcttttttaagatcactttaatctggatctcttggatttctgtattattagctataagtctactcagatgttctatttcatgattaattatggtaggttttgtgtttctaggaatttgttcatttcatccacactatccaatacattggcatataattattcacactacttttttataatcattgttatttctgtacaatcaacagtaatatccctattttcatttctgattttagtaatttgagttttttctcttttttcttagttcatctagataaaagtttgtcaattttgttgaacttttcaaagaaccaatttttggtttttatttattatttatttatttatttatttattttttgagatggagtttcgctcttgtctcccaggcaacaatctcggctcactgcaatctccgcctcccaggttcaagcaattctcctgcctcagcttcctgagtagttgggattacgcattcaccaccatgcctggctaatttttgtattattagtagagatggggtttcaccattttggccagactggtcttgaactcctgacctcaggtgatctgcccgcctcggcctcccaaaaggctgtgattacaggcataagccaccatgccaggcctttattgattttttaaattgtttttctattctcttttttgtttatctctgctctcatctgtattatttctttccttctgttagatttaggcttagtttgttcttatagttccttagtttgttcttatagttccttaagttccttaagtaaaggcaggttgatgatttgagactttactccattttttttcctttttttttttttttttttgaggcagggtctcactctgtcacccaggctggagtgcagtggtgtaatctcggctcactgcaaccgccgcctcccagattcaagcgattctcctgcctcagcctcccgagtaactgggattacaggtgcatgccacgacgcctggctaatttttgtatttttagtagagatggggtttcaccatgttggccatgctggtgtcaaactcctgaccccaagtgatctgtcgtctaccttggcctcccaaattgctgggattacaggtgtgagccaccacgcctggacttacttgatttttaatgtatgcatgtatataatttttccccttagcatggctttcattgcattccataagttttggtatgttgcatttctgttttcattcatctctaagtatgtttaaattttccttgtaatttcttctttgatccattgattgttaattatgttgtttaatttccaatgatttctaaattttccagtttttctctgttattaatttctaacttcatctcgttgtactcagagaagatactttgtatcttttaaatctattgagatttaatttgtggcctaaaatatggtctatcctggaaaatgtaccatgtctacttaagaagaatgtgtatgtagctgctggtatgttgagtgctctgtgtttgttggatcaagttgctttattatgatgtttatgttctcttctcatacttatcttttctctggtggttctgtccattattgaaatgcaggacactgaagtctccaactattacagaactatttctccattcaattttgttagtttttgctggtcagaccattgatggtctgttattcattgtgtaaatgtttacaattattatatcttcttgcaatattgaaacttttactaatatatggggacctgctttggctctgattaacttttaaaattaatgtatattttgtctgctggtatagccatcgttgctttattatttgcatgaactttttttttttcactttcaatctacttgagattttggatctaaactgaatcggttgcaaacaggatatagttagatcatggtttttaatccattctgctaatctgtcttttcattggagagtttaatccatttaatttaaattaattactgatgaagaagcacttctgttttattgctatttcttttccatataccttataaatattcttttctttatttccagcattactgtcttcttttgtgtttagttgacttttttagtagtgaaatgtttcaattacttcctttgtgtgtattttatagctattttctttgtggttaccatagagattacatttaacatcctaaagttatagcactataatttgaatttataccagcttaacttctgttgtgattttctaattttttgtcttaaagtctctttctggtaagtggccataagccaagacagccactctctagaaaagccccgactgggaggagtattagattgagattgccagtaaggaaagacacagaggaggcagcacaacaaagcccattagataaccagaagcagttttattatttgcccaagaacagggaacagcatgtcttgctgagccaaccagaagaggaaagccatccaggacacatgctcacctagtgggaggggagcaaaagagagagcaaaatacctgtgagccaaagcccttattggggtccagagtgtgacccagtttggtttcctgcagggaattctaactgatgggtttagagcaagcaggcacaagttccgtggagtctgtgactgagaggtggttgccttggcatgtcttggcagtccatgtggtatatgggagtcagtgggtcaggtaggttatatctagctgtcccatgggcaggtggttgtcaggaggtagttgtataaactcctcccagttcctcaagctggatcaaccaccttgaggacttgggaggaggtagagaactggaaactatgcaaagtgtgactaagccccgcttctggtatgataaaattaaacctatattcaaaatggatgccaaagcaacataaaattatgagctcacaactttgaatagtatacaaaaactgcccctttacaggtcagttcccactgaccaactttttcagttgctgatgttccaaaattatatctttacatataatgtgccaaaaacataaactaacaattattttaaatggattagcctcttacattattcagaaaacataatgtggagttacaaactgaagttaaaataagactagctttttgacttttttttaatgtgttagtatcttaaattatgtagaaaacagtgaattataaactattgctactataacattagcttttgtaattgcccatatacttaccagtaatgaaatctttatttcttaatgtggctttgagtgactgtccagcatcttgtcattttacgctgcaggactttctcgtacatttctttcagggcagttctactggtaacaaaccaccttaatgtttgtatatctgggaatgtcatactttttcctcattttgaagggtatttttgggatatataagaaagttcgttgacggtttttgtttttccttttagctctttgaatattttgcatcactgccttctggcttccatagtttttgatgagaatctgatggtaatcttattgagcatcacttgcatgaaacaagttgcttatttcttagaattttcaaggttctgtctttggctttgaaaaatttgaatgtaatatgtctcagtgtggtctctttgatttcatcttacttgaaggtctttgtacttctcgggtgtttatattcctgtctttcactacatgtggtgtcataaatttgtgtaatatagtcaccacttaatatccaccttcaggcttgatgtaagttgtttgaaaccagttgtatccagtcacctttcacctagttaaaacttcctttccctgaatggttgtttagatatagcctgtttgttcctcatcccagtgacccaaaccctaacacacctcatagttggttactattataagacccaatggtgaacaacagagtcatctaaataagtttattcatttatatgtgttttctaagctagaaaatctacaaccttcacaggaaaccctaaggaataataccatggactttactgaaggcataattacacaggtactcttcctctctcctgctcctcaccctctggttgagctccctgatgcctttggaattccagtcagcctcccatcagtacctgtaacctctctgaaacctgtgagttatgaatttcttgtttcatgcactttggtttcacttcctctttgtctcacctgacacgcacacacacctaaacctaaccttcctcccattcaggtcttttctagaagagtggctgttttggtttatgagtgctctccaaaaaaagacaataccaaattaaaagaaactgtaataatggaaatctcatgtggaaagttttcagccattatttctttaaatatctctcttaccctttctctctctcttttccttacagtattcccacaatacttgtctgcttgttgacgttcagagatctcataggctctgtttaatattttcttcaatctttttctatttcaagttttataatttccaataccctatcttcaaatttgtttcctctgcctgctcaaatatgcctttgaatccctttagttaatttttcctttcagttgttatatgtttcagctccacatttcttttcggattttctctttttattgatatttccattgtgttcaacattgttttttgtttattctttttttgctttctccacttcttcttttagttatttgacagtctttaatacagttattttaaagtgcttgtctagtagatctgacagcaagtcttttttagggacaatttctgtttgtttgtttttttttctttgaatggaccatacttttctgtttctttctaggctttgtgattttttgttgttgagaactagatagttgaatctaataatgtggtaactctggcaatcagatttttctttcttccccagggtttgctgtggttttttaaaaattattttggtttattgtttttgttttcctattgttgtaggcagtctgtgtgccaggagttagcctgaggtgtaaatttaaggtctcttctggtctgttttgaccctgcacctttcaattgacatgtgtggtcactttctaattttcctcacatacgcagttgcttttgaatgttctaaatgtctttaatgtctgatgcccaagaggggaaaaagagaaaaatgaagtgataggaaaatgatactggccttttaaatgccctagaagttattgtggctggtgggggagcgcttgcaataatgcgggaggtacaaaaacaatagtcagccacttctttctctgcacttctgtgattggaagcagcaatcagtaatcagagcacaaatctctggtatttggggaatacgcttcttttttcccactctggctcccataagctacggacaagctgctccaggaacatgtgcacagccatctgcgatggggacaaggataggtagctactattatgttaagagccgaaattgaccaaaattaagtgcagtttattatccaagctctccagagttccaaaatagttatattggtcagattcttctagtgcgattacaattgttgtttaggtgggaagaaagattcctggtgcttcttattctgccatctctccaaaattttctctccaattgatatttgtatattgctcatgtatcctgtaaccttgctgaatttgtttattagtttttacagttttatgtatattcgagttttctacatacaagatcatggaatctgcaaatagagaattttacttcttccttttctatctggataccttttatttctttttcttgatcgttttccccagctaaaacatgtagtgcaatgttgaatagaagtgattagatcggccatctttgtcttgctccttattttaggatgaaaactttcatctttcattattaaatatgttgttagctattttttttttgtagctgcctgccttttatcagattaagaaagctgtcttctaaccctagtttttttttttttttgctggattttgataaatgttttttcagggtcaattaaaattattgtgtggtattattcttcattttcttaagtgttttattatattaatttttaattattaacacatccttgcatttctagtgaaaatctcactgttcattgtgtataatccattttacatgttgctggatttagtttgctaatattttgttgagaattttaaaatctctgatatttatcagcagttttgatctatggttttttttcttgttatgtatttgtctggttttgatataagtgtaatatcaacctcatagaatgagttgggaagtattccttcctcttgtattttttggaaagtttctgaagtattgatattaattcttctttgaatgtttggtagaattcaccagtgaaacattttgggcctgtccttttctttgtgtagggtttttaaattactaattgttatggactgaactgtatcccctcaaagttcatgtgttgaagccctaagccccaagtaattctatttggagataaggcatttaaagcggtaattatggttaaataagggtaaagccctaatccaatagaactggtatcctttttttatgttttttttttttttgagatggagtctcactctgttgcccaggctggagtgcagtggcgtgatctcggctcactgcaagctcgcctcctgggttcacgccattctcctgcctcagcctcctgagtagctgggactacaggcgcccgccaccaagcccggctaattttttcgcatttttagtagagatggggtttcaccgtgttaaccaggatggtctccatctcctgatctgcctgccttggcctcccgaagtgctgggattacaggcatgagccaccgcgcccagccagaactggtatccttttaaagagagaaagacggcaagggtatgtgtgtatacagagaaaaacctgtgtgaggacagcaagaatatggccatctgcaaataaaggagagaagtctcagcagagattaaacctgatattttgatctgggtcttccagcctccagaaatgtgagaaataaatttctgttgtttaagccacccagtctgtggagtttgttatggcaacattagctaactaattcaatcgctttactcattgtaagtttattaaaattttctgtttcttctagagtcagtttcagaggtcatgtcttcctagaaatgtatccatttaatctaagttgtctatcatagtactttgtcttttaaaaaaatttctgtaagattggcagtgaggtcctctctcttgtttctgattttggtaattttagtcttctctgttttttttcctctggtcagtgttactaaagatttgtcaattttgttcatcttttctatgaacctacttattattttattgattttttctattgtttttataatcactatttcattatttcctactgttattttgtttcctttcttttgctttctgaatgcttagtttgctctttttttttttttttaatgtctaaagatagaagctatggttattggttagagctcttcctttaaaaaataagcaccaacattcataaacttctatctgagcactactttagctgcatccagtaaatattggtatgtcgtgttttcattttcatttatctcagagtatgtgctaatattcctgtgatttcttacttgatacattattcaggagtatattgctaaattttctatattttttaaaatttctcaaatttcattaagtgattgatttataagttcatttccttgtggtcagagaacacgatttctacgatttctacgatttaatttctttaaactttactaaggattattttatggcccactatacgatttatcttggaaaatgatctgttgtactttgtactctgctactgcaaagtggagtcttctatagatatgttagttctagatagtttataatgttgctcaagtcttctatatccttcttgcgcttctgcctagttaatttatccattaggaaagtgtgatattgaaatttcagactgcttttgttgaattgtttatttcttccttcaaattatcagctcttgtttcaggtctttcaggtttattttatgtacctattattagtgttatattgtactgatgaatttacccttttaccattttaggacatccctgtttaacttccttttacatttttggtttataggtttattttgcctgatattagtatagttactccaactctcttatgcttactgttactgtttaatggtgtttcctttccctattcttttcaatctatttgtatctttgaatctaaagtgtgtattcgacagacaacatatagttggatcttgttaatttatcctttctgacaatctctgccttatgattgaattgtacaattcatttcaatttaaatggaagtacatataaaacaaggttatgcattgattggttgataaaaatattgtggccagagactcacaggaaccaaattctgtttttccactacatgaaatggctcagtatttgcctatttgaaattgttggtgactttataaaacataactacatatgaataataaaaattgatggtatatacatgtagtatatgcatactattttatatagttgctttctatgtcaggtaagagatgaaaggacaataaatatgcaattatactaccttttataatcatctctatttatatttatttgtattttatgtgtggatccaaatatttgcctgatgtcacttgttttcagcctgaagaacacctttagtattccttgaaaggcaggttagctagcaataaattctcttaatattgatttatttgggaatatttttatttcaccttttttgaaatatagtttttctggacacagttttcttggttaaaaattcttcttttttttctgtcagcactttgactatgccatatattgccttctgaactccattgtttcagataagaggtcagctgttaatcttttgggatcccctgtacatgataagtctgctcttttgctacttacaagattttctctcttaattaatctacacatccagaaagcccaaagaactcaaaatagaataaaaatgaagagatccacacctagatcaatcagagtcaaaatgttccaacccacttttaaaccctctgtttaatattttcactctaattattgtactttcaaccctggacttttcattaattcttcttctataacatctagctctttattgacattctctacttaataagacaatgccatcatacctttgtttaattatttaagtgtgactttgtttagtttttatttataatatctcctttgcagtctttggctgataagtacaatatttgggtcctttctcttgccattttctttgcctgtgtatggctgtgaattggacattttagaaaatacaatgcaatgttcagtattgattctccttcccctaccctggacttgtttgtttatttgtttagtggcttggctgactgttccaatgcagtctgttttctccacagtgtgtagcctctgaagtcactgagcagacaatggcagctttaggcatagagtgcagtccccctgacaatctctcccccaaatgacagtggtttcagcttggctgtcttttactgtggactcagagtccctggggttcaacttttgattttttgacttcacaatgggtttatcaggatgcaacctcatcgtaagtcgagaagcatctgtatttctcacatcttccttttaattttctggttggtctgtctctcttgctatcacactcagctattagactccattaatttgtagctgattgctctattattttagagaatacctcagggcataagttgctccacagtttgctccaattaacatctcagtccctttgcagatgtagtctttgaggacagttagtgagctttggtgtgaccagaggtgttctctttttagcagcctttttccttgattctctctgttaagcgtttcaatttttactatcgtatggctataaacctccacttaattgcttacgaccaaagtcaccattgttttctatagcactgttatgcttttttctccatactttgttctaaacatctccatgatttattctaaataaagtcagcctccttggggacagctacaaagctctctgttcttggtctgcctctgtccctgggcagaatgtctgcactacttctccgaagaacagcttccacttatcttggaataacatagctactctatgagtggagtgctgggttgggatgacagcctctggttctgtaggaatactttcattctataagtgagatggatcaaaatgatgggacccagaataataagctcactgcattcagagtataggttctgtcctacaattaaggttagatggagaaaggaagcctgagatctgttagcattagaatagagtttctgcaacatatacctagggcagaggaaaattgctagtttgggatcttcccttcctgagaagaaaccatagcactagactgggctctgggagaagatggagacacatcttcttggttgtacttggacagagtagagcttctcttccactgagcctgaggggtctgagaacaattgtaactcaattgtcatggtctcttactgttcttactgagatttaatatattttcttaaaaattgtttcttcatttggagtattccctttgtataattttctaactctactatataaaccaaaattttcagtgaattaaagagttaaaagtatatatctcataaaacgttaatgtaatttgtaataagaaatgcttctaatattagatgttagaagaggagaagcaaactttatatgctgtataatccctttaaaaatattaatacaaacattgctgatgacatgataaagtgaaagaaatttttaaaaaacatctgccaaggtgttgaaaataatatttctaagcaaggtgattaagggtgacttgtattttctttgacacatccttgcatattttccaaatcttctatggtatacatatatgtctataataattagagcaataatccttattaaaaatagtgatgccttttttagaccttacaccgtgtttaaacaaattttactaattgcttggtggctgctagcatgatcattttttccacagtcttctgactctacttttgctgactctgccctgatatttcatcttgattgatacagtatgtgatctactccagtcacctttgttcctccattcattaagggaagcatgaggggaagatgaaattcacacctaggcagttattttcttctgctttattctgactccaaactgctgcagctcttgcaggtcacatgcagctctgagagagattcagtcagctcaccttttaagcccagaggttctcagactgtatcaacttttgaataacttagttcaatctaattctatttttttcctgtaaattcaagtagtcatcatgatttctatgatttcttccatgagaaactgttatattcaatataccttatatagttattgttatttacattccactataggaacataaaaactgtagtaggtcctaccactatttcaccttaaattgtattctgtcggacaaaatcttccatcagcaccttctttatgttgaactcataaaatatggcagtctacaaatctatttatctcttcttaggtatccattagagaattggttttctatcactttgaattttgctcaataacacccctcaaattcaacaaagctaaatcttaaaggtaaatgaaagtaaagagagaccaaaagagagacatgtttaactcacaaatgaaatatctaaaaagattttcaaaaaaccagatactactatatacagctaattggagaaaaaaggaatagactctctttatttgtgagtctaaagtcaattttaaagagctcaatacagaaaaatttgtatatagatgtaaatatttaaatataaaattttgtcaaataactaagatgaaaattatgtcttaacccctgctatgattattaaatagcaaagtaaggtaattatagatgatgttgtcaccatgttttatgtttattaaaggtagcattttaattttaggttaaatatacaatgtaggagtatagtagtttatgggctttaatgcacattttatgaaatgttgagtctgtttgcatagtcactgtgtatgctacatttaggccaattttatgggacttgaagaaccatagcactattttaaatgataatgctggtttatagggattgtgcttccttttacgatatcagtgattgatatatttaatggctaatttttgatgtacttcaatgtgtaaaggtagaatacttatataatgtccaacatactgtgtggaattattcacacagctgccgcaatttgtttatttaactacaaattcaaaattactttcctttcctttcttctttccttcttttttcttttcttttcctccctccctctctctttctctctgtctctcttctcttctctcctcttctcttctcatctcttttcttttcttttcctttcctccagagtctcactccatcacccaggctggagtgtaacggcgagatctcatctcactgcaatctccgcctcccaagttcaagtatttctcctgcctcagcctcccaagcagctgggattacaggcacctgccaccacacccacacctgccaccacacctgccaccacacctgtatttttagtggagacagggtttgccatgttggccagcctggtcttgaactcctgacctcaagtgatctgcccaccttggcctcccaaagtgctgggattataggtgtgagccaccgtgcccggcctcaactacttcttttaagcctatagtatcaggcttctgctgatggaatgaagaattcattgggcttagattcaggagaactgaattaaaatcctgtatgtttgggcaatgattaactagacttttttatttcagttcttttctcttagtgagacaaagctgcaaatttgacgtaaaaagtccaagctgtaaattctggctctatcaggtgttaatgggtatttgacattggaatcatttcttgatttctatgaatatcagattcagtttgtaaaatgtgaatcataatatatatcaccttgataaaaacatgaagtaatgaatgtcaaagtgttttgtaaatggcagagcattattctaacttttgtacatagcacatatatatttagtgcttatttttatgctgagttcccattctcaagtgtgacatcttactggaggaggcaaatacaaataatatccatacaaagagtcagataacatacagatgtacaagtattatagacagcttgcagagctaagcaagcatagaagacttgagtaaacaaatggcatttgaggtgggatttaaaaagggaagaaaaatgggagcaagaactacaacagttgtgtagtggtgtgaaattaactttggctaaagtagataacagtaagatataggcaaagacatggtagaaaatgaggtttgcaaagcattttgaggcagacagagagctattaataggagtttggacctttttccttggtttagtggggagctgttagagctctttaataattctccatccagattatggctggttgatacctatgacttacatatttttgacttaatatcaaatggcaataggaggtgccgggtggttaatcctgatatggtttgaatgttggtgttccctccaaaattcctgaaattgatattgaaacgtagtcccaaatatcaacagtgttaagaagtgaggtatttgggaggtgattaagtcatggaggctcctctcgcagtgggatttaggcctttataaacgaagcttcacatagcatttggctttttcttccccttccttgccttctgctgtgtgaggacacagtgttcaagacaccatcttggaagcagatactaggacctcatcaaatactgaatttactggcaccttgatcttggatttcacaaactctgtaactatgagaaatacatttatctttttttataaatcatataatcccaggtattttgttacagtatcacaaacagactaagacaatttctaaaatctggcaccctgagctcaggtgtcagtttaataaaccgagtgtgtgtaaaatgtggaagaaaaaaaaacaccctttagccactatgcttataattatttaacagttaaaaaaaaggcacagtagttgtctcactccgtttgggctattataagaaaatgccttagactgagtaacttgtgaaaaacaaatttatttttcacatttttggagcctggaaagtctaagatcaagacaccagcagatttggtgtttggtgagggcttgctgcctgcttcaaatatggtatcttcttgctgtgacctcacatggcagaaggagcaaaaatgttccctcagactttgtttataagggtactaatctcattcagggttttgccctcatgacctaatcatctcctaaagatgccatatcttaatactcttgcattggagattaggtttcagcctgtaaattttgggggaacacaaacatttagaccgtagctgtagtgaaatattgtcagtcaagtaatgctaaaagttttgctttttttttttttgtttatttttaaaaacatttttatagatagcatcttattgtgttacccaggctggagtgcaatggcacaatcttgctgcaacgtctgcctcccaaactcaagtgatctgcccacctcagcctcctgtgtagctgggactacaggcgcccaccacaacacctggctaatttttgtatgtttttgtagagacaggtttcaccatgttgcccaggctggcctcgagctcctgaacacaagcaatctgcccaatttggcctcccaaagcactggtttacaggtgtgaaccaccacatctggcgaagtaatgctaaaagtttataacagcacactattggtgaacatgactgggcatatgttctgtaggcatacctttttagatgaaagtacatcctggcctcattggagtattttgtagatgtccttccaaggatatgcatgaacataaacaattcacataatatgtacatatatatgtttatcataaagagtgaatgcaaaataaaaatgtatggagtgaatatttggcagagtacatttacttatttagtttacataattatacctcttgctcataaccctgacagaacaggtctaattttcattaagcatgactacagttttcctacactaatcatattaatgttatacttgttttgataccaaataaagtaattaggttgtttttgatggtagtgaatataatatgtatattaacaaattggcatctgttttatttcatttttcatttcaatttaaatgtaatcaaccaataatgaccctagtaagctagttaataattaagataagcattcttccactaaagttatatagtttatttcaaaacttatgtttaatacatttcaaaagatattaatcagaaatgttcaagagaaatggatattctgagccaattgttgacattctaaatccaagtacattaacagcaccttttcaatcataactattgcatcattagtgcacagctacatagtgctaattactttatttacctctacattgaatgaatgctgttaaacctttttaaataattgataatttattaaatactaatatatgcaaaactgaactatacaagtttttccaaattatatctgccatcttttgattatataaatacaacatatactacctgaatgcaaaattaacatattatatttttattatgttaaaacatatgtaacacacagttttccattttaaccattttaaacgtagagttttcagtggcattaattatattcacaatattatgcaaccattaccagaatctatttcagaattttttatcaccccaaacagaaactatgttccttaaaaagttaagcatacaattaccatatgatccagcaactctgcttctaaaaatatactgcaaagacttgacagcagatactcaaacagatgctggtacacatacatatgtttaactttttgagaaacagtgtaagtgttttccacagtggctatatcattttatattcctgccagcaataaatgaggattccactttctccacatccatgacatgctaacatgtgctattttcttgttttttggtttttttttttagtacagtcatcctgttaagtgtcaagtgatatctaattgtgtgtgtgtgtgtgttttcaattttagtttttgtgggtgcatagccatatatatttatggggcatataagatattttgatacaggcatacaatgtataattatcacattagggtaaatgggctattcataacctccaggatttattctctgtgttacaaataatccacttatactctttcagttaccattgtgattttgaattgcattttcctaatgatgaaaaatgttgagctacttttcatatgcttattggccatttttaaatctcctttggagaaatgtctattcaagtctgtattcatcagagaaaaagaacccataggagatatatatttattatacaaattatacatataaatatatataatataaatctataaaaagagatttattgtgagggactaacttatacaattatggaggctgagcagtcccatgacttctgtctgcaagttataggcacagaaaagatgttggtgtagttggccagttcaaacctgaaggcctgagaacgaggtgcactgatacctgatgcaggagaaggtggatgtcccagctcaagcagagagcacattcagcctttctcatttttgctctatttgtgtcttcagtgagttgggtggtgcccacctgcaatggtgaggatgatcttctttattcagtctaccagttcaaacactactctcttgaggaaaccccctcacagatgcacccagaaataacgttttgtcagctatctgggtatctcataatgcagtcaagtttacacttaaaattaaccatcacagagtcttttatttacttttaatttgctttttgtcttcttgttgttggcttgcataagttctttatatattctggatatatattttaaatataaccatatactttttcccttatcaggtatatgatttataaatgttttcctccactctgtgggttgtgttttcactcttctgatggcatctattttgattcccttatttcctttagtttgtgttcagctagtgttttgatatagattttcttgaattccaagtgcttggaaacaaaacaaaacaaaacaaaaaaacacctctcagtgtttgacgattaattctgtgctgggtcactcttttaagatttagccagcccagttaaagctctggcccaacctttacttcctacttgtgctgagtgtggacatcagccaatgatgaaagcttaaggttttcttgggtcttttttgagcatgcatcctatcctagtcatgttcttggtttccaaattccccagtatatacaggcacttttgagtgttctcatttcccaaagaaattaccttcctggctttttctcccaagatttaggcagtcagttgtgtgtcttaatggtaatctctcttttacctcagttggctgcaggttcttcatttgccttccctttttgaatagcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagaggtgtggataagggcgagtaagaatgccacaatttttggctaccatttttaaattgcccccttttttttttttttgattcggcattcatttggttactgtatacttttgactgtttctggagttctgacaaagttggttttgacagttctgcttgttttaaatgatttttgtgaaggcacagatgtttggagctgcctaatctggtgttttgtggatattgctctcctttactgtaattttatattccaatttaagttaatggaattaataagtaaacctgtgaattataagacttgcattacacaaagtactgtaggacgtatgctggtggaagacggaccctcaagaatttgagaggtagatatgacctgcatatacatatctattacagcaggtagtttatgacctgtagtaaatcaggggagtcaggaaaagattaataaggataacttttaaggtggactttgtagcttaactaggatttttatagttagtgataatagggagaaaaagtttagctggaagaactgaatagaatcctgttttatgagtatgtaggctatttgtagagttttggtggaagatagagccagatgatcataattagttctgtctcttatttaaaagacaatgaaaataaaagcttttaagcaaagaaatgctacgatttaagctcctgcttcagaagattagtttggcagtgatgggtagaatgcattgagcctacaaaatgtatattacatacataaaattatatatacaataaatgtgattatattaagacttttgaaatctaggaactcttagtttaagtcaataaataaaagatttgcttattttaaaacccatctaaccattatgacacctaagatttttaaaatactaggcaaatgcagttaaaaaacaaattatgttaaatttagcttcagagtatgtttcaatgaaatatgataaatactaccagaaagttacttattaaaataccatttagaatccgcaatacaaataatcatgctacaagccaatgcttattggatgcttcctatatgccaggaaatatatgatgttaatttatatatgctttctataagtatatttttctaagtgctttatcagtggctgctcatgtaactctctgttacacgtctgccagcctgtcagttaagtaccatttttatcatatcattttatgaatgaggaatctgagacttctataaattagggaacttggcttgccacataaccagcaaatggtagagctgggatttgaatccattcactcaggctcacagattttgaccttaactgtcacatagcactttctccctttttaacagttatcaagaatctagtattgaagtaagatgtcgttaaaaaaaaaaaaaaaaacacaaaatgtgtaaaaagagacattaagaaaactaccatagtagtgagaaattacaatagtctttttgctaagtcctcaatagattagataaaataaataaaaatttatagactttaaatataattaatagtagcaagatattcatacaatagtagatatctatcataggtctgtaatagatgtagatgtatttgtatattaaacagattatatatttatagaatatatatcccaaactttctattcatatatttaaataaataatatagtttattttcaagtgcctatagaatatttacaacgtgaaaaagtgataatatcctagggtgaaatgttagtatcaaaattttaaaaataatattaatatgcataccacattctcaattttcactaacacaaaactagaaattaatagcaaaatgttaaccaaaatacttaataaaatgacaatttattaacatgttcctaaagtaggtctaagataattttaatatgtaattatatagtttttgattaaaggaaatggcaatattacattccaaactgcaaatgatgatgagaaaagagttctcaaataaataccctaaaggcttttataattaagtaaaatagaaaagaaataaatagagtcatatcaataataatgtagcggggaaaacagaaaattcacctgttaatacattagaaaaaaaatgatgaatctaagaataattatttgatagggagaggaaaaattctaccaaaataggtgagaaaaactctggaatgtctaagaaataaatacatggaaagagaaaaattgaaaacacactgtgtttatcaattgctttataactatttactccaagagttagcagcttgcaacaaccatgttttttttcacatggtttctgaaggttaggaatctggtggcagctcggctgggtggttctggttaacgggttcttgtgaagttgccatcagtgttgtttatggttgcacatccaaaagcttgactggagattgaagatctattttcaagcttacatggcttgcaaacttcttcagtatcatgtgggtctcctcttcatacagcttcatacagcttctcatgatatggcatctggctttcctaagagtgagtgatctaagacagtgagggagatatatatatatatatatatatatatacacacacacacacacacacgtatgtatatacatatatatacatgtatgtgcgtatgtgtatatatacacatacatatgtacgcatatacatatatacacgtgtgtatacatacgtgtatatacacacatatacatatgcgtacacatgtgtgcacatatgcatacacatgtgtgcgcatatgtgtacgcatgtgtgcacatatatatatatcagatgatatatatacagaaagtgagagagcagatacatataaatcttcaaaaccagtccttaactaacaggtctcctctcacacacaaatatatcctattggacctttcaagtatattaacttatgtagcaaaaaggacttgcagatataattaaggttaataatcagtgactataaaatagggatattaacctagattatataagagtattggtgggatgtagggtatgatcatgtgcatggagaaattttcttctgctggagtcaggagaggtatagcagaaaaagctagaaaaattccaatgtgagaaaaatttgtgtgccatttggggcccatatgaaaggcttgaagagaggactctaggagttcagggtggcctctggctgacagacaggaaggaaagagaaccttcattcttcagccacaagaaacagcattctgccaacaacttgaatgagtttggaagtggttttgtttgtttgtttgtttgtttgttttttcctaaaacctcactataaaaacccagctggctgacaccttcatttcagccttgacaaacccacagcaaggacacagttagctgagcctaacaggacttctgacttttagaactgtgatataataactgggtgttgttttaagtcgctaaatttgtgagaagtggttacagtagcaatggaaattgaataccatagcatatacttactctcaaagtgatatgccctctcttttgctatattatgttggtcagagaccaagcagggggatatgggagggaaccatacaaagatgtgaataaaactgaggtgagatcatcaaggactgtattggaggttactactatcctctgacctccacaatacaaattccctcacatatgaaaaatacacacactgccccccaggattccccaaaatctcatcccattttagcatcagcttgaggttcatatgctgttatctaggtccaggcatggatgagattcctggagtgtaggcacttaaatacagttccttggataaaattacttaaatacagctccttgaggatatttcctctctatctagagatagaggcaggttactgccccccccatacccaatatcctggcagacaacagaggataatagttgtagacattcctgttcataaaggcaaaaaataaaaggcacaaaggagacataggtccacagcaattttaacatccaactaggcaaatattggcagttcttaattgttgccaactctgattcctgcccccaaatgctctctgtatctttttgtttaagattctgggtttttggtttctccctttgagttaccctttcttttcatgaatggtagtgcatgttcacactgagtaatttttatagcctgccttcttatttatagatttaagggtccaaggacctctttttattttgtactgtcactgttcttttcaattaaaactggcgattctggtgacataatctgcatacaactttgtagatcttctgtggatcttgttaaggatcactccattgacaaaatttatgtccctgcatcttttctatataagcctcttctctaccctcttccactgagatggctgagatactatactctttaccttcttggaatctctctctacttttttttgttgagaggatttatgatgcgcacccttaaattctttatagggctttttttttttcaccacagagtactatgagacaccccttttaacttttctggagtcttaacaaaggcttttagagtcacgtcattggattctactaattctatccttgtttcccgtcttgggacactggaaatcttcaaaaccagtccttaactgataagtctcctctcacattttactctaaacagagtatattcaacatttttaatggaaatttcctcagctggatcaccccatttgttaggtacattttccatcttccacatcactgcaagtaacaggtttgttggacattttgccactaagtaacaagaatattctttcctcaaatttccaataaaattttcctttctttcccttaactgttcacaggcagcctcctcaacgtcaaaacttttgctaacagtctgttcgaggttttcctaaaactcttcttaaaacccttctacctacttcctattgcctggtttcaaaatgattccacatattaggtatttattgtggcaccacactacttccaatttctaaattttgtgttatttgtcaattgctgcataataaatcatccccaaattttgtggttttgaacagcaaacatttactgtctcacatagtttttgggtactaggaatctttgagtagctgagctaggtgctgctggctcagaatctcttgtgatgctataggcacattgttttctggtgctgcagtattctgaatgtgtgattggggcaggaagatctgttttcaagctcggtcctgtgactgttggcattaggcttttcactatgtggacttctccacagtgttgtttatgtgactctgaatagtcacaatgggggttagtgcttcaattcacaggacttcctataagaaaaaaacgatagggcatttatgctaggggagctggctttcctcgggaagtaataacagagagagagaaagagaaagggagggagagagagaaagagaggagaaataaggacggaaaataatatctcttataagctgtctcagaaatgaacataccatcacttctgatatgttctattggtgacatattctattggttacagtgaccaaatctggtacaatgtagacagggtgtacagaagggtagaaatagtaggaggtggggactcctaggagtctcttggaggctgactactacactacaacttctggcctccaattagtcatgtctctctttttaaattaaaaaaaaagaaatgttggggggtatggaattatactttataattcaggaatgtttgtctcagggaaattaagactcttatccaagacattaccaagacaattgaaacctaacccacctgtattgttccttttcctactgctataaagaactgcccgtgactgggtaatttataaaggaaagatgtttaattgactcacagttctgcattgctggggaggcctcaggaaactttcaatcatggcagaagtcaaaggagaagcaggaaccttcttctcagggcagcaggatggagtgagtgcaagcatgggaaatgccagacacttataaaaccatcagatcttgtgaaaactcactatcatgagaacagcatgggggaaaccgcctccctgatccaattgcctctacctggtccctcccttgacacgtggggataatggagattacaattcaagctgagatttgggtggagtcacagacctgaaccatatcgccacctaaacctcatgcctcacctaaaatcttatgccttttctcttgcaataaaataggataccctggagatctgctatgtatagtactgttttccatagtacataatattcctatactgcttgagcttttgaaattgtctatctttgccagtttttctttatctcagccttcaatttctatcttacctcactggaataagtgttccagatggataaattttctctccacccttccagattactatgtttttgtttgcaataaacatgtatggcattgcctatagcatcatgaaagaaccagacttactgaaatcgcatgaaaactaagtgtaggccaggtgtggtggcctgtaatcccagcactttgggaggctgaggtgggtagatcacgaggtcaagagattgagtctggccaacatggtgaaaccccgtctctactaaaaatacaaattttatatatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctatatatatatagaatatatgtgtgtatatatattctatatatatatagaatatatgtgtgtatatatataatatatatagaatatatgtgtatatataatatatatagaatatatgtgtatatataatatatatagaatatatgtgtatatatagagagtatatgtatatatagaatatatgtatatatggagtatatgtatatatatagaatatatgtgtgtatatatatagaatatatgtatatgtatatagaatatatgtgtgtatatatagaatatatgtgtgtgtgtgtgtgtatatatatatatagagagagagagagagagagagagagagagagagtaagctgggtgtgatggtgtgtgcctgtaatcccagctacttgggaggctgaggcaggagaattgcttgaacccgggaggcggaggttgcagtgagccgagatcacaccactgcactacagtctaggtgacagagcaagactctgtctcaaaaaaaaagaataagagtaaatacgttctgagtaaaaatctatgtgggtcttcctgtattagactgtttaggttgtcataacaaaatactacaaactgagtggcttcaacaacagaaatttgtttctcacagttctaaaggctgggaagttcgagatcaagatgccagctgactcacttcttgttgatagctctgttcctgttgtgtagatggctgccttctcactgtgtcctcacttggcaaagaaagtgagagagccttcgggtttgaatgctgctataagaatacaaatcctttcagatcagtgcttcacccttaagaactcatttaactctaatcaattccttattctaaatcatgcttgaatgtatgagtttgtgggggaatcaattcaattcataggacttcctataaggaaaaaatatagtgctttgactttgggatattatagtattcaaggagctctttttttccaatgggggttttgtttctttacattatttttctcagtatcaatccagacagtgagtttttcatatatttatgttcccaataattaagttactgattataatatggagtttcattattgctgctattttagaaatatgtatttcctgagtttcaggttcaaaacgtttttaaaggaaaacaaaatacactcattaaagagattaatagcaatggaagaaaatgaaaatagcgtacctataggtggacttgagtttgttttcattcacttaagtagcttcttattagagggtcagattggttttatattaatgtgaagagcgcaacaaacccattatatataatagatttatattatacaaagccactgatatattgtggtagattatatgaagctattctcatcattccccttctagacatacatacacacatgcttatatataataatcaaatgagttagttgacaaaaggttttaaagtccgaatttaattcatgaaggtatccattttcttggattaaaattctagtttctgatttttttacatttcaaaaacactatacctttttctaaattatgtatatttttctgtttgtaaggaaagtgtagagcttacaacagagacatagagaaaatattgactatactaaagttagcaactgatatatgttatagatgaactgtaacaaatatgtccttagtgaaatataaaatgatgttgttataataacgttagagttctagttagtactacattcaatttgtattcaatttgcgacaatttaaaagttattaacctatattctaaagttagtaaattattttacaacagtaatttcaacaatggaggctcccatgtgcccatgtatttggatacatttgtctgaaatcattttaatgagcaattaaaaaactcacaaaatagtctttctaatatttgctctcaaaacaactctgagaggtcaactgtttaatatgtttaatgtaatatctattatattctcaattttaccgttcttactaatgaattatgttatgattttattgcctttggaattgaaagcaagataaaatatgctttttgtgttttatacttacatacaacaaagttttgaagtattttttagctctgaaaaggaatgataacaatgactatttggaaataaaatatatcttctactatagaaaacataagcaaatacaacttgttaccaaggtatagtttctggtgtgtgtgtgtgtgtgtgtgtgtgtgtgtgtgtgtgtgaaagacagagtggtggtgtctatgacatactacggtatatttgagattataaactaacaaagcaactcaaacacttgacaacataagagtaaaagataactgaacatgagatgacaattggaaagttaaccttgaagtggtctggaaaattatattatttgctttgtttttgatttgtcaatggagaccaacataaattttccatgtaatggtaagtcattaaaaagtcataaaatatagtttaatagcattgcaattattattttaataaatgttacaattactataatttaaaatacttgcctgaaattaattctaatcatccaaaatacaacttctaatgaaattttcactcttgaatgtttactttaaatcacattgtcttccatatattcaatacttttgggagcaatgctgtggaatgtagaataaatatcagttgttgctattgaaaattgtgaactttaaaaaattttaataaagggataagattataactttttgcttatgatttgtaaaaaagaactgcagtaccctgttttacaaatatatgattgataacattatttggaaatgctatatataccaatcattttcaggtcatttgaaaatttcatgttttaccttaaaataagagaacaaatttaaagtgagccaactcaagtttattaagaaaaagtttgaggcagtttgtttttcagaataataataataatagtattatagtctcagattatgctttatgccaaactgtggtattgtcatctttggtttctggataagattttactgatgccttaggtattattttaataaatgtcataatttattataactgcttaatgcactcaaaattttgcaaagcttcttatactgtataattcagactaaaatttaacataattgtgatggtactttgaaaggcctacaatgttccatgaaagaagaatctgggggcaccaatcactgcattatctacaaacaatatgagtttttgtatcaataatttcacactttccccaaagaaagtcattttttcttgagtatcaacaaaattttatagtgttcatttagcttgcttgtcatttcaacattatgtattgtgtaccatcacaatagggggtgttgaagaagcccattacctactattcttgtcctccattgttcagagcataatgtagatagaaaatgataaaaacaataccttagattcctaagcatagggcatgatagtaatatcatagtagtgacattggaacccgcatgcaagtcattataaattcctgcccttatcatatacatcatacatgaaaatagaagagataatgagtgcaaataaagaagtggaactgagtggcattaatctcagtattgagagattttgtgagtagtacagcattcttttcatgtgctagctgaagttcccaatggcaaattgaatgctgcttatatcattatatgcatgaatgaatatgattgaaataatgcatatgttattatatcaaatccaatttcacgaatattatcaaccaactaaaaagtctaattgctgattagagaacttattatggaggttcttcttaatatgcttcaaattgacattgcatactggactatgtctcatttatgatttagggaacaaaatgtttgacagtgtgcacacacacagccatagtacacacatatgtctatatacatccataagtgcaaccaaatatatacaatatacaaaatgctatgcagtatatcagagccttctctgtgctcttcaaacttggaagaatggatagcaaagctcacataactctccaggaccacattttctcacttcctctaccttagtaaaacaattccacgcatggtccttgtctctgttgtacaatgttgtgtctccaaaacccagcacaaggcatgggacatgggaagcagtcagtggatcaccttagttcaagaatcctctgcttcagtcatgctttatggggccacaggtgttttgagaagatgctttagttatagctttaatgaagcaaagggtgcagcagagaaaagccaacatccttaccatgatcctaaggcagatgccctccctcacctacaactccttctccaaccatatatgccatcactgtccccatccctctctctagtgctgacgccactagcctctgcagctcttccaaataagcttatgcctcagtgacgttactgtacctggaaatcccttccacagatatctacatggcttattccctcacttcattcaaatctctctttatgaatcatcttattagagaaaacttccctgactacctacttaagtggtaccttccaatacctttttttatttattgaactttggtaagtttaagcatgtcttaaatatgtatttgcctattgtctgaaaaacacaagcacaataatgtaagctctaggagaggagtagtttgtcagaattgtactctgtcttactgcttagaattgagtgtagaaaatagaagttcctcaagaagtatctattaaaagaatgaataaattaagaagtgggtccctaacatccatgtcaagaaatttttggtgttgtttcattttgtttaacacaattgacttctaggtaaaatttcttttgtaataaattttctgtgtctaaaaatagtttgaatttttaaagtttgatttattaaaacctgtattacttggtagcacaaattctatgtatttttgatgatactgaggataattctatattaaataagcttacaaaagcaaaaggaaaatagtttgtaaaaccattctgacattcaaatactgacaaatctatttgcaaagataaatctaactttttgttgtagcagtagggtcttgataaaaatttatattattttgccagtaggctcatataaacctgaatctgatactttaaagcactttctccaaataaaattctacatagatctttgcacaaaagcatcaaagtcaagtggacagaatttagaagctgaaacaatgaaaacttctggctgaatgcaaactgggacgataatcagcactcttagggtgtgtgggcaaagagagagggaataaaaggatggagtacgcaaatggtaatcattctcctaatcaattctatcatatggagaaaaatagaaagacagacaaggaaatagcagaggctattgaagaccggccatatcttcatgaactcagagaaagagcagagttatgcaaggaatggccctccaacatgccatagcctgcacactagtgaatttgctatattctatgtcatggatactgataaatccaattgacaactcctctttctatatgaaggaatgagaaaaaggagttgttttttgcactgtgatgaatatgcactcgatatgtaaattaacccaatgattaatacaaagcagggagtagtagacgcttaaagaatagggaggcttagtattcctatgggaatacagacaaagagactttgacttttctagggttatatggaaagatttcaaagagaaagtgagatttgaggtagacagtgaaagttgggcacaatttgaattgcccagcgtccaggaaggcattttaagatgaggaaatattatgaactctagaggagaaatagtcaaagaacccatgagtatgtaagattggctggactatatttttcccaccgtttatttcagtttttttctatgtcatgtattgtatttagttataattaactattcaattctctcttatatatttgtcaatataaatatttgtttaacatacatttaaatataattattctaaggggctgtattttagattatgtttatgtttatacattagcttagaaaaatactgaaatccacaaaaaatagtatattttaagtaaaaggaaattaaaaccatataaaatgtcttattgttaaacttatgaaatactagaacagttacaaagaaacaattaaaatgatttgttagaaaacatcagtgacagaaataacatatgctgtctggtagaaactttacctccaaacagctattttcatatcgtactttcgtatttccttaggagacataataggttttaaactatgccttattactacgttgtgaagttgggaaaaaagaaaatagactgtgtatgtaactatagcactttaataaaacatagtgtaagtatttgtctaatttaataatgccaattaactgaaaacagtttctagtcaatttgtctgcctctggtatagcaaaaaaaaaaaaaaaaaaaaaaaaaaatctaagaaactatcatatgtgtttttaaaataaagtttatattttatgttaaaagagggaaaaaacaaaatgctacaaagcatttatttttattgatcttgagatctgagcaaatttatactttatgggaatcccagtagggaaaatagaaggacatctaaagttcatttcctcaaggtgggggaagtcttcttaatttgtcttgcattatatttattcacatactcatcagctatttattaattcatacatgtatttgttcattcattcagtttagtctaaactttgactccttttcacctggccctgtccttggtctaactcgggcatgacactttccaatttcttctgcaatacctactgcctgcctacctcattctgcctttctcattagatccgaattaggacctcagaagctcactaacctgcaggatatagacagtctgaattttggatctagcaatcgtgtaatttagatcttgtttaatggtccatgctacctatgctttcaatctcagactgattttctgataaatcaagttaaaattaaacaagtttgacaaattaagttagactgtatcttttatttccaaattcagctccctaaatactcattcataaactaatataccactattcatatttccatttttagctttctggcttctgcctgagcctagaatcctaaactcggacaattgtagctttgtccacttggccgatatttaatttctcaattaagtatatatttggcactgtgatgaagggactgtactgggatctgcacacattttcaaaaggtatgcatgcctttaattcctaagggcttaaattctaataaatggcataaaagcaatacataacagaaaaactatataattataaaatataaaatatatatatacatatttatattataaaaatataaaattttaatataaatataaaaataatagtgtaaatataaacatatttgtataaatgttatatatttataaaatagataaaatgtaattagagtgcgttataacaaactttgttgagtggaaggagataatgtattttaaatacatacatcttatacttgcaaaaactaaccagctgaagtgggagaaaaaagggattgaaaatctggggatctgaaatgattgtactgtaagatagataaataattagtgagataactgcctaaactgttccaagagagtgtttttaacccctttaaataaaccaagattattcatacaaatgcatgctatgagcacttgataaagctaacagacagaaagtcagtaaagatatagaacttgaacagcactatcagccaaatttccctaatggagatttatagtatactccacccaacaacagtagaatatactttcttcttaagtatacgtggagcatcatcgagatagactgtatcttgggccataaaacaagatcaataaaattaagatgatttaaatcttacagagtatgtttcctgaacaaaactgaattaaattagaaatcgataaagatatctggaaagtctccaggtgcttttaaattaaacaacacattttaaatagctcaaaggttaaagaggaattcacaggagaattagaaataatctgaccagaatgaaagcataacatatcaaaatttgtgggatagtgttcagcaaggttacagaattcaaagtcaacacacagaaatcagtcttgtttctatatactagccatgcacaattgtaccaacattttagatttttttaaattaaaaaaaaaaacattcaaaatagctcccaaaatataaatacacaggtataactctaacaagacatacaggatctgtatgttgaaaactacaaaacacttaagaaatctgagaagacctcaaaacatgaaagacatacagggtttgtggtttgcaagtcacaatatggttaaagatgaaaattctccccaaattaacaagtagattcaatgtaattcctatcaaaatttcagcagtatttttgtagagatggacaaatagttcagttgtgtagaatgtggagttctactattgcagctatggaagtaggcagtgcaaggctgtgcagctaacaggccggagtttcaaggctttgaactggatctaggtttgtgctgggtcaggttgtgggatagtgtcatatgatgaaactgttctgcaatagatttaatatcaacagggaaaatatgtattctacaatggattgagactgctaggacaataagaatgattctccaattagttactgcttgttttgtgggccctgactctgtagcttgggcctggacaacactaagaacacagtatccatctttctgccttttcatttatcaagagtgagttccctaatgtttacttgcctatgatcacccttcattctatatccccattgtctgccatacagaacataaaactaactcagtttgcggaatggaaaagcaagtgccagttgcattatatctacatttatgtctacgtttgcattatcacatggtgcgttatcatggggttttcctgcttttatttttcaatttctcttgcttctaaagctctaatttgatcaatccatttgagcatgcccttactaaaaatacctattccttatgacccaaccagtcctcatggcttcaggatagaccacagccaggaacagtcatatctgaaccactatatttacgtaagatatgacttctagtggaaacaatttctgatggaataatcaaaattctacttccttaataggcaaataaagagttaatactattaatatttagccagcattttgaaaattgtataatgttcaaatcgatgtcagacattttcattttatcttgattatacataaatatagggagtatatatgatttgcctgtagttatgtaaatgacagaaatggttaatgagcccagagtccaagcctagtattctttttatgaaaccttaggaagtacaatgttattaaatagtcatagcagtatatagtgttcatattgcaaaaaaataaaaattgccttgattttagaatagccactaattttatatcatatttgcattgatttcaataatttatatattattcctgagtgatttcagaaaggatctgacatggggtgatctttatgtctactagaaaggtgtccaatctaaactgagtaccttcccctttgacatttctacatctttatttgttgcttcaaaataagggtaattagaaatgtatgtggttacaaatggcagattatataaaaataatatccctagaaatgtgttttatatttacctttgaatattaacatatctaaatatgggtgctaaacttcccttagctaaaatactagagttgtattattgtggagaaagactgtattagagctaagaaattaatcacttttttgcaatacacgtgattcttaaacaatgcaatggttaggggaaccaactgcccacacagtcagaaatctgagtataacttttgacattcccaaaccttagctactaaatgcctactgttgactggaagctttactgataagataattgacacaaataactgataagttaattgacacaaatgtatattacatgtattatatactctgttcttataataaagtaagctagagaaaagaaaaatgttactaagaaaattataaggaagagacaatatatttactattcattaagtggaaggggatcatcctaaaggtcttcatccttgttatcttcacgttgagtaggctgaggaagacgaggaacaggaggagatggtcttgttgtcttaggggtggctgaggaggaggaaaatctatgtataagtggactcatgtagtttaaacccatgttgttaaggttccagtgtatgtttgctcaatatctctaagaagccactgaaaaaagtgccccatatggaatttgtaaaacagctgtggaattttgccgcttgaaccactttgtttcctcacatgaacttgactgatggaaacagcaacagcagtagcttacagggatggcagcaggtataggtctccccagtttcttccttctccaaatccacttatttttttttcttttttttattattatactttaagttctgaggtacatgtgcagaacgtgcaggtttgctacgtaggtatacacgtgccatggtggtttgctcacccatcaacccatcatctacattaggtatgtctcctaatgctatctctcccctagcccccactccccgtcaggccctggtgtgtgatgttcccctccctgtgtccatgtgttcccattgttcaactcccacttatgagtgagaacatgtggtgtttggttttctgttcctgtattactttgttaaaaatgatggtttccagcttcatccacatttctgcaaagggcatgaactcattcctttttatggctgcatagtactccatggtgtatatgtgccacattttctttattcagtctatcactgatgggcatttgggttggttctaagtctttgctattgtgaacagtgctgcaataaacatgtgtacatgtgtctttatagtaaaatataaatccactattttatggtttggcatcctcacattccatttattcatctgaatccatgttttccattccctggtgctcctggacccccgcacttgtcccacgctgcatttctaccttgtcctgatgctctgactgctagggatgaggcaatcatgagtcatgtacctacttagagccagtctgtattttagactgatttaaaaggagagcaataattaatgcaaaattgcctttcctgggacttttaatgggtggatttccaagtctttaccaagcaacacactgagctgtaagaagaaatggcaaagtcagtgtgataattaatctagtggttcaccactctcaaggggacattttgacaattgagagtttatttatttatttatttatttatttatttattcttgtttcagtgattcacgggcactgctgtcatgtagtgggtgcagccaggtaggccaagcatgttgctgcgagtagggcagtcctgcataatgaagacttgttttgtgtcacatcggacttcaaaatgccccatgcatactcataaagaaagaaaaagcctgttaatatattttacaatttttcttacattttattttcaaattttaatttttagcctaaaacccaagtccactttgaaaataaacacaaagccccgtttataaagttttactacatactgttttccaggaatgcaactactatttgaaccaaggtgatattttactgaattttaccagaaccttaccgagaattgtttagcgttgcagaaactcttctccgtgacagtaatgccacttgaatttgaatttcctagacagtacaccttaactgtttgcatttatggtcgtcacagctataatgaatgattccatatgtaggtatgagtcactgactccatcattatgtctcttggtgtagttgggcctgagcatatattttgaaaaacacattttttgatatatattactgactacattttttacattaaagttaggttaatatatccatttttaaaattattatctgttaatttcattttgatatagtagatgggactttaaacatatttgttttctaaaggaacattctttaaatttgatgatttttttaaatcatagaattaaggattactgtttgaagaaattaagcagactagtaccgaataataggtgcaaaaattgcataataagttatttagctgaacaaaatacatgctaattacaaaagcctgatgattggtttgtaataactgacacacttatatgcatcagtcgatatttctatcatgtgtaaattgtgctacatacagatgataaaacaaagtcatataaaagttggccttataatacagatgtctaataggcatataagtcatccttaccaactttcagcctgctgaccagtcgtgtaatgaaaatggatggcacctgaatgagaaaacaattatgtggctatctgaaggagggtggtcataccaaaaggatgaacaaaatacttcaagcaaaactaacagcaacataacgagctaagaagtgacaggcacaaacacaagtggatcatgttgacttgaagcaagcagagtttgagctgtttcactgtctcattgaaacagaagagtatgctcagcgtgaaactaagagacagcttacagagaatgacaccctgcaggtagcagctgctgctgacacccaacgggcagaatatagagaaggtatatttgtttatttatgcaatttgtgaggaattgattgcctgacataattcacccttttcagacccatgcttataactaggaagcatcaaggtcaatatcccagtcacacagtgcaaaatattttgccatatgtacaggattgaatgtaatggcagaagtcatttcaacaggactgctgtcaatatatcatttgcatatgtacaaataatttgttaactatggttgttcttaacatattcacaagtaaaccccctaaggcataattacaatagcactgcctattcaatccctatttttgttctggaaattatacctacattgagcctagttctaggttcaggccaaaaaacaagggatatgcaactttaaggggaagaaatactgactccataaatatccatatagctttttaagaaagatttgcttaataggaaaacggtgttttctcacgtaaaattcaggttttgtttaacaaacatattgaatccaaagataaagtatagtataaagtaataggatgtgcttctgtattgaaatactggtagttttaaattcttgacatgaataactggatatggcatatgtaaatctaccaagaaataaaacagaggtcttaaaatgtaaagacatgataggacatatttatcaccccataaaacaaactggcattttcatatcctaagctggccactttgttgtatttgtgtatgggtcctcactacaaagttctgtccctgatttgggaacatcacacatgagaggtaaaaagcacatggtagatgagggatacaaataccattctgtttatgattctaacagatcgatttgtgatacaaaaaccatgggtagaatttgagaataattagtgtgatacgatgttataaatacaaaggaagtatgtgtgtgatttttttttcaaacttggttttctatttcttacagacagtagttttctttgaaagtattaattagttcactgtttgtgtgattttatgggcaggaggagtgactatccattgtgatggcagtaaaaggtaacgtgccctaatgtagttcatagtaatgacgagggacacatgccaggtgacatattttaatgaaatgttaaatgaattaccaagaaaaaagggaacttaattttcaatatgaaaggaagaggccattgaataaataaagtggaggtgagataacagattctcaaaggattcttaaaaatctgccatgttatatcattctggtcaacagaatgattcatatttcattaactgattatagataaaatattagatcctgttacaagttatgtgtcttacagttcagttattattcacataggtatttcagagggagaaaatgattttccatcctttttttttttttttttacaacattaggggaaaataattactattaaaccttctgtttccattcactggatctgagatgaagtggatttccttacatattcatgactgctttggttaaataccatctattctgaattttattctccatattacagctataatataaaggaaataaatatgctttccttaaatgtatcaatggagcaaaaattgtttttataataaagaacaaatccaaagacaggcaattcagttaatcatataatttaaaggttattgcaaggtcttggataaccctgaatatttatttttccaccagctcactatcttatttgcatcttttcttatgtgttctaagatccctgcaactggaataatttctcttgataaaagaataaagaaaagatttaattatggtatttattattgtattttgaaggtaaatattaaaaatatgctttgatggaatgggctcaagagaaatgggaatgaggatgctagttgagaagacttctcatgcgtcctcctcatttcataagcatagattaattaaattaactagttgctcaccaaagcctgacataagaatgatgaggtgcagaagccactaagttttaatgtgtgttaaaaacagcagcaaaaactgttaggggcttagtgagtatcatggactatctgcaggtgggtttccatggaggaggagcccaggggagccccaaggaagtataaggcggggtggggctcaggaaaagcagatttaaagcttgagagcaccatgctgtgctgatattatagcagagaaaaaaactgattttacctttcctaactcctttctcttcttgccatgaatagcatatatggaattacttttaaatatgtgatgaatacatgtatatccgtgacacatgagtctctgcctgcaaatcagttatgtaagaaatatggcatttccttgtttactagaagtcaagctaatttagacatgactctctttcttatatgtctagctagaaattctaccttagtcattcttagggcatctcttccctatggtggtgccaagttcctggagccttattctacattagtcatcaggagcccttcctagttgttggtcatctgcccactgctgaaataaatgttcagtgtcccagcttcatggtaatgtgccttactttgttgttatacatggaccatctttggatgaagggtgaaacttaggactaggatccagcctctcagatgaatcctgtggtgtttccctctgagatctggctaccttttccaggcaatgcaatagaatgatactaaattctttccttctcacagagcctgacaagcatacatacccctttcctactccaagggaatctacctcactctttctccttgtccttgaaagcttccctaaagccttctcttctttcagagataactagcatgagcttagagtttcataaaagatgagaaacacttctgactccaggtagtttctggtctctgtccatccaatattccagaggcaaggaattacaaagcctgtttccctgcttcactggaaaaaatagggggaaatcaccaggagtataaatgcaaattagtatttcaataaattatactaccattgaggaagaatctcacacatttatgtcaccaggaatactgataatgaaggaattaattccaaaatacaattttaaagcagatacctaatggctaagttctgacaaagagtatagatctgatttgtgcattatgcatgtaactatttcagagacatggaaattaaatcatatttaagacatatttgatgtattatatttactgaaaataataaaattctgtaaaatcaggactgtcaggaaaagtcagaatgtagccactgtactcagttatagaataaaagcagatatatcttggccattgaatcacagtgccttaaaataagatagtaaagtaatgaggaagctctcctactaatgctattctttttttttttttttttttttgagatggagtctctccctgtcactcaggctggagtgcaatggcgcgatctctgctcactgcaacctctgcctctcaggttcaagcgattctcctgcctcagcctcccaagtagctgagattacaggcatgtgccactgggccaggctaattttttgtgtctttagtagagacggggtttcaccatgttggccaggctggtctcgaactcctgacctcgtgatctgcccacctcggcctcccaaagtgctgggattacaggtgtgagccgccgcacccggccctactaatgctattattctaaactaattgccctttctaggtttgcctgcctggattgtgttttttaaatattttttcttatatgttatattcttgttagatggctagaatgctctagggtctggaaagagggacaacatcctttgggtaaatggaaaagttgaactaattgagaaaaatattctgtgtttaaattatgtttgccatttttagtattttcatttttagggactacatatgctgacttaggaagttcaagctaggtttaattttcttcctttgatagcttcacataacccacactttccctccaaatattcctcatctttcacctttgcttatagttgttatagaatttattaaagagtaagaagaaaagaaaataatagacataccaggggctcaggaataatactatatagaaaattacatactgttggcctttagtttttgaacatgattaaatgtgaaatattgctataaaacttttattcagctcagaagggttcggcctacataacagaaagtgggagataatggggaactaattttccaaaaacaaatttcttattttatcattttgtataaagtcatttctgacatatcatggcagcaaaaacatgataaataaagtcaacagtaatgttgtgtacttgatctactgtggcaaaactgaaggtcccctgttagtcctaatatattttcccactttctttttaacagtgaattatatcctcattcaaacattaaaaaatactcttttgctgacattttaaagaagaggtgtccaatcttttggcttccccaggccacattgaaagaagaagaattgtcttgggccacacataaaatacactagtgatagctgatgaggttataaaaaaattgccagtctcataatgttttaaaaaactttagtaatttatgttggaccacattcagagtcattctgggctgcatgcagcccatgggccatgggttggacaagcttgttttgtaacaacacagtggaaaaatggaacccttacattgataccatcaagaatggtaagcaaggtatacacatttaatactcttaaggagcttacattcttgagaacaagagtgtgaattaaagtcagaaatttcagttaactaaattatactgttagatgagaaaataaaaactaaaatactggaagtttctatagtctttactgggcaatcaattattgtgccctttttgttgatcatgtgattaaggtaattaaaatccacgtaaatctcagcaagtatatttttaaacaatagattcaaaatttcaagatgaattccaaagggaaggatactgcattgagggttaaatactgggaagtgatatggtttggctttgtgtccccacccaaatctcatcttgaattgtactcccataattcccatgtgttctgggaggaccaggtgggagataatttgaatcatgggggtggtttcccccatactgttctcatggtagtgaataagtctcacgagatctgatggttttatcaagggttttccacttttacatcttcctcattttctcttgctgcctccataagaagtgcctttcacctcctgccatgattctgaggcctccccagccatgcagaactctaagtccaataaacctttttttcttcccattcttgggtatgtctttatcagcagcatggaaacagactagtagagtaaactggtaccagtagagtgggatgttgctgaaaagttacctgaaaatgtggcagcaactttggaactggttaacaggcagaggttggaacagattgaagacaggaaaatgtgggaaagtttggaactttctatagactagttgaatggctttgaccaaaagcttgatagtgatatggacactaaggtccaggctgaggtggtctcagatggagatgaggaacttgttggaaattggagaaaggtgactcttgttatgttttagcaaagagactggtggcattttgcccctgccctagggatttgtggaactttgaacttgagagagatgatttagggtatctggtgcaagaaatttctaagcagtaaaactcaagcgatgacttgggtgctgttaaaggcattcagttttataagggaagcagagcatgaaaaattcagaaaatttgcagcctgacaatgtgataaaaaagaaaaacccattttctgaggagaaattcaagccagctgcagaaatttgcataagtaacaacgaggggaatgttaatccccaagacaatggggaaaatgtctccagggcatgtcagaggtcttcacggcagcccctcccatcacaggctaggaggcttaggagaaaatggtttcatgtgcctggcccaggatccccatgttgtatgcagcctaaggactttttgccctgcatcccagatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcagggtgctcatgaagaacctctgctagggcagtgtggaagagaaatgtgtggctggagcccccatacacagtccttactggggcactgcctagtggggctgtgagaagagggccaccgtcttccagaccctagaatggtagatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatgtgagacttggagtcaaaggacattattttggagctttaaaatttgactgcctcactggatttcagacttgcatgggccctgtaaccactttgtttgtgccaatttctcccatttggaagggctgtatttacccaatacctgtacccctattgtatctaggaagtaactagcttgcttttgattttacaggctcataggtggaagggatttgccttgtctcagatgagactttggactgtggacttttgagttaatgctgaaatgagttaagactttgggggactgttgggaaggcataattggttttcaaatgtgaggacatgagatttggaggggccaggggtagaatgatatggtttggctctgtgtccccacccacatctcatcttgaattgtactcccataatttctacttgttgtgggtgggacccagtgggagatcatttgaattatcagagcggtttcccccacactgttctcagggtactgaataagtctcacgagttctgacggttttatcaggggtttccgcttttgcatcatcctcattttctgttgctgcctttcactcctgggccattattttgagggctcccctaccatatggaactgtaagtccaatgaaacctctttttcttcacagtcttgagtatgtctttatcagcagcatgaaaacagactaatataggaagtaatggtgtctcttcagagaacacgaagatttgtcgtttcattaaaaataaatatttattgagtacccactctgggctagctatgtacaactgttaagtgatggattgtgacatataaggccagagtcctcatggagtgtttaactctacacagggctgacaagtgtaagagggaacaagaacataaataaataagctaaattcagctagtgattggtgctaaaaaggaaataaacaggataatgtgatagtgatgtgtgttgtgggtccattcgggtttctagctctttatggtcagaagatactgagctttgaaggcaagctctgcgcatgaggaaacaggtgggttaaatagattttttttttctctgacaatcaagcccctggataacctaagcgttttcgccttcatttcagccaggctttttctcctttattctatgcttgctgggccctttactctctaatagccaaactactagagctagagatcttgcctttgtcattaacttttcctgttcccaatatctgctttctaagatctctttcaggaggtagatatggaaaggaaaacagacataaaatttgaatgtatcattgtggctacatgtgaacatattgcattaaattaattgatagaaagaagtttgaataaaatattttagaagaggtttttgaatttagagtttatgaggttatacttctttatcaacttacagttaacaatgaagttattcccaagcatctttaaagctaatttatttccttttgtgtttaaagttttttgaaggaaatatatgcctcaaaacaattctgttgaccttttctatctatctatttatctataaaacaaaacattaaatggttccttgatggttttaagtcatggaatttttagaagctaaaagtgatttaactgcagaacattaaaaaacagcactgtatgattgaaactatgagctttcattctttcttacccaggtctggggttcaggcacatgaaggattgactttcatagttccacatcataaggcacagattgtaaagtatatgtaaccattttacttagtctattaactttcagaaacccaaaccaagagaatcactcagcaatgtgacatttcacttttagctcttactgtcctttataatattcaggtaaaataatattttaaactagtttagactgtggcacatgcagtacataccttgatggtacggatgacaggcatcaaacctaaactctgtaaaaaatctgtgtaaataactcttattttactttacactgaaagtaaagtaaaataaggactcaatggtaaactatttctttattaatacacacattcttattttacatttcagagtaaagtaagagtttgtgcgtattagtccgttttcatgctgatgataaagacatacttgagactgggcaatttataaagaaaaagaggtttaatggactcacagttccatgtgtctgaggaggcttcacaattgtggctgaatgtgaaaggcacagcttgcatggtggcagacaagagagaatgagagccgagcgaaaggggtttccccttataaaaccatcagatgtcttgagacttattcactaccaagagaacagtatgggggaaactatctccctgattcaatcatctcccactaggtccctccacgacatgtgggaattatgggaactccaattcaagatgagatttgggtggggacacagccaaaccatatatttgtgtattaataaagaaatagtttactattgcatccttaagaattgaggcacttacatatagctcacattcattcttactcttctgagtctcagtatcaaatgggctggattaaaaataaataaaaaacaaaacaataaataaggcaaggggaactcaagtgaacacatggataaaatgattagataataaatggaattattcgagaaatattttaaaaattagtgtaattataaaaggtaaataaattctagataaacactgtattaatcagggttctccagtgaaacagaaccaataggagaaagagagagagagagatagatgcaattatggaggcaggaagtcccacgatgtgctgtctgcaagctggaggcacaggaaagccagtggtacagttccagtccaaacctgaaggtctgtgaaccaaggcagtcagtgctctaagtcctggtccaagttcaaaggcctgagaaccaggagctctgatatccgacagcaggagaatatggatgtcccagattgagcaaagagcaaactcaccattttagttatatttatgccctcaatggattgaatggtgccctcttacattggcgagggacatctcctttactcagtctactgatccaaatgttaatctcttctagaaacaccttcacagacatacccagcagtaacattttaccatctggacatacttatcctggtcaagttgacacataaaattatcgcattgagaatattaggcatccaatagtggtgtgcttgcaagcccactctcagaataataaaggcctcgatatgtagcatttgacaacttccgtagtgtaaataccctcaccataacacatttcagaggatcaacctgaagttgctgaatgtgaagttgggaagcaatgtataccattttcccgtgtgaaccagtacgagtcaactgcagtgtaccactgtattagaccagttaatatatttaaaaatgtttctaatccacagaaatggacttatctgacactgtgggagatcggttaatataaattaattttctagatagtggccatttcacctgtaagcaaatagtgtctatttattaaagataatttctatacaatgtatatgttttctgcctatagagcataatttcatcaattcttgatgatctaagttcctcagttgatattaatcttatgtgaacaatcaggaaggtagtataatggttaaaagaacatagtcttaaaccaactgtttgggataaaatcctgcctctactattgtgtaatgttgagtgttactcaggttccttctacctcagtttccttctctgttaattggggaaattataagtgttgttagttcttgttattcaaggcagttatattctataaagtcaccacaaacactgaattagtaaatactggattattgttttgaggggaaatacaggggttaatttcctggaagctgattcatcaaccaatcaatacctgcattgttttgtgtatgttcctatttaaagataatttatttaatatatatagttgaatcattaacatggaccacatagacaacagcactatcacttgtgtgtgaacaaagcttactgacaaatgtacgttctctctaagacacatcacagcctttttgcatttaggatcactagacagcacatagcgctacagccaagggctgttttaaatagggaaatcaccaacaaaaaatcacagaagcatgaaaaacatggcaataaatagactgttaaagccaccctgtttatagtatgagagttgaaacacaaaggtagggctttgcctagtttcaacacaaatgggaacatgcacatcaggtgactcaaatttttcaagcttctgcccatgcctgtgtctacaaatgagcaaaaagggctgtgagtataatttgggagttactgtcaaagatcaacaaagctggacactagttaaagtggtaagatcaggtggtaatcagtaatatactgctgcagaagggaagagggtctggcgtgacctgaattcaacttagatttgtacaaggaggactgggcattttaaagagagaattgtagaatagggagaagggtgagcagggactcagtagagtcagggtagcaaaaaattacaaagtgttggtcactgtaaatgattcaatcctccagcagagacggggaggcaagctgttcctcctgatatttacattttaagagaatggctttcaggtcctttgagaaacatactccttaattgtaggagacacataggtatctcaaagggataaaggaaggatccacaattgtaagacctttgtagtaaatgctctaaaaaaggtgtcggggcttatcatcaggtgtgggctagagtagtcgattcttttggcagccctaaaaaaggtgtccgcggcttatcatcaggtgtgggctggagtagtcaattcttttggcagccatgagcttccccaggcaggatcttaaatggggctgggtcatcctagggatgcaggcttgatctagtgcttattcaagtcttttcataggagggtgggagaatttcatgttcgctgacagcctgtagattttataggccaagcatgagacctagtcagggagttccgaggagcctggctagcatttgagcaaagagagaatatttgtgattacaaatatattttattaaataggcaaattcgcaaatatgaaatcacaaataatgagggtcgaccgtattttcacattgttgttatttaattatgtaaattgcttagaacactaagcactcaataaatgtctgcttaaattataatgtaagatgtaggaagtgttgagttataaagctgtttgttttgatctttatcagcctgcctcaggttgctattttaatatttggtcttctttttgttttatattttcggttttccagtttactgccaagcttccactttttctcactgttagtttgtgctactctggccttttaaccccagccctcctgcacccatattctttgcgaaaatgtttcagttgactatttaacaaggctgagtgaggacttgaaggcactctgagttgctagctctactatgatcattttatttgttcaccttttgcttttagacccaagatcctgcccgtgttccaggtacttgaggttgttaggggtctgccttttatgtgaggtggatttttatgaccatttgggaacaatgttcaatttattagtatatttttatcatcgagggttttggccaagaacttcttttgtttaggagctgtggcctggccatgatccaacctggctgagatgctcagaccacgtgattttcatacagacacagactgtggtgaatcttatggtagagcttgcggcagactccatggtagattttatttagatctcacgtctccactgaataaccaactgaatttcatggctacaaagaaaggaactatcacatgatgaattattttatattatttttgacaatataaaacaaataaatgttttcattataaaagtattcttgacttttgaagtaaaatttgggtgtcactcgaggactttgcctggctaaggtgcaaaattcttgtgaattttaaaaatagcttatatataaacctttacagaaaactaggaggtgaggaaaatccctcatgaacttggatgttatgaattgcagtctagggatttaaataggtttcacttatgttcatgttggattgttagagtaggtatttcatgaataattttatctcagataaactcatgatagattttatcattttattttggttcaattatataaatgctatttaaaatccagctcttactaagggttaatatggtaatgaattctagtattccctttgaaaacacggatagatattttttaatctttttttcatgttcacttaaaaaatatcttgctactgtctttatatcaatgtttcataattctattagccacattttgttgacctgcatattcctacaagcctgaattttaagttacaactttgtattcaatattagtagtattaaaacaaacatatcaaaggaaataaaaaccctaaaatttaatgtttcacaaaggaactctgtgttaaaacagtgtccttttagagttaacatatgtatgggagatgcattttaaataaagatgtatctgacctggaagagtagacaaatctgctttacagcaagttgaaagtttagagaaatatttatcattcagttaccaaaataacaaattaaagcagcaaggaaagagaaaagagaggagatgaaaggaaataaaggaaaaccaagacgtaagttaagaaagagctattgcttgtgaacttcttcctaaaaaatgatagaaaaaaaagataagaaacagaaaattgcatgagacttcagtgtttatgttttgatggaaatgtacaaatcattttcattctttgcagtgctgtcatgctccatcactttagtccattttcaccttccaaagaaattctgaatgggccttccttctctggcagctaattaatctttcacaagcctactcttgcagcctgtctgccagggatgccccacaccttaagccagtgactcacgagcagatttcttaccctcttgagcagtactttcttcccttgagctatgtgaagacctagcttttctattttgtttcggaaactatgtgagctgtaatatatcattgaagaattgctccttcccccccaccaccataagtgaatataaagtgttcctgaatcatttaattgggtaataatgacaacaaagtctgaatataaattatgaatgtgtacagcattttaccaatagtgtatatcatatagatgtaaggacacatattactagattataaattctctgtgtatatacatttgttagattatcattgtaataacacaaatgtacttatatttataataatgttgcatttgcctaaaaatactaataaaactgcaaataaaaataatttttagtctaattaatggaagatttggtatatgaatttttttttaagttagagcataattctttacagattgaaatgcctcagttaaaacaaaacaatatggccagggatggtggctcgtgcctgcaatcccagcattttgggaggccaaagctggaagatttcttgaggccacaagtttgagaccagcctggacaatatagcaagactctatctctacaaaaaaaaaaaatgtgtgaaattaaaaagtttggtatacattctttttgtatgcaaatgtttccatctgttgtcatttcaatttaatctgaataacttcttttcagcctttctggtagaaaacatctgctgtcaatgactttatcaggttttatttatctaaaaaatgttttattctcgttattgaaggaattctgggctgaatattgaattttcagccctcaaaaaagtgatctgcctccattatttctgttaaaatgtcagttgctatttgtataattgctctgcacattatgtttatctgtggctgctttagagattttgttttatgttttgcttttgacagttgactattatatacttaggtgcattctttctgttgttaagcatgtttggattttgctgagctttttcaatcttgatatgaatattgataggaatgttgacatgaaaaatatcaatgttgatagttttcattaaattgcagaagattttagccatcatttctgcaaaaatatttctacctcatctccctccctccttctcttcacccctctctgataacacaattatacttatgttagaccttgtaatatttttctactgattattgagactgtaatccatggtttttcaatattttttctgttcttcaaatcagataatttctattaatctcttttcattctcactactattttttccttcagtacccaatctgatattttgctcacccagctaacattttaatttcacatttacttatccattcttacatagacctctttttttatggtttgcagttaccttctgagattctctatctgtgcacccattataactatatgtttctttaaatctttgaacataataataataaatcatttgtagtcttggtctttgatttccaatgtttgattcagagtctgttctgttctatgtatttttttatttttcttgtgtatggattacatttttacctttccacttatgtacatatgtagcatttaaaaaaaaaaattacatgctggggctgggtgtagtggctcacgcctgtaatcccagcactttgggaggccaaagtgggtggattacttgaggtcaggagttcgacaccagcctggccgacatggtgaaaccctgtctccactaaaaatacaaaaatcagcctggtgtgctggcacaggcctgtagccccagctactccagaggctgaggtaggagaatcgcttgaaccggggagacagaggttgcagtgagccaagatcgtgccactgcactccagcctgggcaacagagcaagactccatctcaaaaaaaaaaaaaaaatacatgctagatgttgttaatgactaatttggagaaatctatattaggttttctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaacagcaaaccatacttagcgttactttgccttactgttagcatcttcttataatttctacttttgcaataacatatatacatacatgcatatatatacatacacatattatattatatatacacacacacacagaaaccatgtgtatatttttattagtttagaactaataaaaatgtcataaagttagtctaggaaaattcaatggaaaaatcaatagcttcttctttgctgacaaaacaaaaacaaaagttaaaagtgcaaattaacaatatcaacaaaaatatcctatacacataaagatgtttgtgtaatgtgaaagaataaatctgcataataacagtgaagtgtgtaaataagtatggacacacgtataaggatatgccaggttctttcattgaaagagacacatttctttataaactaatatataggtttaatgaaattccaaggagatcctaataatgtttctgctttgagtgtatttggtaaataaagttattctaacctttatatctccttagataatagcaattgataaataaagctggagggaaaagattcatgagaaagactagcctaccggttattaatctataaatttactatacagtaaatattgtagaactgaagaaagattgataacccaatcaatgaaatagaagttagagcccttaaacagactcttaattatgtactatacaatataaaatcctttatttaaaaagggaactcttcttgagacttcttcagtaaatcaaagtcatcatttttttcccttcagcctttccccattttgacttgctgattctcaaatccctttctatctaaatcttgtatatcttttgactttgtatatctaaagtttcatctgtttcaaagaaactttattccactgtttgatgagattttatttttagatttttttcattatcacacaagtaaaacactattcagtgtaggaaagagtagactttaaaagtacttagaaacacacccttaaaataagtaatgataaaatattagtatgataacctttccaatttttgtatgctatagataagatgtacattcaaacccttctattcataataatagcatactataaatattatagaagttaattcttctttactgaacagcataacttgaaaattattttaaatattattgtataagcattctcattcttattatcaatgtattatacatatattatagttaatgatatagatgtatcactgtttgcttggacagtcttttcctatgaatatttggatggtttctaagtaattgatcttctaaacaagaatgcagaaacatccttgcaggtttattttttcacatttgtcagttcttttcattgagatacatttataggtggtaaaatttgcatttttaaaaagcatttaaatcatattgataaaggatctataagatgttgacaattcctagctatatactctttccagcaatccatctgtgtccactttcccccattcttaccacttaagttttagaagttagagaagataaaattatcctgtcactgttttagtatataagttttaggacagttaaaatgttttatgttatcattaagcataaggctaccattgacattaatttctatatctgtaattcatatttacattatttgacacaggattttggacagtctttttcaaattagtatggttatctggtttatttgttttgacattcaaactagttgaacattttttctgtttgtcttggaaaattgagtgcttcttggaatgtatcgtgattgtcttaaaggtataatatatgactaagtgtgttattttagctaactaattaaaatatatatttgtaaaatgagcctttattttccctaccatcttcttaactgttttctggaacttttggcatctaggatttgcaacacacatttttatgatgtgtgagattgtggggagctagcatactactgtgcctaaattactttacttgggtccccaattacactgaactagccatgccttttccgtattttctgtattccctggaatttgtgtatctgattataggaaaatggtggtgagtttgtgatgaaatgacatagaataacaaggagtagaactagtctattgtacttcttagataggctcatagagtttgaatcacactgctgtcaatgtcttagttcctaaaagccacagaactcaggatcacttggcagatagatgatggagccttttcacaattcttgactacttcatgaagcaaagctatggcttgactgaatagaattctcaactgaatagaattctcaactcagccaaattgggaatttgtttgtctgttggtattttttaatgtgtttgcatgctttagtctctggttgtatctttgtggatgatacatatatcctaatacttagttataatttcataacaaatgcctcaacccaagattttaattttacatgcatttgataaaattttaaaggatatttaagagtattattaaataagaatcttctgtatttctgatatattaacattgaaatcacttgatgtgaaatcttgaataattttactatttactatagtatctgtgaaaaaaatcatttttgttaaaaatgtatgtatgtgtgtatatatttgtgtgtgtgtgcacgcatgtgtatgtgttgaatgattttattgcattcaatactatatttggcccaaatctttactattgaatgtaatacaatcaatcattcaacacgtaagtactgaatgcctaacgtgtagcagggactattctatggatacaatttttttttaaagactaaagtctctgcctttggggagacttttagtagaaggagaaagataaaataagaaaaataatgagtatgttagatgacacatgttgtggagaagaaatcaggaatcagggaaataatgtaagaaatcttttgctggtggggaaaaatgatgttgtgattctaattaagatacagctagaaccaaggtctaaataaggtttggtggggagccttcccaatatctgggggaagagtgttccagagagagaaaactgcaagtacaaaaactcaggagtagtaatgtgcctggtatgtgtttgaggatcaagcaaggagcagcaggagtggatgagtgaggaaagaggggttggaaaatataaaatgaggccagagagtgttggtgggtaggaagagtgggacaaattctgtagtctggtagactatttggatgactggcatttactcagggtggtatgggaagatattggagggcttcgagcaaagaggtacattatctgcattaccttttatcacactagtgggcggggagaggggaaggcaatggtggaagcagaaaaatccactgtggctattctgatccatctatgcaaaagatgacaatggatgggaccagaatgatagcaaagaggaagatgtggttagagaaaattaaacacacaaaagaaaagaatgtggagaagagaagatgatcagggacttggaaaatgtggaattgccccaaaaacaaatcttactcaaacttaactctatgcctttccctactaattcagccttcaaagaagcgacaaattactcagtcactcacaaaacaaaaataaataaaacgtatgaaatttaatacattttgctcttaacagctgtatggaggtgtaattgatttggtttatttttggaattgcacttgtttaatgtatacaatttgatgaatttggacatatgcataaacctatgcataatatcaccacaatcaaggtaataaatatattcaccacctccaaaagtttccgtgtgtgtgtattttagtggtaagaacaatcaacatgagatctagtctctcaacctaattttaagtgcacaatactatgttgttaactttaggcactcttgtacagcagagctctagcccttattcatcttacataatggaaactttatattcattgactaactctctatttcccccttccgcaggtcctagcaaccactattttgttttcttcttttgtgactttgactattttagatacctcatctaagtggaatcacacagtatttgcctttctgaggttggattatttcacttagcacaatgtcttccaggttcacccatgttgtcccaaatagaatttccttctttttatggctaaaaactgttgcattgtatgtatataccatatgatccagcactcccatgttcattacagcattattcataacagccgagatgtagaaacaactcaaatgcccatcagcagataaatggataaacacacttttatttcttactttggcattgtatattgacattgtaaatagatcttgtcaattaatattttatgtatatggtataaagaggtcctggatttttagtgccatagttagaaatttgaggtccatctgaaatcaactaaaaatgcaaagatttctggtaataacatgtctttcaagttaatttaagtctatgagtctttacttaaatggctctgtgttcagagatgatgaacttacagcagatttgattccaaaataaacctaggagactgtaacagatgccattgatacctctccccctaacctcacgtttatctgcagctgtactgcaattcctgggtcccttatctacttcccacctcaagggttttcatctgcatctctctgtttctctgcctaaggcaatgccacagcttactaggctcaagtttgaggaagttaatgtccctggggacaggtagaagtcactggataaatagctcagcattgttgtccctcagtaggacagttgtgaagcatgttttatatgattcttcagggagtctttgtattagtttgttctcactttgctataaagaactacctgagtttccagtttttctgctctgttttttccccatctttgtggttttatctacttttggtctttgatgatggtgatgtacagatgggtttttggtgtggatgtcagttttccttctaacagacagaaccctcagctgcaggtctgttggagtttgctagaggtccaaccatgatagactggattaagaaaatgtggcacatatgcaccatggaatactatgcagccataaaaaatgatgagttcatgtcctttgtagggacatggatgaaattggaaatcatccttctcagtaaactatcgcaaggacaaaaaaccaaacaccgcatgttctcactcataggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaacatgaaaaaaaaaagaaaaaataaaaagagctacctgagactggaagacctttacgaagaaaacaggtttaattgactcacagttttacaggctctataggaagcacagctggggaggtctcaggaaactaacaatcatgacagaaggcaaagaggaagcaggcatatcttcacagtggtgcagcaggagagagagagaaccaaggggggaagtgctacacacttttaaacaaccagatctcatgagaactcattcactatcactagaaccaagggggaaatctgcccccatgatccagtcacctcccaccaggcccctcctccaacactgagaattacaattcaacatgagaactgggtgaggacacagagacaaatcatgtcagtcttcaataagtccaagttccagttgctcatagtgttcccatagcataccctttactggcttttgcccttctttatttcccttttcccctcccttgcatgcactttctggttcacctcccaaataaatgaacttcaaagtatttgtcttagggtacacttgggggtcccacatcaagccaggcagagacactttaatgaagttgctcatgtctggttgacaaaacaaaaggttcaagaatgttcctcaggaattaagcaaaggtgattgttagctccatctactttgttttacccctctttgatcttattggtctcactgtgaccagcattaaagaaacaaagggtcttgagctggtacagctcaaaatggtgaatctgttgctgtttccataattaatcatttttgtcaatagttataagtgaacagagccatgaaatgcagaatgcataataggaagctgaaaatttatgggcatattgaagacatgtaacaattgcctgtatgaataacaaaggagcaggaatacagcttctcggaggctaggatctgagtttctgacatctagaataaagttaggaagaacttaagtgctacaataacaaaagatgccactggatttacagtttggctgaattctagggaaatcacatgttgtaaggccttggtaaagatcagattcagaaattatttttaaaaagaagaatttggaaaagataaagtaaaaccccaaattctatattaatttttgatgtagatttactttggaggcataccaagtgtttctggcttggaaaagtttaggtgcaaagactatggatgagcaaatgttcagtggtccttttctttccctcttatggcataatctaagcctcaggaacagaaatatccataatccataaaatgctttttttatgttatacaaagaatcagaaagacacgacttgtttagaaattcaaaagactgttaacagagaacacacacatctcctctgacatgaaaattttcagataaatcaggcagcagagaaagacaaagtcagaaaatgtttatcgttttcctgcaattattggaaacatgaaatatttttggtcaaagcagagggaaccaaattaaggtaataatgtgtaataactaataaaccgataaagtaggtgacaactgcagcaaatgcatgatcacttatttttccccaagattactgtcattattcttatgggtatgtgggtgtgggcaaggggaaataaggcccatgtaaataaaatgtaattctttgcttgagatatttatagttttgtggttgaaaaacatatataaacatgttatttcagtacagtgtgaaaagggcactgggtttttggcagagttagatgcagagaagtggcatgatctgattatattttcgaagaattactgtggctttcttgctgagaagagactgagagggggctggaagacaataatccaggcagaagagtttggtggactagggacaagatggtagcagtgagctgatgagaacatgacacaaaaagattatattcaaccatttattcatgccttcatgcatccatccattcactcatttagacataggtccagtcttaccaaaaagttgtaagaataacacaacagacacttcacccagatttcccaagtgttaacattttactatttttttttatatttttctctctttgtctgagagagagaaatagacttatatttctccaaaatattgactaaattgtaggcatgataccccttcacctctaaatacacctccaaatataccagggtataatatctaaaaacaacaacattctctgaaacaatcttagaaaaattatccaattcagttttaacactgatacagctatctaatctacagaactttttcaaatttgttaacctgccccaatagtgcctttataacaaaagaaaatccataatcatgtattgcattcagttagttgtcttgtctctttagttccctttaatctggaatagttcatttctctttcattgtgtttcatgatattgacattttggaaaagtacaggccagctatttatagaatgtctcccgatttgtgtttgtctaatatttcttcttgtttacattcaccttatgcaggtttcatagaaatacctcagaagtgatgctcttttcacagaattttatatcaggaggcacatgctgttgatcagtgtcattaacggtgatgttaactttgatcacttggttatggtagactctgctgtctctctactgtaaagcagaatatttaactttgtaattaaaaaatatcttattattttcacactgtgttaaatatcccatgtgttctccagatttcacctattagtgttacaggatctttggggcattgctttgccagctggaaacctccatggccagtggtgtctttgcttgagttttgcttgggcctgctgggccaactcagcaggctgctgttagctcacacctctggcctggattgcatgcctgccaagggcaagtggagcagcaaggggtgtgtgagagagacagcatggggtctagccactgtgcatagccaggcacgctggctgcagcggggtgggcagctccaggcactgacacaggtgctggctccctgtgaggctgcagccagaccagacatcctgaaagcagcttccacagctggcaccagggaatgctgcagcacctggaagctttaagatgccaggaactgcaaagccccatagaggatgtcacggccctggcttaaggagctcctaggtctgggctcccctaagggctgcagatcttctctccttctttttgcctgcaacatggcaagcaagggccatgttttagccttgctcatgttacagctctttcatccctgccattcggcaggtcctgagttcttgaacctgtgcccaggaagaatgaggtatgtggacaagtggagctgaataattctatttttcaagtggatggtgagcaaggtgaaaaggagctttattgtgtgatgtaacagctcagaggagacacgcagtggatagctactctccacagctagggtgtcacaacaagtattcagctctctgcagagaggagaccgtggggtaggtagctcctctctgcagctggtcttatcatcatctcctcaagtctggctgagtctggggcttttatgggcctcagaggggaggaagtgcacactgattaatctatgagcagcctgaataaagcacaagttcccactcgcgtccatgggcccagcagcccggcccccaggcttcaggccctccccagctcacaggtgggacttcaccagggacctgccccttatgcccaggagcctgtctgctttctgctgccattcatggcgcccaggccattcatgccaagggaaacctgtaggccaatgccaagctgccctcagcagcccctcaacccccctcacatacttgttggtgcccaaagtccagagggggctgaggcaacaggggactggcatgtcagtgctgccttgagagtgtgcacacactggcaacctgcaacagtgcccaggctcagccccaatcttgctccaagattggagtgtgcgccaggagcagggagagggcagacagtaggagcagacacttctgagcccctgggggcgggggtccttcctgtgcccccaagagtgcagagctgccaggtctgcagccatggcttgggtggctgtaactgtgctcttgcctgcttccagcctccaaaagcacaaggaagcccacatccacagccatggctggatggtcagagctgtgcccagggagcacgaagttcctgccctgtcaactcagaaggggatggcacttctgcctgttcccagatcctgccagctccatggagtgcacagccctggcatgccttccccactgcagccggtgtcatgcagtggccgctgtagattaaccaccactgccatgactagttttaatatccattgatgattctcactttcattgattactaccaagatggttgttatgataatttttaaattccatcatttatttttattaatttattttctaccaaaaggaatagcttttccttcatcctaattttcatttatatcagtggattaatgtatttctattttgtacaataggttattcttattgtcattatttatttgaatgttcaaattgtcacattcttggccaatggaaattttttcaagtaggccacagttgcccttttgacatggaccataattctttgagcactctcccaactttcagcacagaatgttgcagggtcctcttgtactttccttggcttagcactggagtcagccatttcttcaagaaactctggttcctttcagtacagaatggtattagagatcaagattagggttctatctgtaaccatcaccacaggggagtcgttgcttctaggcattgttaatattaataaacaaagccagaaatagaaagataactgtgtattacactcactcacctgtctctatttagctaactagctatattaaaaacagttgatacacactggtttctctgcttccattccaacatagcaggataattgtattttctccctttttatacttataactgtcctctctactagtgacaaacagctcccattatttataatatattcacttacatgtttaatcttacaatgtacagaaagtagggtcagtgttactaacctagacatctaagaaagaggcctactcagtagcattcagtatttatttagggttctttttgtctttagctggaaaacatatagtccaactatggttagatcttctcccattacttcttagtgttatttattcaaaatattatttatttaaagtatactgggtcatttgtttctgtttctgttcaattttagaatttttcaccttcctttttgttttattattttcttttttgtgtctgtgaaatactaatattctaaaagtgagatctatattaaatttcacttttaactaaattatttcctttcttgtgttgtcgtttagttgatttctttatatattcatgtatttttaagcagataatttaattcatttaggcatattcatttttattgatgaaatgtttgaggttatagggtttccttttatcactattttatgtgccacagattctcatataaatagagatagatagtatgtatactttaatatacacatatatgtgtatgtttttattattccttgtttagaaattctttaaatttgttttgtattttcatattcacccaacttgtttaataaaagttatttttgattatttattccaatcgtatgaccttttaccttttttattttaaaataatctgttttttgttattagagattaaattgtaatatttataattatgaaatgtacttatgtaacttagtatatgattacattttaagaatgcccaatgaatgtttgagaagaagatgtattcactattacttgagtgtaaagttctgtgtgtataatatctaccttactgattaggttttgcaggacttctatatcctgttctgtgtgcacttgattgatcttatatcaattctgatatattaacatctcctaggcttgtatgtttctatctgtgtctttttgattctccttaattttttgctttataaaagtgtctactatgttattttggtgcatagatattgatagttgtcatgcctattttgtgaattcaggcttttaacattgaaaagaataatttttcccatatttaatgcttcttagcaaagtttaatattaactttgtttgataccaatattgcctttgctctgttattattcccagaagcctggtgtgtgtgtgtgtgtgtgtgtgtgtgtgtgtgtgtgtgtgtgtgtgtgtatccaagtctttctatttagcctttctgaattattttgcatatgttttggatgcagaacatattgggttttactttgtgagtcaaattgaaaataatttccttctaatggttgtgttaatcttatccattcacattaattgacgtgctaaatgtctaatgtcagctctgttattttatgtaataattatcatgtgtactgtgttatatttgctgtgtttctctatacaaagtagagtattgacctcttttattctattttgtaatttcttttggtgtttaggaaagactgtacttttgttctagcagtcaatttttaattctttttacattttcttattcttttgcttttgttttaacatgtttctgtgttgtttgcattttgaatgacatattttaacacaaactattacctacacagcaacttccctattttctctcttctgtcaatttcagttctgttatttctactttgtcagaacatataacacacactatgtagcatataacataaaatattattactccactctcaactttatctttgttttagtcttagatttacaattacatatactaaaagcttaccatttgtaatactgctgaaatttctcaattcatttctttttttttagattttttttaatactttaagttttagggtacatgtgcacaatgtgcaggttagttacatatatatacatgtgccatgttggtgtgctgcacccagtaactggtcatttaacattaggtatatctccaaatgctatccctcccccctccccctaccccacaacaagccctggtgtgtgatgttccccttcctgtgtccatgtgttctcattgttcaattcccacctatgagtgagaacacgcagtgtttggttttttgtccttgtgatagtttgctgagaatgatggtttccagcttcatccatgtgcctacaaaggacatgaaatcattattttttatggctgcatagtattccatggtgtatatgggccacattttcttaatccagtctatcattgacggacatttgggttggttccaagtctttgctattgtgaatagtgccgcaataaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatcgccattctaactggtgtgagatggtatctcactgtggttttgatttgcatttctctgatggccagtgatgatgagcattttttcatgtgtcttttggctgcataaatgtcttcttttgagaagtgtctgttcacatccttcgcccactttttaatggggttgtttggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactccaacaaatttacaagaaattcatttctttgttggattctgtggcacttaaaactgtttttccatagcattgatccttgactgaccacttaactggctataaaatttttcattcataccatcttcccttgaattatttgaaaatgctactcctctctaccttattttgctttgtttttgtatttggcaataaagataaagtttaatacacatgaagctggccataccacagtgagatagagttattactcaaacaacctctctgagactttaggggctagggtttttcaaagatagtttgggtgagcggtgggggtggttaggcttgcagcctagggttgcttgcagctgattggctaggggtacagtcatagggttgtagaaaattgtccttctgcacactcagtcatttctggtggggccacaggagtggttagtgggcccaggtggagccaatggtcgtcagacatggaaaaaacctgaaaagatatcttaaagggccaagcttagcttctgcaatagtgatgttatctgcaggagtaataggggaagttgcatagcctgggacctccagaataatggctggcaattgcttatgtctacaccttagcagaattcaggcccctctatcctcctagcctggtggtctctcatttgctttagaagtgtagttgaatttgggggaaggactgatatctctttcttccattcttttaaacttttattttaagttcaggggtgtaagtgcaggtttgttacataggtatacttgtgtcataggggtttgtttcatcacccagttattaagcctagtattcattagttgtttttcctgatcctctctccactcccaccctttaccctcccaaaatccccggtgtgtattgttcccctctatgtgtccatgtgttctcatcatttagctcccacttataagtgagaacatgtggtatttggttttctgttcctgtgttagtttactaactaaggataatggcctccagctccatccatgtccctgcagaggacatgatctcattcttttttgtggctgcatagtattccatggggtatatggagtaccttattttgtatgtagcgttttggaagtctgatgccaactatttttcttgtcattgtttttatttctttatttattggctaaagtctgcatatttttcttcttcatctgtaaaaatttggtatttttactttaacatcattttgaactgattattactaatcaattttctctgctactcattgagccctttcagcatttagattcaggacttcttttatttctgaaaggctatttgaattgtcctttaaaaattaattcttttccattattttacttatattccttggagactccagttatagtaaattggatcttctttgcctatcttccattttaagcactttctttctgagcctttttgtttattttatttttattttctttgttgtttttctattttttaaatgaacattgttatacttttatttgaatatattctttcttgggtatctcgtaatttactttttctgatatgattttgtctttttaaatccttttttttctctttttagtgtttgaatttatggtttaagttttttgttctgttttgctttgtttttgctccatacctcaaagtgtttgttcattaatttagtttggagtattgtgttaaagttttcttctttttcactgttactttttgggggttgcagaaggaggattgtatcagctgaattgtttatattctcattctctgatttctttttgtagtttttaataaacaaagactctttgcacttctacattttaatggtctaggttggtgatttgtagtagtttcttttttttttttaaatcatggctaaaaaatgtcctatgtagtcagtgtgaaaaaagcatagtttcattacaaagtgcatttttttttaggggaagattttataagggactaagttattagtcttccaattgtattgtattgtctcttatcttgctcaatctaaatttctctctcgcttctttttcacttcaccatataatttccaaagggcacttatttcttgcttttgattctcttcttgaagactgatgccaacctcttgaagactgattccttgcatactgtatgcatattctttccctgtgatcactgctctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttctttttctttttctttttcttttttttttgagacagagtctctctctgttgcccagactgaagtgcagtggcacgatcttgaattactgcaacctctatctcctgggttcgtgggtccaagtgattctcctgcttcagcctcccaagtagctgggattacagacgtgcatcaccatgcccagctaatttcagctggaagttttctaaaccttggataccaaattaaacttgacccggatatatattagtttggtgcaaaagttattgtggtttttgcattaaaagtaatgggaaaaactgcagttacttttgccccaaccccaaaattttatcccatgaagaagtaaaaacaaaaacaaaacaacaacaacaacaacaacaacaacaacaaaaactccttacctctattttatacatgtttgaggcttcatattcttttctgtgcccaaacaaaatttctttatttgttttccccctatctcatcataggaaaaatattatcctttggaagagattctacaagaaataaagatagttcaatgtttcctaagattgaaactttggcgaagatttgaacatactaagtgaatgatgtcttcacactttcttttccttatttctgtgcttctcattcctgatttgtgttacagagtctaaaaatcttctcattctagtacagagagcaatgcaactctcctaagagtctcctgcaaatttatctacccaagctaaagtgctcagcagtaaaaaaattccacctttgttagagggaagttttgatgaaatatagcacatttttactttgttagtatagtgggttaaaaaaggttttatggtctatatattggttgttaacagaagaatctcttgaggacagtgagctaacataaaagaatgaattttcaaatcagacttataagaatctgagatcttacctaatattcaagctttactaaataatgtcaaaaaaactcatgcaaagtagagtgaggactctggtacaccaaaggtcacatatcagatcctgtattttcaccttagtcatgcagttctgcccaaggatactagatcagatctctatatgacaaccttgagatcacctcatgcagtgggaatatttaaattatgaaacaccctcatttaataaatctaacactagtatagcctatttcacattttccagggagaagagcctgatatatcctggtttctatagtttacccttagttaggacatcttgtgaagtgcatttcagagattaagtctcttctttctagcaaatatctatagtccatttaaccaaatatctcattagcaaggaggtagaatggggtcagctgccaacatttttccccaggagcactcaaccccccaaaaggaaattaatcaatttcaggcaagctgctttaatttctttctttcattgatttgctgtgattttctcttttgtatttttttctaaaaccgtgggtattaaatacataattgtcagaaaaattgatgtaatggaaatggggaaaaaactcagtcatatattgtgatgttagaacaattcatttacctggttgcagctctggtctatctgtatataaatagcagacttcatgccttacgattcagtcacctgaagaacagtgtagtggccgaattgcttagataattgatattatatttatggtatctgagacagaatgaagattttttattaaatccctttgaagattagaaaataatgtcaatagtttgtatatttaatactatatatgtttatatattcatataacatatacacacttatatgttcatgtaatacacacaagcatatgtatacatataccatataagtcccttattattattgtagtaaatcaaagttctatatctatatactgcttaactacacataacttcctattattcttccctgttctttagtctctaattttatatagagtaagaattatatattattgtcttattttctgagcagaggtgtggtggattattccccaaaggtcttgttttctctgtttcttttatatttcatgtcaacattttcttgttgttttccaatttcttccataaaaatgtaatacaaagaatatcataatagcaatctttacatatgcattatttttaatttataaaggactaagaactgtttctgtgttctaaatactctaagtaatacattttctaagtaataaaataattttgagaaatgctataaatgtcatgttcatctttccattcataaaatactattctttctgctaccgtgctgtggtttctcccaatcaacagagttgcttatagacactctctgaagtcacgtccacccctggacaacttgatagatggcttttaagaaagaaatgaaacattatttgggggagggtggaacaatatggaagaatataaagcttcatccatcatcccacccacaagaacacaaaattaacaagtatctacaccaaaattgccttcatcagaaccaaaaatcaggtgagcattcagagtacctgcttttaacttcatactgaaagaggcactgaaaaggatagaaaagacagtcttgaattgccattgccacccctccttcatcccctggcagaggccacatgggatggagagaaaatttttgcacttaagagagggagagttcaacaattgtgaggcattgcattgaactcagtgctgccctgtcacagcacaaagcaaaactggactgaactcagctgatatctgcccttggaggaagtgtttaaaccagccctagccagagaggaattgcccatcccagtggttggaatttgagttctagcaagccttaacactgtgggcggaagtgctctggggccctaaataaacttgaaaggtaggctagaaaaccaggactgcagcacctaggcaattcctagtgctgagctgggctcagagccactgcactttggtggcacattgacctactgagacaccagtcagggtggtaagcgagtgcttatgcagcccctcccccagccccaggctgcacagcttgtgccccaaaagagaccccttccatctacttgaggagagcagagggaataataaagagaactttgtcttgcatcttaaataccagctctgccagagtaggatagggcaccgtaagagttgtgagacctcctttccaggccctagctcctggatgacgtttctagatataccctgggccagaagggaacctgttgccctgaagggaaagacccagtcctggcaggatccatcacctgttgattaaaaagctcttgggccctgaataatcagcagcaatatccaggttgtatgccattggccttggatgacaccctgagactttctggcttcagctgagactcagcacattccaagatgtggtaactatggggagagactcttgcttgagaaagcagagggaaacgtaaaggggactttgtctttcaccttagatatcacctcatccctgggggttagagcaccaagcaggctgtcctgaatattcttgggaatgatcaatgagttaatgaagtgattaagaagaaaatttaaaattttcttgaaacaaatgttaatgaaaacacatcatactaaaatgtgtgggatacagccaaagcagtactaagaggcaagtttatagctttaagtgcctacatcaaaaaaagaagaaaaacttcaaacaaataacctaacctagttcttaaagaattagaaaagcaagagcaaaccaaatgcaaaattagcagaaaagaaataataaaaatcagagcagaaataaatgaatttgaaatgaagaaaggaatacaaaagatcaatggaacaaaaagacagttttttgaaaagttaaaattgacatactttgagccagactaagtaaaaaagagagaagatgcaaataaataaaatctgaaatgaaaaagaagacactataactgataccatagaaattgaaaggattattagcagccactacaagcaattataagccaataaatttgaaaacctagaaaaaaatggataaatggctagacacatacaacctaccaagattgaaccatgaagaaatccaaaacctaaacagaccaataacaagtattgagatcatagttgtaataaaaactctcccagcaaagaaagtccaggactcaatgccttcactgataaattctacaaaactttaaaaaaaagaaataatccaaatcttactcaaactatttccaaaaatatgtgaagatggaatacttccaaactcattctgtgagaccagtattaccctgataccaaaaccagacaaagatacatcaaaaaaggaaagtacaagtcaatgtcactgatgaatattgatacaaaaatcctcaaccaaatattagcaaattgaattaaacaataccttaaaaagattattcctcatgaacaagtaggatttgttccaggaatgcaaggatggtctaacatacacaaatcaatcaatgtgatacatatcaacagaatgatactgaatggaggaaaactgaaagcttttcctctaagatgaggaacatgacaaggatgcctactttcaccgttattcaacatagtgctggaagtcctagttagagcaatcagacaagagaacgaaataaaaaatatccaaattggaaaggaagaagttaaattatcctggttcacagatgatatgatcttatatttggaaatacctaaagacttcacaagaaaactgttaaaacttataaacaaattcagtaatgttccaggataaaaaattaatatacaaaaattggtaccatttctatatgtcaaaagtaaacaatctgaaaaaaaaaaacaatttagcaatcccatttacattaggtacaaataaaataatataactaggaattaactaaaaaagtgaaagatctcttaaatgaaaactataaaaaattgatacaagaatttgaagagaatgccaaaaatggaaagatattccatgttcatggattgaaagaatcagtattgttaaaatgtccatactacccaaaacaatctacagattcaatgcaatctttataaaaataccaatgatattcttcacagaaatagaaaaaacagtcctaatattcatatggaaccacaaaagacctagaatatccaaagctatcctaagcaaaaaagaacaaaactggaggaatcacattacctgacttcaaattatgctccagagctttgattaatcataaccaaagcagcatgatactggcataaaagcaggtacatagaccaatggaacagaatagagaacccagaaacaaatccacacacctacagtgaactcacttttgacaaaagtgccgagaacacacacctgggggaaaaatatcttttcaataaatgttgctggaaaagcaggatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataaggtattagtaactagaatatataaggagctcaaacaactctataaaaaattctaatactctgatttaaaaaatgggcaaaatacctgaatagacatttctcaaaaggagacatacagatggcaaacaggtatatgaaaaggtgctcagcatcattgatcttcacagaagtgcaaatcaatgctacaatgagatatcatgtcaccccagttaaaatggcttttatccaaaagtcaggtaataacaaacactggtaaggatgtggagaaaaggaaccctcctcatacactgttggtggtaatgtaaattaatacaaccgctatagagaacagtttggaggttcctcaaaaaactaaaaatagagctatcataagatctagcaatcccatgcctaggtatatactccaaagaaaggaaatcagtgtatagaggagatacctgcacttccatgtttattgcagcactattcatgatagccaagatttggaagcaacctaagtgcccatcgacacttaggttatcaacagatgactggacaaagaaaatgtggtacatttacagaatggaatattattcagctattaaaaaaatgtcatcttctcacttgcaacaacatggatgaaactggaggtcattatgttaagtgaagtatgccaggcacacaaagacaaactgcatgttctcacttacttgtggaagctaaaaattaaaacaattgaacctatggagatagagagtaggatgattaccagagactaggaagggggtagtagacgggtggcggggggaagtaggaatgattaatagacacaaaatatagaaagaatgaataagacctagtatttgctaacacaacagggtgactataataaaaattatttaattgtacactgtaaaataactgaaggagtataattggattgtttataacacaaagaataaatgcttgatgtgatggataccctaatgtgattattacacattgcatgcctgtattaaaatatctcatgtaacccataaatatatacacctatgtacctacacaaattaaaaaagaaacaaaaaaatcttattattccatattggtgaaatataaggagaatttagtagtttagactccctccctccctcccttctttcctttcttccttctctccttcccaacagggtctctctgttgcccaggctggagtgaaattgtacaagcatagctgactgcagccttgaactcctgggctcaagcaatcctcctgcctcagcctcccaagtagctaggactacaggcatgcaccatcatgcctagctaaattttaaacattttctagagatgaggtctactatgttgcccaggctgatctcaaagagtttagacattttcaaaggagaaaatgtgcttatagcaatctgaaaaagcttatctcaattgactgaaaaggaacagttaagaaattaaatggagctttgttgtattaaaggaagtcttgatcttgatcacatgaaccgaagcacctctccttttccgtcaatatttgacttttaaaatctggattacccagactataaacatgaaagttgcttttttaaaactcctgtcatgctctctgacttgcaataatctcttgagctttctttcagaagtgacagtgctagtttggagaaaattttattttctggtaaagtgaattaatttttctagttacatatatttcattgtaaatatatttctagtgctagttgatggcaggagtttctgttgatataaattgtgaacttcaaaatacatgtttttaaataaatgttttccatcataccatatagtattatttttctaatgtgtctcaaaatcacatttgtggttgtgcattcagtgggctccatggcagagctggggaccagcggggctgccccacagccattgtaagtttattgtgagaaagttggacgcagccctggggactcctgtgagcagtatctcaggatggcagcactaggccaacctgaaattaatttttgaagggaagttatatttacgtcacaaattaaaaggttaaacttttttaaaaaaataccttcttatacattttatagaaacgtcatttgaaaaataaaaaagagatataacatatgttctgaaacagagtttctggaaatagtttctggaaaagaagaatgtgtaacagattttattggtatatttcattcctttcagtgagagcttttatttgaaaggtgtcttgatttctacacctttggagacaatcaacacggctggtgtggtcccattagaggtcatattaagaatacccatgagtgagctcctcttagtgggaagaggcgagaagtgaagccatatggaaaaaactacctctcttagggacacggtggtaatctcaatcatgaagatcaagaagtgaaggcaagtctagcccaactattctttagctgaagaatcagctaatgaagttatgtttaaatccacagtcctgggccccagctaaaaaaaaaaaaaaaaattcagtttatcttgcggatcccaggactgcatattttaacaagcatcctgagtcaattaagctgattctctgaacacactttgagaaacattcatctggccctttctgtatcagcatcaatatctgagtggtctgatctgagcaactgaggcagaacacagcagaagagcttcaagtcgctatattcttgtccaagaacttaacgtaattcatattacttaagtaattaatgttattaatgacatagaacagaattgggactctttttaagtctcatagaaaattagaaagcaatgtatgtactccatatatgtgtatatatacatataaaagtattatgtattttaaaaagcccatatgtttgcctcattatcattgcaacaaatcaaaattccagatctatatacagtcagccctttgtgtccataggttccccatcctcccatcttctttttctccctctctgtcaccagactatttcttctcctgagttatcagactaaattattttcctaccaaaatcatttcagcttttgtaaaaaaagatcaacctgcaaaagagattatagggtgtgagccaaaccatgacagtccctggtagaacactcttgcacatgttttactctccaacattatcgttgagtagactcagaatgcagaaggatgagctctgccaggaacgtggggttgcttgtttccctgaagactagttatgactgtcttttttgaaccatgcaatcatagcagtgtcttgacctttaatattgatgacataatggtttgttatgttttaattaagctctaagaatatttctggcaatttagtattacctctcctgtggcctacacccagaagttaccctttcaaggacgacgtaaaatatgattctgctaatgctagtgttttacatgccagtcttttattcagctcatggtgttttcttttctcctaaaaatactttatagcaaaggaatcacatctcaaaaagaaaaggcatttattaaactaagggtagaaataagaagaccaaaaggaattgccaagaaaagcttttactaatgcttcacattaggaatctgcagaagcctgtgaatgaggaaatggccagatttagggaacttgaataattgcctttggagagcaaagttgtattaatctcattggctttttgatttgctattttcctccccatcttattcacttcaatttttgtattttcttttttcttagagtgctaactttcatgttgcttttctaaattatgcactacccctgctgtctgtcccattctaattaggccttttctatttatacttacaatagtgtaaaatctcaagacacaacttttcttgctcctagagtaggtgagccacaaatgagaagttcagatagatgcagtttaacagagtcagcaagaatactgacatacccatgagaaatctgccttccaggtctgacaggtgacacctttgcaatgatcagccttaatggttgatctgcattactaacatttccttggtaatctgatgtcacattgcaagcagctcaatattatagggtttttatcctacatcattagacgtacttcataaattttgcccaagaggcagacttggcttttacatatttctgtttatttaatgaaaaatagatttcccttttttcttcctatgtgatttgtaatactgcatattaatagatattgaatagaaaatacttgtatcatattctcaaacatttgaatgtgctatataagctctattcatgtcaagtaggacaatgattttatttactttttcaattattatgacatcatttttattggtaggactatttttgcatggagtagaaaagggcagccaatttaaaaagcttcttacgatagaagcattgtcattgttctccacctagtacctattgcagtttttcctaaagtaaattgaattaactggacaaggagcttggtgacccaaattttacttcagctatcaggcgaccttctttgtagcaaaagtgaatcccttagaagtcttttgacctttgttcacagttacacagctttcaacgttttctggtttaactcagagcgcagcacagagttacaaacgaaagagacaccttgcccctggggcacaaccaattcatttccagataattcatacctgcaaaactctgacttgcctgcaccagccacagactccactgttgattgcagtgttgcagctaaattatctggaatcaaggtccagtctatatatcccagatatagttttggagaaatcttttctctttatatcgtatattataagaataataatataaactcaatcaagaaaagctatttttaaaatactaaactgaaaaatttatctgccaattttaattgcactttggttccccctgtatatgctgatacccaatctcaatgtgagactgatttttcttctcatacttcccctctgtttgctccttacagcaaagttccatcaaaaaaatgaatattaactaaaaagagacgaaaaaagggaaacttcataacttactgactttctataaaacatcctttatttcctagcaatgtggttgaggtgcgttagaggaagacaagaaggcaaaaactgaaaacgtcttctctagaaatgacagagttttttctgcctacattcaacttgaataggccttaatgtttttgatctgtttgagaccactactcaaatattctgtagagttcacatgggaccaaaaattgatttaagacatgaaaattagacctgttgacaaaagctaagggaagtgaggttatttcacctggaggagaaagacaaggaaggcatgcaattcgagcatggaaagggtattgcataaaatacggatgacagctattccatttgaacctgagtttcacatttaattccatttgagcaaaaatgcagttcagttttaatttataagaggagaaatttggaatctatattaaatcttcttaactagaacaaaaaaaaatgaaaattaaacattcttcagttataattagaaccaagattgtctttgcttaataaggcctgaaagcaaagacgttttttagatgagaatgggtatgactgtgtgcttagtacttaccatatctcagaccctttgaagcaggagtaggcctctagaaaattatgaggacttctgtgtagtctcactgctttttatgtatggcagagaagtacaaagcaaaagaaacctttccccagaaaaacccctggaatacaaccaattcactcaacaggtaattcatacctagaaaaatggtttggtagcaccaaagactccaatgctaatttcaacgttgtacacaaattatcaggagtcaaggtccaggctaacacagcttcgccaatgtaatgatcacaacagtacaagtgatgaaacagaggcagaaagaagtagcttgaccagactcacacagccagtaagtgacaaggttagctgagaatcagtctattcatgccaaagcttatattctttccattattttacaatatatacctaagtgaagtttaaaagtcctttgcaaactctggattctaccaatacatgtcattaatgatagataagaatattttagttttgttttatgtgctaagtagaattcaaggttaataataggacaatgaaataactttctcactcacccccactccctttttttttaaaaacggagtctccctcttgttgccctgtacggagcctcccttttgttggagggcagtggcacaatctcggctcactgaaacctccgcctcccgggttcaagcaattctcctgcctcagcctctgaagtagctgggattacaggtgcccgcccccatacccggctaatttttgtatctttagtatagacggggttttgccgtattggccaggctggtctcgaactcctgacctcaggtgatccgcctgccttggcctcccaaagtgctgggattacaggtgtgagccactgtgcccagccctcacttccccgttttaaaattctaaaaccctatatctccttatggctaaatataaagtaacaattaaaatctcagagagcgttcataattcaagcttttatttatccaattgttcttatcagaagttcttaaactgttttttatagagcagtaaagagtataaaagagaatatgtgagaataaaatacttcctttgcaaaattcaatatatttctgaggcctaacagaccccaatgaagaaaatatccaccaaattattaacttcaatgagaatgagagttgaggcatatagtataatatttctataattttttttgctgaacatagcatggtttaatgaacaataacctttgacttcttacagagaatccatatctctaaatcaaaatgtatttgtgttcctctctgcttatatagttacatatatcatctcagcccaaagatatattttttgttgcaaatttaaggtgattaaatggtttttaatggtagcaatgttgcagttttaattacagtgtttattatcatgaagaatttaatgtaaatatatgacaattagcagtattctattggggaaagctgaaaataatttgtcccaatctggagatttgctgagacccataatatgcatacactaattcctttgccctaacaccaccactgtataaaatatctctagggattttaaaaggtaaaagtgatattcacagcaggagtgacacagcatataagggaaacttaaatttggcaggcttttagcaggattttcccccattaaatcacagtagcataaaataagatatgtaaaatcacctcattacatttattttttaactaggatttgtttgtttttaaagatccaggaaaaactcaccaaattcctcttctcataccctactctacttgaaatcctgtaagaattaccaactacatattgatgatttccatttttgatagataatttgagtatgtaactttaaaaacatgaatcctataaactaatgagcaagatttcattatcgaatagcccattttgcattactaaatggactacttttcttaactaacttggcacttttaagtatataaagaagcaaacaataatgatttttaaaaatatttccactttccaagcctttattccatttcctgaattttaacctgtcaaaaatgaaacgcatgcctatggaaaaggtaattacttttctccttctttaacttcttcttaattaacttttaatctatgctgttacagagggagcatgtcttaatactaaatgtgtctaaaatgtaggagacagagatttaaatcatttagataaacatctgcctagcacagaggcataaaaattacaaaattaggatatgggtggctgagtgccaacagtagctgccagcaaaagcaagatattgccttcatttaaaaaaaatcttttgcttacaaacaaaccaacttaataaatgacttctaaccatacactcttatattggagcacatttcttgttttatactacataaaattctaaaaacatgtgaatgagaaattgaagggaaataaccatgcaatcatttatgaaaggcatgttttaatagagaaaaaatcaataaattggaaaatttttaccatgaagtgaagcactattgctttgtttagttggagtggattctgtcaacagtaatttaaagtaatcagttcaatgatatgatccctggttggtgttcagataattactatacttatgtctagtaattttcagctattaaatggaatatagagtggcaagtaaagacaggaagctttgacccttaataccccctttactatatgtgtgtaatttgtcttctaataactgaaataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataaagcaagtcacacaatttttttttgtttctctgtccatataaaagttatgatactgtagtctattaagtgtgcaatgaaattatttttttaaaaaatgagcattccttaatttaaaaatacttattggtaaaaaaaaaaaattctcacaatcaactgagccttcagcaagttgtaatgttttcactggtagacagtcttgccttgatgttgatgactgctgactgatcaggttggtgactgtggaaggctggggtggctgtggcaatttttaaaaataagacaataaagtttgccacatagactgactctttgataaatgatttctctgtagcatgtgatgctgtttgataacattttacccacagtagaaattctttaaaaattggagtcaatcctctcaaacccttctactgctttatcagttaagtttatggaatgttctaaatcctttgttgtaatttcagcaatgttcacagcatcttccccaggagtagattccatctccagagaccactttctttgctcatccataagaagcaacttctcatccattaaaattttatcatgagcttatagcaatttagtcacatcctcaggcttcacttctggttctcctattttcaccacatttgcagttaattcctccactggagttttgaacttctcaaagacatccatgaaagttggaataaattccttccaaactcctgttaatctttatatttcgatcccctcccatgaatcttgaatgttcctttccagaaggttttcagtttacttttttttttttttttttaccttttcaagatccatcagaggaattattagctatggcagctataccttataaaggtatttctcatataataagacttaaaagtcaaaattgcttcttgatccatgggctgcaggatggatgttgtgttatcaggcatcaaaacaacactaatctccaatatctttatcagagctcctgggtgacctggttcattgtcaatgaacagtaatattattaatcttttttttggagcagtaggtcttaacggtgggcttagaatatttagtaaaccatgctgttaagagatgtgccatcatctaggctttattgttccattcattaagcatagatggactatatttagcataattttcaaaggccctaggattttttgaatggttaatgagcattggcttcaacttaaagtcaccaactgcatttgccactaacaagagtcagcctgtcctctgaagctttgaagccagacatcgacttctcctctctagctaagaaagtcctagatggcatcttcttccaatagaaggctttttcatctgtactgaaaatctgttttttagtgtggccaacttcatcaattatcttagctagctagatcttctagataacttgctgcaacttctacatcagcactggcgcttcaccttgcactttatgttatggagatggcttctttccttaaacttcatgaaccaacttctgctagtttccaacttttcttctgaaggtttttttttttcctctctcagccttcatagaactgaagagagttaaggccttgccctggattaagctttggcttaaaaaaaatgttgtggctggtttgatcttctatccagaccaccaaaactgtctccataacagcaataaggctgtgtcactatcatttgtgtgttcacaggagcagcactgttaatttccttcaggaacttttccattgcattcataacttggctgtttagcataagacacctagctttcaccctgtgtaagtgtacatgccttcctcctccagcttaatcatttctagctttttatttgaagtgaaagatgtgtgactcttccttttaacttgaacacttcgaggccattgtagtgttattaaatggcctaatttcaatgccgttgtctctcagtgaatagaaagtcccaaggagagggaagagagatgggggagtggctgttccatggagcaagcagaacacatacagcatttattaattatgtttgctgtcttatatgtattcagatcatggtgcttcaaaacaattgcaatggtaacatcaaaggtcactaatcatagaccatcataacagatataataataatgaaaaagtttgagatactgtgagaattaccaaaatgtgacacagagacaaaaagtgagcacatgcagacggcaaaatattgctgacagacactgtctacacagggctgccacaaacctccaatttgtaaaaagcacaatatctgtgaagctcaataaagcaaagtacaataaaatgagatatgcatgtatctcctctccctctccatatccaaatgtagtaaaggaaggaaaacaaacaatatatttattaaaatactgtattgagaaagggaggtagaggcattacaaaccagaaatttccattagcttctgagattcaaaaggtggatgaagggtattaaatgtataacacaagttaagggaaccccaggaaactgctacagtggtgctgaaaggttaatgaattcttgacttgttgcaggacatggggatcacagtccttttctctaaatagtttgtgttccactgtcttcttgcttccagtagcaaatgtaaaatctgaccagtcagtacaatggttttacctttcaaaatatcttgctcgggaggctgaggcaagagaatctcttgaacccaggaggcagaggttgcagtgagccaagatcatgccactgcactccagcctgggtaacagagcaagactctgtctctctctctgtctatatatatatatatatatatatatatatgtatgtgtatatatatatatatatatgtatgtatatatatgtatgtatatatatatatataatcaagaatttttgtaaaaaatttcatcctcagacttctgaatggttgtcttttttttcagttagtggattattatttgtttgttatttcaactccatttgttacccttttcttcttctgaaatactgttggcatgttagatctctgggatctgtttcttatgattatcatattcttgtggggtttttggtctttgttctaagttatttcttccatgtgatcttattacaaatacaagtctgagccatacctggccttttctaatttaaattccagtgttttattttataatttatgaatcacaatcattatagattttctgactatatccgtttgatggtcctcattcattttatgttactgttttctttgagttcttcatcagttctagtaataatttattgggaactatcacttaaagaattttggatcactcaccattcctcaggttacttataccctttaaggttatttttttttttgccatattttcattatatgtgcccccagccttcacacatggggatattatgggttctgagctaaggcagactttcagtggaggatggtgaaataaaatggaaggcacagtcatttttgctcccgtggtcaggttatgttatctgtcaaatgtgttattctctcttgaagcatctgggtactgcatccccagtcccctctttttttcaccctgagtataagtaagagccctgtatcactcacaggacctgcgggcaatgcagcccagtaatgcaggtgagtgcaaggtgactgatttcctccaagcctaagagagtaactgggatcaagcaacctttgaaagactacacaaagccagtgtgccctctcatcagggagatttgtagatttcagttgattctccttaggaaaaaaatttttccctataccatctgcagaatattagattcatcctccggctctacccagatgcctccagcttgcatgcaccatattctaaatgactccaaagagagttgggaggaagaaggagccagggatgaaaaccttagttcccaaacattccttattttgaaaaggagacaaaaatattgtttattttgaataatgtgactatatatctctaaaacctaaaggataaaatgaaatgctttttaaacataagataattcagtaagattatgggttactataatgaatgtccaaaaataaaacagaaaacatagcaaaataaaaatcgaaagaaaaaggataatgtataataacaatacaaccataaatctcttggaatggaattaataagcaatgtgtaatacttataatgataaaactataacactctcttagaaaacaaaatgacatgtaaagagagaggttttctttgttcttgattggaatatttagcactgtaaagagggtagatatcttaaaaatgtcttcatgaaatcagaacaaatattcagaattccaataggattgcttttctcgggcatgggagtgggacagagagttggaatgctacaacacaaataaatctcaagtacctgatacattacatatgagaggattcagaaaattccttcccaaaataaaatatattataaaactagaattaaaatatgatgtaaatgaagaaatacattacagaagcaatgattttcaagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagaggtaagtccttcatagagaaactcgaatatcttcaaacggatctcctgaagcatttagcagagtactaatcaacacatatttatgaggaaagtacataaagcttggaaagaacatgtgaaaggattagaggaagggaagcagtgccaaaagctgagatatggtgctgggaattatgcgtgttataaccagacagattggaaaaactcataatccacagggcactaggttagtactcaggaaagtctcataatttcatttggtgtattagtatgagttttccagagatatagaaccaatggaatgtatgcatgcgtgtgtatacatatactttaagaattgattgtggaggctggctagtccaaaatctccagggcagaccagtaggctggagactcacagaagggttgatattgcagttcaagtctgaaggcagtcttgatgcagaattttctcttacatgggggtcctcagtttttttctcttaatgctttcaactaattggatgtgacccacctgcattatggaaggtaatctgctttacttacagctactgattgcatctaaaatataccttcatagaaacatctaggcctatgtttgaccaaaaactggatactatagtttaacaaagttgacacataaaattaatcaccatactcagtattttacagtactcagaagttgcttcagtagtgaggagtaagcagccctaggttgagcactgctctggacccatttaacaagttagaaggcaagactcaaaaggatggagctataggaggaattttaaaaataatttaacacccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggccgaagtgggcagatcccttgaggtcaggagttcgagaccagcctggacaacatgatgaaaccacatctctattaaaaatacaaaaattagttaggtgtggtggcacatgccttaatcccagctactcaggaggctgaggcaggagaatctcttgaacccagtaggcagaggttgcagtgagctgagatcgtgccactgcactccagcctgggcggcagagcacgactctgactcaaaaaaaaaaaaaaaaaaaaaaaaaagaaaccaaaaccaaccgcctgacctcactacaacattaccacatccccaaacatgcatttcccactacacaacccatttcaattgatggcaacacaatcttttcagatggtgagaacaaaaaccttgaagttattattttactcctctctttctctccagttccacatctaattcatcacaatatcttgttggcaccaccgcacctgttgtaatagcctcctcttttttttttttttttttttagtctctgctctcttatagtttaatctcgacatggtaaaacagagtgattcttgcaacatgtgactctgatcagtcactcctatggccagtctcaagaaaggattttcattttattcaaatagaagctaatgtccttccagtgacctacatgatctgctcctccgcttttcttctgacaacatctcctatgattctcctagctcagcactgtctaatgatgaaatgtaatgtgagtcacatatgcaattttaaagtttttagtagcacattaaaatgttgaaaataagtgaaattaatttaataacattatatttaacccaacatttcaaaaacatcatttcaacaacatgaaaccagtataaaaattcaacaagtaatcaatataaaaatgatttttggtatttttttcatgcacagccttaaaaatcagaaatgtatgttatactaatagcacatcttaaattggtttagctcaatagccatgtgtgataaatgggtactatatcaaacagcacagtgccagctcttgcctctccaggcacattggtttcctttatattcctggaacatgccacccatacttttgcttcacaacctctcttatctaatgtgctgaaatgccataataccacatactgggtaatttataaacaatgaaaatttatttttcatggttctggaggctggaaagtccaagatcaaggtgctggtgaaggcttccctgtctgcttccaagatggcgcccttttggtgcatcctatggagaggaggagcactgtgtcttcacatggcaggagaaacaggtcaacaatggggcaattactagttccctccagcttttttatcaggtcactaattccattcatgaaggctccacccttatgacttaatcacttcctaaagccccacctctaatactatcacatgagcaattaggtttcaacatatgaattttggggacattcagacagtaacacagcctttgcatcagttgtttcctcttccaggaactgcttcctccatatataaacatggattgttttcttacctccttccagtctttttcaaatgtcaccatttccatgaggccatgccagattactttatttaatgtatcatttattatgttttaataatacataaattacttatttataatgtttattatctatctctcctctcactgtaaactctcctatgagggcaggaattttcgactgttttgttaatttatatactcccaacttctcataatctctattccatagaagttcaataaatacctgctgaatgaatgagaagaattaatgcagtcggatattatgctctcattccaacaacctagagtcatgtactgattttgagagatattcaggatattttggcaaagaacaaaatagacatattgaataattgtggaaacatatatccttttattatttcaaaacgtgtctttggatatgagtatagctgtgattgagatgacatatcatgtttataaagaaagcataatatctagttgctataattaattgcgtctgtctagagagtagaaatctgtggagagaggacactttcatagtttttaattatacttatatatatttagctttttaaataataagtatgctccttgtgataatttaaaaatacttataggtttaaaaactggtaatgtcataaaatattgggagcaattattctcttgttctaaaaattaactcatttagggtgctaaaatctatttcttggaggtcccctttgtaaaaccctgtaggtatttttccagaaatattcggagacctctacattgtatgtgtattattctgacctccttttgtatagggctatctgcgtttcatcattttaattccaaggagtgattttataaactgttcctcagttcatagtctttgcaattaaattgtaagttgacccactaactgaattacagaaatcagatataaacaaatgaacagatttcagctgttcatttgatatattggtttgaattagttttaatgggccacatggcagttttctagcctgtaattgctattaaacagaattctgtaaattcactgaagatgtttaaatactctgtgtggtaatacaactgatttgtgttttgtacaagttaataactatagattgaattaaaaagaaaatatgaccaaaaaagagggtctatttaatgcagtttttgttttattactttggaagattcatatgtcttaatttcaatttttcttttatttcattttttcaaaataaaattataagaatataagaataaataataataacagtaacttgtatttctactgtgctaagagctttaaatattttttctcatgtgattcttacaataaacctataaagttgatataaatattatctcagtttttacagatgagaaagttgaggtttaagaaggcagaataacttatctatgtccacagagctaacaaggttagaatcaacacttatatattattgttagtttcattctaaaactgtgtttttaagcattatgtcactaatatatttatcctagtgaaaataattcttctgatcatctttaaaaataaataggcctaaaattgcaaagggattttgacctcaaatcgattataaatccattatatgaaactgttatatatggtatcgcatcacaatacttagaacaccgactggaacatagtaggtatacaataaataattttgaattaatgaaattatgaaagttctcatctaatattctaaatctttacagtgaagggaaaaataccttttaaagtgggaagaacaaaagcaaatggcacagggtgttagtatttgagaatggaatagtcaaataaaagggattcaaattcacttgactggatcatttagaaaaactacaaataaagctggaaagtgtcaggctattccatagtatgcctactttacagattaccaaatacatatagtttatgtgagtttgtatacttaacaggggaatatttatttcctctgttaattttatgcatgttgaaatatgtgagggcctggttaaaataagaagccctctctgtagcccagataaaatgagcctctcattcttctccattaaattaggagacattggttggcctttaaatatcattctggactagttaagcaaactcataatgtttgacttctgtttgaccagctcctctctccaaactttgtcaaccacaaaatatcgtatgacacattatatatacctgatgatactcaaatactcttcatctttttattctctaccactttactagtgcagattatcatctgttctagaactaatgatgaaatcaccttcaaattattccccttgtgttagaagtccagcttgttgaccacttcttcccactatcaccatatttatcttcctagaacatgtgtctgttcttaaatcttgctaattccctgtcaccttttgctaattccaggaggaagtgtaaagcttcctcatgaaattaaagaagtctgccacagccacctttcctggctcaccttcccacaatcctccagcaaacctgaattgcaatcataaagaccaactctggctgccccagataaccaagcaccatctgaggctgaatcttgtttctaaaatgctgtagctcttcctttgttatcagtcaaaacccttctcaaacatcaaggctcagaaaaaatgccatctgtttcatgatgtttttcctagtctcccctattttactcctaccttaaaattaagcatttccataaaactttacttatacctacatttattgcatatctccttcccatatttattatagttgtcattattctttccttattggtttcaaactctttatggacaggtaaagtggctcatgtaagtgtttctcttccagtgcctagaacaggacaatatttgcagcaacaaaatattcaatataataaaaatatgttgtttactgaaaaaacactcaataaactcaaaaactacaataaaatattttgtacagaataaagatagcaaagaaaaaaacataattctccatataatggaaaaggaacatgttaaaacttgtattgataactagatgaatatagatggatgttttactggaaaagggaaatagaagagcagaaaggaaaacacatcaaaattattctttgatttcaactttccaaggaaaaattattttcaggtactaagtttgtctgcattgcaaaggagtgattttgtaatttccagaactgtcatcctttgttccactgttgtccttcacccagtatgctctctggggggttttaggagattgcacaccaggagcgctgggcacaatggcactgaagtcttgcagtgcaggaagcctcagcaatcaattcccacgctttccaggtggtgctgtttggttccattcacattaacttttcagctttctatgtgaagaaagcctccagatagtgaagagggagggagagcaataagaccagtgattacaaatccatcactttcattgttccagagccagtagcagaacacagctgatagacaaagcactggttttgttcaataattaggttgtttcttagaggagaatatgaagccttttcaatattttactctttttagaaaatatgtatattgtatcaaacattgtgtagcacacaatagaaatggaggttttaatagtagtccttattgtgaacatcaaatattaaaggcagttttgattagatttggggaagaatcagctctactgcatgcataaagccaaaatatgtgggacactggtccacctgagaagcaaggtagatatttcccaaattaagggtaattcaggagaggtattactattgcgtacacttataaaatatactcaaaatttgggcaaagataagaaaaggatttttaggcatatgggtatgtgtatgtctttctgaaaaaaaaaaaactaaaattttaagaatgctatcataatgatatacaagtaaaatagtctggatgtgaatacatccgggtcttttcaagatggtccttgccaggattttgttgaaatattattttcatgctatcaaacgtcctaagtaaatgtcattgtggtttctttatttactttttgggcccctactttctcaccgtatttccaccaagtctgacaccatgttagctgtaagtggggcaaagagatattataaaacattcttcagtgattagagacataaaaactataaaaaataatgtgttactttgtaaatagaattcaaattagaatttaaccttcaaaatatttttttttggaaagtgatgagaaaacactgcatctatatggaagccgtgcagtataacagaaaatgtcctgttgtataaggatggaacacagaatttatttccacaactatcactggctcctaagacattaaagctagtcacttaatttctggtgtctatcaatcagttcttaaaaatggaaacaatgatgcaaattcataacaagagatcatacaaatattgggatgataaataatatgtgactgtattttagttgcccagtatgccattttgtgattatttttcagaaaggattcattcctgaaagggaattacagaaaataagcactattggtgtgtactgtattattagatatttttacacaaaccattatgttgaactcagaataaaaggcatattttaactggacatagagccttgatttgttctaataaaaccctaatttgcccaagttttatcagtaaccatggttcccacatagtactcatggaggtggccatggtttttattttctaataagactcactgtggtacaaggtctgactcagagcttttcctaggaatataaaaaggataaataaaaatgtaaaagaaaaattatcaaactgtcccttgataactaaatggttgatcataaattggagtgtctatgcaaatgaagtaaataattaaaatctccaagaacagcattgactaggtggttgatgactggcaattataaaagctgaatttttaatatgcatacatccaaggagccagtaaaaattagctcccagactaatggacttgcctttcttccgaagcagaattttaatgagagcattatttataacggagagcccaagaaccagggtattcttgcttagtctcatttttttttccctgacaccttatccattaaactatgaacttctttacagaagaataatactttattccctaagaagtaaaggtcaaaatgacctcagaaattcgttgcattatatatactctaaagacatgccacttaggacaaaagaaatcataaagcctgtgtttctaaatacccaagttgtatatgcttttaaaatatatttcataagatcaaattacattccatatagttttgcccttccacaaattttctgtgtgattatttcctacataagataaaatgcaaaatctttgaaggacacttaaatctttttgcatatatttttataaggcttgagaatggttttaatcattccgatacgtgtatattgttaagctgctaatttctttgaggccattgaaagggtttaatttttccctagaaacaccattttgttattggcagtctgtgttataaacatcacagagtttaggttgccactttcctttttgatatttcaaccggagcgatgtctggttttgctttcatgactctttcccccacagttgtaactaagcaaggactgtttggcagatagcatctaaggagattttattgtctgggtgacagctcccttaaactatgagtcaggcaaaagcctggtccaaggatgagtcagagagtggtttactcagagctgccttaaacagaaagtcactagttcccatccaattctatcccttcaccctcattccagtgccaacctaaaatcatatgaccaagggagatgggtggtaaaagcattatcaggaggaacatgataaatgaggtctcattagtctaagcttgttcccttctgtcacctttttttttgttgtttttaagccctcagtattttagaaacttctatatctactcatatatactgaagaacctaaattttctaaaaaaaatcatagattttattaaaaatctcagaatgtaggtacctttctaatgtccaatatcagatagacaacagacaaatgcttaggataattaggttctttatatcaaccaaggcaaggccaggagcttctcactgagactctttgttcaataaactggagattgtaactttggttaataacattgaattgtgagtatagttaagtttatttttatatgtgttttggcaattttgtgtttcttctcttttttaattgcctatttttatcctttgcacattttcctcttggggaatttttttttttttctgattggtttgaaatacctctttgtgcattaagaccatgagttttttccttgcaacaagtatttttcaagtttgttatttgccttttaatttttatacttgtaatgcataagtatgtttatgcttctgtgtgatcaaatatacctatactttccctaatgttttatttcttatttttatatttagaaaagatgcccctactctgataccagatgaatatttacttatctttttctgtaattcttgtttgtttacaacaaatgtaattcattttggcatatggtatggagtagatctttattgttttccaaatactaagccagttgtccaaaggctacttatcaaatgtcattctttctccactgctttgaattatgtgatttataacatagatcttcgtagctttaatatatacaaaagcaattttttttctagtcggttccagccatttatttgttttactccagtattaggaatattttactatttctagaaaactggaatatttcctcacctagtaagtattgttttttgtctttttagcatcaaatgagctgatcatatagattccctcttttgatatatcaatatactgatgtaattaagtctatattatatcagtagagtttctaacatataaccacccttgctttcttagaataaatcctacttggttatggttttattatattaacacattactaatatttttcagatttctgcatatatatagtataactgagaatgttatgcagttttctttttgatctgtcattgcccagggctttataattttttcttcttaattcataatataaattggaaaatatagtagagaaagttataaaaatatggctgagtcaactaagaaattcaatgattcaccttcatctgccctacccggaaactgtacaaataaccaaagcattataaaaatcgagaaaatctaaaggtctgcaccagtactggaaactaggaaaggagtctatccacacaaagaatattgagtagtttctgctgtatgtggtgcatataacaaatgaagacttttgtgatagataactcacaattccacatcccaagaaaatagtggagtatctcaggaatatagttatacagctaggaagatcttcaatagcatctcctgatttgaataggcaagggctcaaagcaagggcaggtctgtagatagataagatgcaaaacttctgcccaaatagtctatgctcagcacattaaatacaagtatagtcatattagctcaaaagccttcaggcagtcggacttctccctggtatggcattaaaagctataaataataaagtaattcagtaaacagtataaggcatgtagaggataagcttgagatgatcatacagaatataggagaaaaagaaaaaataatgaaaacaaccaaaggaaaaccatttgcatagatgaccgaccttgaaaaactaaggtactgatttttctatattaacccaacatgaactccaacataaaattgggagttactggtggatgtctccatgtttactgcaccaattatacagaagaggcagctgtcagtcagcctttcctatcctccttcaatttggtgttgtagattgctgaaatacactacaatgtttttgtgagtatcatctttccttcatcatcagttcccatttgttatatatatttctttggtcattgtaatcaggatctaggatgaagaacacaatttttgccttattcttttatgtctttatttacttaaggcaataacactgtaatttagttagaaacttagttcattaactcaaaagagaaattataactaattttaaactctctgagtttaggttttaaaaattagtgaaatttctcattggtttcaaaataaattaatcataaatatgtacaagctattttttaagaaacaatatcttaatcataaaagtcacaaattgaacttttttaaaagcattatttacaggaaggtgctttttttcttgctgcacttttctaaagataaatacatgacccttaacatttccagtttccagttgtcacacatctttacaaaggcaagcacaaaatttgcacctgttatatgagagaagtaaatgtcctttgagatactttgacagatacattataacaaagtaaagcaaaatttttagtctttatataaaaataaagtagaaatatctaattaaggatatgaagaaagctggtactatttctgatctttctaatgcccaaatgaatgttgtattgtttcaaagtttcaaattctattaaaaaattgctggcagatatgttcttattaaacatataacatcataccactcctacaccccgaacaatcccacccaccttgagtacaaatcattttcaaaatattgtttgtcaggaatttttcttcagctatataccatttaagaatgacactaaagggaaatactagactagggaatctgtttagggaaatctgctattgaataaaattggcatagatttaataatatgagtttgaagatagaaatgtaggtgtttgataaaaatttaggtaacagaaatgaaagcatttgaaaatagacatttaagatatttaaaaatagaatccaagatgatgtcattaaaaactgtattatcagaaaaagtagaagacaatatattttaattaggaggggtaggactttttaaaaaatgtttaaaaataaaaatgtaatgtattttaacaataggacaggacaaacatcagttttttaattaaaacccaacttggatttagtttctatagtactttagatacttgtatttccaaaataatatacagacagctactcagcatatgtgtgaatatgaacacatacaaatatattaggccatttcaatttttcatcacaaagttaaaatttctagtgacaattagtggttcattattccttttagaaaagtggctgaatataagatcaacatgaaaagataccttgcagtcctatatacttgtaacaaacaactagaaaattaaatataaagtaagataacacttaaagtagcaataaaaaatcaactacctaccaaaattggtcaacaatatggaatttctctatgctaaaaactaaaaaatattattggtggaaattttttctttttttttttttctttttttttgagacagagtcttgctctatcaccaggctggagtgcagtggcgcaatcttggctcactgcaacctccaactcccctggttcaagcgactctcctgcctcagcctcctgagtagctgggattacaggcgcccaccaccatgccagctaatttttgtatttttagtagagacggggtttcaccatgttggccaggatggtctcgatctcctgagctcatgattcacctgccccggccttccaaagtgctgggattacaggcatgagccaccacgcccggccggatattttaaaagacctaaatatatgcaggaatatttcatgtctgtgcattggaagaactcaatagcataaagatgtcaattcttctcaaattgatctataaatttagtgaaataccaaataaaacattccagcagtttcttttatagaaagacaagtgattctaaaattcttatggcaatacaaagggtcagggatagtacagacaagctttaaaaagaacagagttggaaaacttacactaccagatatcaagacctactataagtcttactttaataatgacatggtgatattggctcaaaaatagacaagtagagtaatggaacaaaatagaaggcctaaaactgagacccatataaatgttgccaccacttcaacagaagttacactgtaattgcaatggattgaatgtttgtgtcccttctaaaattgatatgttgaaatcctaatgcccaatgtgacattattaggagtgaggctattgggaggtaattaggtcatcagggtgcacctacatccacgcaaatcatattagtgcccttaaaatggaacacaagggagttctctcactctctgctatgtgagaataaaatgagaaaacagctatgtgtgatccagaagagggccctcaccagaacccaaccatgctagcactctgatcttagactgccagcctccagaactgtgagaaataaatttctatgttcatgaaccactaagtctatggtattctgtcacggaaatctcaactaagacataaatacaatggaagagaggttgtttttatgaatgatataggatcaatttcatattcatatgacaagtaataaactattgctccaaacttatacaatacacaggaattaatcctagataaactatataccttaaagtgaagtgcaaagcaataatttttaaagaagataatggaagggaatagtctaatcatctttgacttttgggtatgtgaggatttattaaatgggccacaacatgtattattactgaaagagaagatagaaacactttcaattatcaaaatcaagaaattccattcattaacgccattatgaactgaaaagacaaccagagtgggagaaaatacctgaaaaaaagctagggtacagaaatatgaagcactcctgtaagtcataataaaaagacagttttcaattaaaaaacaggcaagagatttgaacagtacatatacaaaaaatattcaaaggactaataaatatattaaaaggcattaaacatcattagtcatcaaggaaatgtcctttgaaaacacaatgagataccactataaacgcaataaaatgccccaaagtaaaacagcagataacgcaaactgttagcaaggatgcagagtgggaaaagaatattaataatagcattattttcaatagtcaaaacctacaacaactttaaatttccatcaacagtagagtcagtaaataaatggcatagcttcatacgttgaaataccatatacaatgaaaaataatgaaatactgccacacaaaacaattgaattttataatcttttaaacattataatcttttaaacataggagtgcttcatatttctgtaccctagcttttttttttcaggtattttctcccactctggttgtctttccagttcataatggcgttagtgaatggaatttcttgattttgataattgaaagtgtttctatcttctctttcagtaataatacattttgtggcccatttaataaatcctcacatacccaaaagtcaaagatgattagactattcccttccattattgtacattaattatgtacaatagtacataattaataccatttatgtaaaattaaaaactttattgataaaaatcaaaatagtgtttactttatggggagatagttattgagaaagggcatgaaggaggcttctggacgccgtaatgatctacaagtcaacttaggtattttcacttgacataaactcaccaacttaaacgcttgtgatttcagcactttgctgtaagtatgttatatactccaacaaaaatgttttcttacaaaataaaacagaaatatgcagaagaaaaacttcatatcctcaggggaataatgaaccatacgtccttaacacagaggcgaaattccacagcagccccactcctgaagtccaaggcagggaaatacacacatgatgataattaagtgaaactgatttatttttatctcagtatacatttttgtagcgctatatgacttcatgtgttgtgcttaaggaaatgcattcttatatctaaagtaaggatgaacagattgtaaattcaagaactgtgctggagtttaagacttttttatagtaattgttaattttcttaagtaaagatttctgccttgattacaactaattagcaaataaattttctttctgtcatatccccttatatggaatcaaaaacttattaagcatatgtctatatttgaatgcatttttacatgtgaacatctcttttatatatttaaatgtatatttgacatagtagagtatatatttaaatgcagacacacacaaatacatatgcatttaagttttaaatgaatagtaaacagtgatatggataacccaaaaatcgtttctatttgaatttggaatgtcttgcatgatttttgaggtatatttatcttcttgattacagcttgtttagactgatattaaaattagtctgcactacttgaagacacaacacctgatcttgaagaattatatctaaaacatattagttaacagaaagaaggtatctagggattaagtgttttacactaatattcatccagaaagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacctcttgtagttcttattatagaatgtgccttgggctgtgatcgtgagaatttaaccacaatggcatatgagttcatagtttgcttttggttgggcaaagttaataagtaagcaagggacagatcatgaggtagagagatctaggctgaaagatgataaattcactttgggatatattcagtggaaaccatcaacttgtaccctgatcaatagcaagttggatttagtgatatgagctggagacatagttcagagtcatcttatatatgatggactttggaaatggaagctttggaaatgaacccaggccgcctggaggagtgtgcagcatgagaatagaggagagcctggaatctagaagcctaagaataacaacatttaagggaggccaagaagagatttattttgcatcttataatctgatgatacagatgtcattagtttgattacatgtacaaataaacagagcaagtagagaaaaaatatttattaataataacaggcaaccacaacctccgggtacctaggggcaagaatataactgtaccttgtgagggactggagccaggaatgagaagccttcaagggatcccgagaggatgtccctcactcttgtttctgtttcaacctgaatatcttctttattcttctacaggcaggcttcatttgttcttctaaacacatgtttaaaaaagttaacactgaagattcccagttttatgtctcatctatgcaagaggccaactcaaaacaaaagtagagttaaaggccttattctcagtttttgggaaagggcattatttcagatacatatcttaaggcttttcactgattttcccagcactgctgtctccaaagtcatctagtcacttgtcctgagagtgctgagttctcccctccccttggctgcccctgtgcaggcacgttggccagccatgtgccaataattctgcctcaatgaccactttcagacttcaattaaacaccatgaaggcgggtatggaatcaggcacattgtgcagctgccaaaatatccagatgatgtaccctagaaatataggggagtttgatttccaagaagcaaacttgaactgaatcccattccttcttccctcccaggattagtcagagtcatagttttccctgcattctgcccaccaaaatcctgtatggcaaaggatataactctgtagcaacttgctgttccttttgtgtagtagccaatgcaggaatgccttattccctgtctgtccctgcctcacttctctttctctcattgcagctgctctgggcttgcatctcttaagtaaagcgtttgcacattaatccttactttagcctctcttttctggggaactcaggtgatgagaggcagcttattgcttagatgtgttcctgtgtcccctctgattctttctgcaagggagaggaaggcaaagtattcccaagaaaaagacccttccacatgcctctgtgtcttagaaggcacaggggagcttgtttccagaaaagaaggaagcattgccgttaggagagagaccccaaaaatatctgacaaagattaaaagtatagtcatcaagaattattctaggccaggtgtggtgtctcacacctgtaatcccagcactttggtaggttgaggcaggaggattgcttgagtccaggagtttgagaccagcttggacaacatagtgaaaccccatatctacaaataataaaataaaaattggctgggcatggtggcgcactcctagagtcccagctattctggagggtgaggtggaaggatttcttgagcctaggaggtcgacgctgaagtgagccgagatcacaccactgtaagagcctgtctcaaaaaaaaaaaaaaaaaaaaatctgttatttattgctccttttctgtgtgtctcttaattgcaattatcaatgcttttattttacttttctctttaaacagttcaatgaatttgattagatgagttattactataaatatagtatatttctgtgaaaaaataaccctttgaggaaatttattataattgatcacttctgaagagtgaggaaatgacatgataaatatctttaggggttgttgttttcagagtatttctctatgaaattaagaaacaaaaccttcaaatgtaattctacgcccttatcaaaatgatttccttacaaggaatattttggatttccagaaaccatacaatcactaattcagtttaattcactaaggtaaagtagggaagatactgcactattgcccttcctgcagtagaaaaaggcagcaacaaccaacgagaagctgggttagcgcttggtaacagtcttggtgtgatctgtggaatacacgtttaggtctttcatggcacctcagaatctctgcccttccattgcttgttctaagcctaaggtacatctaagatagtcaagagaaaagatcatcatagcaagatagaaagacatgacatacttcaaaattagctctcccaaccactgagaaaaaaagaaaaatcactaacttttctctacttcccacctcaccatcagaaggcagtgtttagctttctacctttcctttttatgcattcagcaagttgtataaagcttatgatatgtagggcaccatttaagaactataaatatgaactaaattatatatcaatgccctcgagaatagtaattttcacaatctggtaaagaaaagaaatctctttgtttgaataatttgttgtgttctgaattcatgatatttaaaaagctaaattttgctacagttaaaatgttttcttatttatagcaattcttaaataagccatgttagaaagtttggattccagagaaggcattaatgcaaaaacttaatcatcatgttaaaattcccaacaaatttcaagcaatacctagaacctggcaattcctattgaaatggcagtgcttagggcaaattggaaagccagctaagaagttttctaccggcaagatgaaagataatgtgggaccaataatataaatcattggcttggaccacctattttattaattgccttattttagaagtcagatttttgtctcagaagaatctgggaatgggagacaagagaaaagacactgactttttaagtgtcttcccaaccccaggtttttgtccttgtttagaagagaaaagagaatttcaaaaacaaaactaatttttattattttaagcagctatttaggtctctaaatagaagccaaatagggtagatgaaggaatgtggactctgcagtcagtcaaattggatttgatatctactttttatcattcttcactgaataaatgtggacaatttacttaacctctgttaagacaaacctaacagaaatatctcagtttgtccatccttaaaagggtcatgataaatatttatgttaatttgtaagaattcaattatatcacttaataaatgacacatacagggcagctggcatacagtaaacaaaagtgaggctgagaattcattggcagcagaattatctgaagacttgagacattaaaaccatcaacaaactcagtaagagactctagtcccagaaatttctcaaataacaagttctataaaacaagatccatttgaaaaattctaaccacattaaggccaggcacggtggctcacgcctgtaatcccagcactttgggaggccgaggcaggcggatcacaaggtcaggagatcaagaccatcctggctaacgcggtgaaaccccatctctactaaaaatacaaaaaaaaaaaaaaaattagccgggcgtggtggtgggcgcctgtagtcccagctactcgggaggctgaggtaggagaatggcgtgaacctgggaggcagagcttgcagtgagctgagatcacgcctctgcactccagcctgggcgacagagcgagactctgtctcaaaaaaaaaaaaaaattaaaataaaataaaaagaaaaaagaaaaattctaaccacattaaagctattttaaatattttatgaataacttagggtaacaatattttaattgtctaatttattagccgaaatcttcaagacacaagcttttcagactaaagtacccaatcaaaacaaacataacctttacttaacacctgtttttgtaattgcaagtttctttaaccagaatcacatggttctcaaatcagactgaacaggaaggcttataaaaatacagatatacagatggagagtcagccccagagttttcaattgaataggtgtgggatgtaagtttttcaagttctcaggtgatgttgatatgcctgatccagaaaccacactttgagaaccactgaataagaaaatagtatctcagatgctttcacatacagggctatatattaatgtaaaataaacatggacatatattatgtacataaaaatataatattagaatttaaatataatatatattacatttaacatatatatatgctatccaattatctcttttgcttcactgaaaaccataattcaactgagatatctaagtaacatacttccagaagtaggatcataccaagactccaagccgcattagccaaattttacctaacaacaaaatctctgttgttggttgaattgtgttcccccaaaagatatgttcaaatcctaacccccaattacttatctctgttttcagtggtacagaattgggaataatgacactctattgggtgtttgcagatgtaattacttaagattagatcatactgaagtagggggagccctaattcaatatgactgatgctctcataaaaagaagaagggacagggacagagagagagaatgccatataaagacagaggccgagattgtaatgctgcatctacaagccaacaaccgtcaaggactgccagccgtcaccagaaactaacagagagacataacattctccctcagagacctcacaacatagcacacaccttgatctcagacttgtagtctccactactgggagaaaattcatttctgttgttttatgccacccagtttgtgatgttttgttatgacagccctaggaaactaataatgcccttcttcccccagtacctgatgattctgtctgcctctaaaatttgcctcacattgcaacattttttagtgctctctcctactcattgtatttttttttttcatccttaggagggtttctttaaagaaggagaggattcagggaaagagggtggggcaaattgtgaccatctctgcctaaatcattagaactcaagagagctggggccaccatggagacacttctggccacttccttctgattccacatcaagttcctcaggctctgggccctgttttaattgtcggcctgtggctttgatatcctcttcttatgtctttttggcactaaaccttgcctttcttcctggctcttcttgcccctcgcttttggcttggatacctctgccatgtcctgcagctggatcgaggaaaacgttccacttgcccttcatttctggctcctactgctctaatttacccagttcttctctgactatccctgagtccactcttaacaatataacaatctcctcacccaagaggtccactcaactctgtttttccataaataaatttctcctcatcaatcttctttcattaaataaaatgtgtctgaaacccaaagacacaagatcttttaccttctcctccacttcttactgtctcatgacttttgggaacctgatacgttgactcttaatactactttagttatactgccatttttaggatatgattgccctgcttctgctcagtaatctccactatttttgatgtctacttctgccctcttctcttccttgtcctatccatctttctgtcttcaggacagcatgacccattcatcactgtcacactgttcgtcttttcatcattgccagatacagtggttctcaactctggctgcacattagaattacctggaaagctttaaaaaactagttctccgatggctttaccttcagatattctaatttaatgggagaaggccttaacatcacatttcttaaaaatcatttatttgcctggtaataatcactggcctaccattatgctcaacagattcaacctttatgatatttttcttacttcctagcctcatagttcttcactttcaatgttaagcattgccactttgtttctcccaccccatcactcagacttgccttacaactcttgataacttgaaataactctaccatttaccaacataatcacaaactctgacactgaaataattgcagtcttctcctcacctttctcacttccagtaaataagctctaaattttttattttgaccctattttgttctttgacttttaaaaaattaccttacatgatgaatttactttcaggtctaccgaaccagacatgtggtcaaccttgtcaataatactaccatctattaggaaggagggtttattctgaatttgtcagatttccatagaggggacggaatgtgtgatttctaggatgaaagttttagaagaatacttgagacctcttgtccagggcctctcatagacacatccccaaaggagtgtgtgattggtaatcatctgactggtaagctaagggaaagaacctgtgggtatatggatcagtctttattcctctcctgagttaaggaggcagttttttttttcttatttaccaggccataagatcatttttcaactctgccaatggctatgtgggtaagccattcattcatggagaaaatacttagatttgggtttccaatctacattttctaattcagctatatccataacaagtctcgtgttctgatttctgtgtgattccagtgattttcttaccattgtttcccaacttatgagaggaagaacctcaagaacagactcaactaattaacttccattcattctgcttttgttgcatatctgacctggggatctggggatctgtcccccaacaactctttttttaaaaaataaattcaagttttattctagatttgggggtacatgtgcagatttgttacatgggtatgttgcatgaggctgacgtttggtatatgaaacttgtcactcaggtagtgagccataatacccaataggtagttgctgtatcttattagagaaatgcacaaagtcctgcttcttggatccactgtaattcttttaaactaagctagactcttattattgcatcctttttaaaattcctagtgtatgcttactattgatgtccttcctcatagcaattcctaccttttctattctactaaagctcttatactaaatccacatcaccgagactttcagtgaataacttcagctcatacagttttgagaaaaccatataacatttatactctttattttcccttcactttaaaatttattttcatccatcttctcttcctttacatgcctcccttaagaataaccattctttttccctcagtacctcttcacaagggaaagattgagattctcagtctctcccctctctaagacttcatttcatcaagtcctctcatttgtttacatctgtaacttctccttctttacaaaataatttctctgcctaagggcatggtcataacaaacaaagccaggaactaaaaacaaaatcctcaattctgttactctttgaaatgacttttttgttttcctcccttcagcacgtaatctttgaaaaaaaaatcatctagattttatgacttttttctcacaccttacaacatgaactccccctaaaccaatggaaatacctcatttataattcatcaatagaatcataaagagcctatcaacaggttttgcttttctcacattcagtctctctcctttctttcctttatccaacccaccagtgttttaggcttcagatccttgtatagatgataatatatggttgttgtcactgccccaactttatatgtacatttacaattactgacctaggctctaactcagcaggtctctcccccaatttatcagcttactctgaattccctacttcaataagtgacacacttatttcctaatgactcaggctcaaaatgtcaatgccatttcatacattcagttactaatttcttcatcattcattatgtacctgcttcttgccaaggaatattttatgtcctggggattacaaagcagaataaaacaatatctcttttcaatgagcttatattatattgaagaagaagactgacaagtaaacaaagtatgtggtaagtgctgttttagaggtagcactgaaagactgttagaagacaaagcagagagcaattcatgttgtgtgagggagttggaagaaatgcttcacagaaagcaggtgctttacttcagtctttaataagaactaggcagttaaaaatagagaaggtaagtccaagaggctggtagggcagaacttataaagtcaaagttgcgtaaagccatgagaaatttggtttgactggaatataaaagcaaaagaaagtaggacgaacaagagtgagtcaaaagacttataattagccaggcatggtggtgccttcctgtagtcccagctgctcgagaggctgaggcgggagaatcacttgaacccaggagacggaggctgcggtgatccaagatctgacatcaagccaatgcactccagcctggttgacagagggagattccacctcaaaaaaaaaaaaaaagaaagaaagaaagaaagaaaaagaagaaaagagagttatcatgaaagtctccatatgttggtatggagttagtgatcaaaattgcttttagggcaatggtcctagcaacaacatggagtgagaaaaatacaaaactttgattatacttcctcaaattcccaaatataaaatcatctgttacatcttgcaaatgtgtcctttacactgcctttaaaaatttttcccctactgtttatattccactcctcccattctggtttagtagctcattacctttcctttgaacatccagactacaaagagaacaattccaatcatgccattcacatagtcataagctgtccaggacacttcactgtctaccacactgaaggtcagttattcatcatgatgttgaaggcttttcacagtgacatagctatctaattatctgctaatatgaagtggacatggtcagtgtcacaaacagcacttttgcgtgatatttatacgtggcagaagcttttcctcccctacatctttgatttgtgtttctttaataccttgaacaccatcttcgccctctgccttttgaaagcctgtccatccttaaaaattgattttaaaatacatctccttttgagattaaaattttaaattactccgaacatatgtgattgtttctttatgctttcatgaaacattgtactttttatatgtgacttaaaaatttatctgatgcagccatcacaccacttattctcatacagcgtaaacttctgacagtgacactgcatgactctggctttcattttctttcatttcatttcaaaatattgccttgcacaaaactgtattaattaaggttgttaccaattccagaggttactacttgtctttttcttcgaaacttcatagttcaagataactatatgtttagtcatgataatttattatgtaccaagcaagaagtaagcaccttaaaaactatcctcagttgctgatatggtctggctctgtgtccccatgcaaatctcatcatgaattgtaatccgaattgtaatccccatgtgttgggggagggaccttatggaggtgatgagatcatggaggcagtccccctgtgctgttctggtgatagtgagtgagttctcatgagatctgatggttttataagaggcatttcctcccttattccctctcttgctgccttgtgaagagatgccttccaccgtgattatgtttcctgaggcctccccagccatgtggaactatgaacaattaaacctctttcctttataaattacccagtctccagaagttctttatagaagcatgagaacagactaatacagttgcctatattttcgatgtctcctccctactctactgcccctagaaagcattaaaaacaagcaaattggatcaatcacatttcaaacttcatgctcagaaagtgtcttcaggcactattgtactgtatgagaaaaaataaagttactttcagtgaaagaattggcatttttaactttgcaatgcccaatgaacaacatgattttgttctattttttactgctcaactcattgatgtcaagtagttactaccagattcaaagagagacactttacctcaaactgcagtgtttacactttcttgtgatttttcattcttagattctattatgtggtttcttcactcctttactcagttctgtcttgatatatcagagcctcaggcactgtactaatatatatcctaaatatttttcttgattccattatataaaggctcccattcttgcaacaaaatgataatggtgagaaataaagagttaaatgcagatttttttgctatcttaactttaaggacgctatataataatgtagaaaaaatgtacagacacacatatagtgaccaaataaaagtaaggtgttattatgtaaaaaagtgatggataccattcaattcttcattttttacccctacttaacatgacaataaactattagcaaacatggaaaattgattatgatatggattatgttaattcagtcattcagcaaatatttattaagtattcattatgtcccaggaaactgtgcaagttcttaaaggtatatagataagaatatatagacatttttctaaaagatgtcacatgataataaatgtaaatcagcaaaggaaagagtggaggtgggaagaaattgagaagtaatgtatgttgggaattataggtgattattcttaagtaccaaaaagagacagaaagccagaggagatgagaacctaattcctattcaacagcaggaattaaccagggaattaaaagaaacttccagttataagcttgaaaatgggagtcaaaaattacagcataagtaaaatttagtgtgccaaccagacactgggtgctatagacaaaaaaatatctagacaaatcttgcccttttttggaagctgaataaaaataaaacacatatggaggcaatgaacaggaagaacatctagaagatctagaagaaaaatactaaaaatagtattctgcacaaattagaaaaataaattaaaaaataaatgatgccatcaagaatatccaaaggacatttactttaaaagacctgatatgtaaacagaaaagtatgaaaaaatgcagtgtgaaaaggaagaggaatacaattaaaaataaattgaaaggttattaactatgtaatagcagatctgatacaacagcaaaggaatcgctatgtggaagattattttacagaccttttccagggagtggaggaagaggatggaagcactcacattgtgcaaaggaacaaaaatattggaaaaaaaaattagataaaagatggctgttatggaagtctgtaaacaaagagccatcaccgagatgaatggtattctgaagaaagtgcaaccatacctattcccaatcttacttaacatctgcatatgcagtttgaaagagctcatcagatacaggtgaaaaaaaccacactgaagcctgttccacaaagttgggcacctgctcccagcactcacagaactatgtttattctaatagatacattctagaaggacattttaattgaaagaataaagaaaaatgtacaagcttacaggaaaaaaactacattagccatactaaacaataaacaattcacttccaaaatatgaaaggccagggcacaacaaagacagatgcctgacaaaatatcactcaatattttttgaaagaataatattctagaaaattataaattaataaaattgaaaaatcagaaaacaagtagaaaacttgaatagaaccataccctggggaaaaaaattgaaacagctgaaaagatctaacctctaaaacagatgctgggaccagatggctttatgaatgagtcctctcacccgttaagtgacccaataatgccaatactgtttaaactattccaggatctgaaaaatagaaagatagcctgctcactgtataaagctagtataacaatgatactaaaatatgggaaagaaaatgaaagaagtaaaaatggcacaccaatttcactttggtatatagatgtaaaaataatataatatttgcaaacttaaatcctgcagtatattgaaataacatcagaatcaagcatattaaagaataagtaatagattcaaaatagagaatatattaatatgctctgtatctattccattcccaccttctcaaacacttcgactgtagagtcctttatggcagagtgggacagaggttgtttttttgggcactgctgggtcttctgtgcctatcccagtatcttgccagagtaatcaataaatctctctcagtatgtggaaaattgaatggagaggttgttggaggctgaggggaggcatttgtaatagatacaagtaaagtttagcaaattaaaaattgataaatttcctcaacagggtatttttacattatgtaccaaaagccttagaaattcacaatttctgagctagtaacccatcttctgagaatttattctcaagaaatggtaaagatcatgtacaaacactttcatcattctccttgtttattatacaagattttcccctgactttcctttaaatgatgcaggttttcacaatacatgcttcggacctttctctacagtgtttctaagcctctttatcctggctcatagtttaaattaccatctctcaccgatgatctacaaattttgcctctcattctaacctatattccaagtccagaacactatatgtaacaacatttttagcatcctcccgcccccttggttgtttcaaagacatcttagcacagtatttacaatattgaatttatgatcttctctcccaaagtttgccattctctgaggttctctaagaaattccatccagttcttcaaatttagaagtcatcactaaaatttcaatccatgaccctccctaaatccatccataaatccctttaccatattttattgatataatattctaaatatttactaaatatcaacttctctttaagacctctactacttctatccaatgtcaagttaatgagtgtctgctccctgggcaactaactagactctgtacacatatgcctgccattctaatacactgtttacactgctatcctagagattcaattttttaatgaggaatatattcattgataacatatctatacacaggaataagcttgtacaaataataaaatactcatctatatacaaatcaataaaagcttttgcaaaagagatatatggagatatgaagtgtgatgatggtgataaaggagaatgaacaaagagaaagaagtggaagaggaagataaagatgaagacgaagaaaaaaagaagaatgataataagaacaagtataagaaagacttttaaaataaaataattatctacaaataattttaaacactaaaaaagatgaaagaacagcaatattcaatttcttcgcaaactctgagaagctcaacaagtctttcaaaagcaaccactaccggaaaatagactgtgacgatcagatgtagtgcctcagagagaggcaccttcactgtatgtcattaatacgtctcaatcacagtgtcaagggtcaaagaaagaaagagtaaaatatgaactggtccaagcagaagatagaaccaataaaccaaccaaataaaataatgggctattgtgacatggatttagcaccagcagttgcttgtatataaaatattcccctcaaccccaattttctttgcatactttattccttcttcttcagatctcagctcaaatataattttcttactaaagctttgcatgagttccaaaccccatgtaacattgtttcgaatatcctgattttactttcttagtgtttatcacagtgattatttgcagacattttattaaagtctgtttcttcctcattagtctttgcgtcctttgagagtaaaaatatatactcatataaacacagggcctatagagtgccttaaaggcattctataaatatctgttgatgagattaataaacaaaaaatgagaacaaataaatgaacaatccaaaatctcgccatactggattattacttttagtttagtttctgagtttaagtctgtcttgaggtcataaaatgttggctacaattaaatgtttcatgtgtgataaaaatagaaaaaggaaatctgtgatacataaaaacaaaatccaagtttctccctctattccctacttcaatcccactgagctaaccagtgctaattaacaacatgtgtataaattcttccattcctttttccttgttcataataataataatagctgatatttatggagtacttattatatcccaagatttgttctaagcattttacattattatttcatttatttctcaaaaatctgtaataaaactactaatactactccattttgcagatggaaacactgaagtatgaagatatttagcaacttaccaagctgggaaagtcacacagctggtcagaaacagagccagtattcaaataaatactcagatgatttggcaccagagtcctctgtgactttatgctgggtctttctcaatgtacacactaacttgctgtatatacctgcataacaatgtactgagaagcattcaatcagtaatgtgtttacaaagctgttagaaccacgcctggcatatagtaaacacttattcagtgtatgcaattattgctataatgtttatttgttttaatgagatataatcttgctatacattagtctataacttgcttgtattacttagcataagtattggatattctctcttgttttctagtttacttatgcatttaaatatgtctgtacacacatagaaatcattttacataaataggttcctgtatgcttagaatctcctgtttcctacaattcctatcttcttccctttatccactctaatgaacatattaacaacctgatcataatgtgttttatgaaatattattattaatccaactgtacctccaaattcaacagaaaagaaaaaacatttccaagaacaacagcaaaaatcccacaaacacacttccagacaaggtcctttggtcattgtacaatacaatacctacttctgtgcattttgctttacttgttcaaatgtatctgatagaaataactcaaaatcaatcaataggattctattttattattttattgactatatagtaggcaaaggagtaagagtttatgtcaaaattattttcttgatgagcagtcacttcatttccaggtttttgccaccataaatggtgctgcaaaaacatactcagatataaatttacacatgctgcttttattgcaaggttaaggagcacatcattttaaatgttaatagatgttaccaaattgcttttccaaaaggctgtaacgattcacatttctaccatgagtaaatgaaagtactctcttccccacatgactgccaacagcaggtgaattggtagttgtcactttattttgcatttcactgactagtgagtttgaaaatcttttcatacatttattgtccatttatatttccttttatgtgaatggcctattcatatcctttgtctgtgttactatgaatatatatataaatatatatatatatatggccctttatctgtttatctgtcatctgcattgcaaaatttttaacaaatcaaattttttcctgttaccttatttattgtatcttttgccatggaaaagctttatttaaaattttgataattaacttattcatattttatacttctgccaattattaacttattgcctgtcagcttcatacccaaccttctaaactcagctctgtgatcctggagctgaaattgcaatttccatttctgtttaccagtagggtccgtgttgagctctggccacagtgggagctaagggagatggcaaggctggaggaggaagccaggacctggccttttctatgtactccttgtctacttcctgtgtgcctccagaggactcttgtgccttgattcttcatcccagcagctctttttatggcagcagctaaatcaatttcaatttttgccaaactcatagaaccattctcattgcaccctcttcagagacactaacagcacctgaggagcacctcattttagaggtttgagtttaagcccttcatctaagtcttttaagatttaataactcaaacttttatttggcccctcttccctaggtattgtagttgcttggtacagttaccacctctctgatcctttagttctctcttttaacactttcagctacctagttagtaattttatatatataatagttgtatcttaaattatatgttttggaataaatgatgtggtttctcttcaacagtgatataataattcataaattaagttgggttatttgtattttcttaggaagtaatctatttgctctggattttcaactttattgccatagtaatgcttgtattttcttattttatatgctattccttctatacattttatttaatctcttctatcattctaatgtatatatatatatttcacttgattaaaataactggattatctatattattggttttgtgggtgcatatgtgtatatatgtgtgtgtatgtatatgtgtatgttgtgtgtccatgtatgtgtatgtatctttgtgtgtatgtgattgtgtactcatgcacgcgtgtctatgggttgatgtttgtgtatgtatatgtgtggggttttttaacagccatatagcacagcataatgataaaaacattttgtagttgttaagagagtatagctattaacttaatgctctagtgcagaattcaccaaactttttctataaaaggctagttttgcaggcctatagtctttgtctcaacaaattaactctgcgattgtaataccaaagcatccataaacaatatataaatggcatgctctggggtcactctctatttgaatctttgccctctatcccatgactttgcccaactaacttaccttttagtgtctatatctcatcttaaatatcaccttcactaggagcattccatgtttctctactggatccttattatttaaggtgtggtctgtgcacaaggaacgaccatatcacctgggagcttatgagaaattcagaatcttgggctccatgcagtagtgtgtcagagttggttcacactgatttgtgaaagcagaatacgcacaactcttcccaaatcagagttcagtgacattgagttggtagcttgaaattgtccacggagggaatatttataccatggcagtttgcaaatgctacaaatgagagtgttttatttaagaaaacaaaaaaaccttgtttcttgcagagcattggcttaccccagacctactgaattggaatctgcattttaataagatctccagggcatttatattaatattaacattaaaatttgagaagcactgcagtagatcattttttcccaaagtacatgttagaatcacatggcatgctaattaaaatacaaagtcctgaaactcatgtgtacatagattcagaacctctttaagtggagcctcagaaatcctttttctgtaaaaatatgcgttataaacaagctttctgcttggttcttaggcaccctaaaatttgacaattattgttctacaatatctgtgcccagggcatgctttgttttctaatttataatagagcagaactgtagaatcataaagaattattcccaggccttgagacctactcacagaacttacacaatttgtatggctgaattttggaattattatggactaatgacccttttatgccttcattttcctccttttagaacaggaatgtatacagttgttattctgtgcctgcccaacaatgtatatttggtaatatggggtagatgatttgtctattttagtttcacaggtctacagatagagaggaatggaatttaaggagctacacttaaactacgtcccaggtgcatcatccacacctggatctagttaggtagccggtttctggacgtcagatcgttgccaattggatgaaacttttgagaggacttggggaggggctgcatgtgggaggactgcttaaggactttctaagttccctcatttgcttaatgatggtttcagaatcatcagggttggagtgtggggaggatgatgaggtggaaggaactcaaaagttcttagcacattggaaatctagctcagcactttgtaaaataaccatatttttaaagccaacccccttcatagcgtttatcaaagtccctacattgctggggatctcacatgtgtaattcacctcttgagaattgtgtgtttctctggccggttgttttttatcttttttccctagctcatcacatataacagagaaagcagacacacacagaaacccccccagaaaccttttctccagttcaactactaaccctttcatatgctccacatggaaaaagagcttcaaattaatcacacgtgtctatcatacacggtgactggtgttcactttggagtgtggactctgttgttgtcaggcttagctcaaactttggatttaaatatgctattaactctagtagtgtatttgacacttagttaattttaaggaaatatttgttgagcgaaggaaagccacctattataaaactgagaatattttatatttcagggtttttcctttctgaatatgtgttttcatcctattttaccaatgatcttaaaaattcatgtattatagaaaaaaatgaaaacttgtattggcttcataatttgggaagtaaatactatcatataaaatatagatccttaatgtgcataaagtttcagttatgcaagatgaaaaagttttggagatctgttgtacaacattgtattatggtaaacaatatacagtagagttaaacatttgttaagatagtacatctcttgtgctttttaaccacaataaaatatttacaacccctcagaaaccttggaaaaatgactgtttctatgggggaaaataaaaccctattaaaaataataatagtatatatatcctaaagcaggcagtaaagtcaataataatgtaaaacaattttctgaatttgggaaaattgaattatagaatgtaatggtgagaataattaattgaatatataatagaaaaagaagtatttaaattttgactctatttgctctgagatttcattcttattccctttggcttatcaggggcaagtgagattgactctgaactttaatatttatttgtattggtatattagtgtttccctctgccattatactatatttcctttgcattatttccagtgaattttatgatgctggtagttttacatagagaggttggtttttttaatgcaaaaaaaaaatgtagaatttttttcaaggaaaatgtaattctgccaagtactttggttcatttgatgctgcctgtttaactctgttcggctcaatcactgtgttggacatattgtgacaaaggctcattttcatcaaaaggaatccccagagggtttgctgcttcaatgaaagggaattcattaaatatagtctaatgtaaggtgattggaatatatatattccgatacacatatgtatataattgcattttagtcagttcttatgctactgggagcgtttttttaaacactcacttctaaatgaagaatgctgcatgaaagctttttctctttctgaaaaacagctggtttcttcagcaattcaacctagaacaaagaaataaaaaatactacatgctaaagcagatccgcagtaaaaattttgtagaggcaaggcaaagtaacattaataaatgaagctaattaggcttgatttgcatatttaactcatcttaattacacaaggattcagcaaacattttaaaagctgcaatcaatctttcacagatatggttagttatttacatgaaataacaaaaactaggagctttgttaatgattactctgtttctaatttatatgccagtgagatcatttcagtattaataatggaatatattttttaacaacctgtaaacccataaggttaaaattccaaagaattttttcacaaatatgtttttgagaatttccagaatatatgaaatgttatataaattgctctattgtattaaaatgttttaccttgttcaaataaaaaaagatctttataaaattcttttgacattaatttttaaacttggaaactaaggtagtagccataatagagacaagcagaatatagtaggtgataagtaggagaattttttcttgcagctggcataaactttaattctgctcacccttggatacaatttgctttctcatctttaatagtacttttgactggtcacagaatttgaaattaaatagggggcataatgacacaatatgattctttttaatttcagtgttttatttagataaattattttgtaaaaatatacgcaggaatgctgtctctgtgttgtgatgtgaggggctggcaggtgcacttgaagtggctaagtacagaaggttctgtggacaagaacgcaacagtgcacaaaactttatgctgtgcagctgtcagatggttgtgacattccattattagggctccatttcttagatttttctctccatgagtgtccttttataacatcaaaaatcttgacccttttgcttaaattaccttgaaagggtggaggtcatgtggttaggaaaggacagctggtgaagggtgcatttaccaaacttgcaatgtgtgtgtgtgtgcgtgtgtgtgcattagtttaaaaatatgtattaaatgcttcccacgtgctaattcatcgttgtggttataattatgaagtgataaagacggtacactaaatgtcatctctgctatcatagagcttgcaatctgcatattatgactatgtaattgttaacatttattgagtacttgctttgtcacgggcagcaatcaaagcactttacaccaattcacttgttaaatccccaaaatggcactatcatgtagatactatattatttctattttacagatgagaaaactgaggcttagagtgttccaagggcacagtaagcagcaaagcccaaattcagacccaagtagtttcgctccagacactgtgcttttaatcattacattatatgcttgtatgatatccaagtctgtttagatatgtattcaaatatgtaaaatatacaacttttcattttgagactgcatataagcccaaaatatattcatgcaatataggtacaatacaataaatagtataaaataatgtcacagtttaccttttgcaaccagttaatgttctaatggctattgtattcctaagacattttatgagtagtagaataaagatatctgtagctctttgcaaggggttgaattgtgtccccttaaatccatatgttgatgtcttaatcctcagtatcttggaaggtgactgtatttggagataaggtctataaagagataattaaaattaaatgaagtcatcaggttgggcccaaatgcaatatgactagtgtcctcataaagagattaggacacagatagacacagatgaaaggccatatgaacatatagggggatgacagccatctacaagccaagtggaaggactcataatgaagccaaccctgcctacactttgagcttggatttctagcctctacaactgtgaagaaataaatctctttcgtttaagccacccagtctgtgccactttgttatggtagctttagcaaactagtataaacttaattgtgtctaaggatgagaacaccactcaatatctgaaaccaaaaagctgaatgtataatacacttaagtgtggaagaattatactggtcagagttacccattgagcaaatccaattgctgattttatatccagtttttgtgaagagtttactttggattgtgctggttacagaggcaggagttggttgaagtcagttttagaaaagtagcttgtattggtcaatgagactttttttttgccagttacagaagtagaaaaaagttgataatagcattagaaacatgttcactgtagtgaatcctgaaccagttggctgactttcaagtcgtgtctgttgttatttgacttttacaggagtgctcactgaagttacttgtcattgattaattagataggtttaaaacccactctgattgtttacttgtaagcagggctgtagaactgttgctaattgattagatgagtttataactagttctggtgcttgtgagcatggatagagaacactgagtcttttcctgggagagtggtgacttttaaaattctcagcagccaacaaaaattaataggtataacaaggaatagagaaaaagctacaaattaatctataaataacaatatcccttacttgtgtaggcattatgttaattgctttacataaatttctcccactgtaaatggagatttaaaatattactaatttcctatggtagagatgaaaagaattgctatacacaaagtacttagtaaagtgtttatacgaataagagatagtatcaataattttccaataagctgagttttaaactctgcaacttcactcaaatatcacattcttaaccaccacaataataataaaatgcatatatattatggtttcatttatatgaactaaggtagatacatgagacagtgaggaaaggggattgtatatgtatgaactagtccatgaaatatacaacaaacatgatttatggtagttgcctctggaggtggcctaaaatgggagactaacttttcattggagagtgttttgtaatatttgactttacaaccatatttttatatttcctttctcaataaaatatagttaataaaaattgtagggatgtttttactaagaagggcatgagagaatgttttggaatgctggaaacatttcatatcgcaatctgaataacaattacacagatatatacacagataaaaatgtattgaggtaagcccctaagatttatgcattttagtgtatgtaaattatatgtcactgatatggtttggctctgagtctccacccaaatctcatctcaaattacaatcctcataatccccatgtgtcgaggggagacctggtggaaggtgattggatcgtgggggcagtgtcccccatgctgttctcatgatagtgagtgagttaacatgagatctgatggttttataagcatctggccttttccctgcttgcacttctctcttgcctgctgccatgtaagacatgcctgcttccccttctgccatgattgtaagtttcctgaggcttccccaggaaaattaaaccttttttctctataaattacccagtctcaggtattgctttatagcagtgtgaaaatggactaatacaatcactaatataaaaattgatttaacatatcaaaaaggcattttttttgttttctctgacatttaatttatttcatttgtttaacttttaggttcaggggtacatgtgcaggtttattatataggtaaattgcatgtcacagggatttggtgtacagattatttcatcacccatgtaatacgcatagtacctgataagtagtttttcaatactcgtctttctcccaccttccaccctcatgtgggccctgatgtcttttgttcccttctttgggtctatgtgtactcaatgtttacctcccacttaaataccaaaacatgtggtatttcgttttctgttccttgttgctatgttagttcacttaagataatgacctccagctctatccatggtcctgcaaaggacatgatctcattcttttttacgcctgaatagtattcatggtgtatatgtagcactttttttcttcatccagtctaccattgatgggaatttagattgatttcatgtcattgctattattaatagtgctgcagtgaacatatgggtgcatgtgtctttatggtagaaaggcattttaaaatctagccttggaggaaaaaaaatgagtgaagtggactcacttcatatttttgtcttaaaattttttcaaaagaatatggaattcattgattaagtaagtcattataatgagaaaggaaattcataagcattagcactttaatgattttagtgataatatgcttggctacttattttatgatttaattttggcctaatttttaagagttttaaaggtttttttgtctgaaatatgacttttgatgagtattacttaatttttttttcaaattttcacatgacactattgacactaaaaagacttttactattttgagggaacaagcttaatctttatacatagggttcacggtcagtcaggctaggctagcttgtgttatggtaaaaaacaacctccaattctcacaacatgtgtgtcctgcttcagttctatgtccttcatgggttggaagatgggtgtggggcattcctgctggtcttcccagggatccaggtggatctctcagccatgaccttgaatgttgtttgtttctgccagagggaaaagggactcctggagggcatttgcacctatcattaactgctgaaaatgcgaagttgggaagagcctgagaggagtattctatgtcatttccattcaccactcttaagccagaactcattacatggtctctcataagcccatggagggttaggaggtgcgtatctacccagaaaggaggaatattggaaagatttggcaaacagcctcactcactccatcttcttgcacataaagggctaggggactttggaatcaggcaaaactggaaaagtgtcatgactctgccactttttatttgtgggttagatgccactgttttcatctctagaatgtgaattacaatagtacctatctcctagcattgctgtgaggattaaatatgataacaactgtaaaacatttagcataatgctttaggtatgtaataaacacttgatgaatgtaaagctgcatcctccacctggaatcaccatttccctatagttgtttaaaatgttaataggcaatggaaaagtcaatgggtgaatatgctcccgggttagaactacactgaagcaaaggtgttggggaataagaaagtgcacgcatttcatgtcatgactgatcagaatgaaaataaatattgagaagactaagctatttgtccaataataaagcatatctggtgagggtggttttttgtttttttttttttgcaatttcatttataatctccatgtaagtgtgcttactttttcattcaataactgtatcgtatcttaccagagatgtcttaggccttggggatgagaagacggaggagtggatgagtttgtcttgtggagcgtaattttagaggcaggagactacaataaataaggagaaaaattcatgaagtaattttgttaatgaggagtgatatgaaggaaacaaaatggggtgacctatttgtcaagtattggcatctgtgaatataattgaaccctgaaatatcagggatgtgacacagtggaagctcagttctcattcatggactacccaattgtaaggtcccgaatggcagcttttctctctgtggtggttgagaaacccaggttccttccagtttatgctgcctcatcatctagaggccttctgcgtatagcctgcaaagaacggaaaatcaggagtttggcagattatggtggatattttctaagggccaggcctatgttggacttacttcacaactgtctgtgttagcagtggaagagatcagagttaccctgatttaccgacggcaaatccataggtgtctggagcaaattcagcctttgcctgctcagaagaaagaattcgactgaggggcataaagcagaaaaagagaccgagaccggggcaagttccagaacaggaagaggagtttattttaaaaggctttagaataggaaagaaaggaaaattcgtttggaagagacctaagcgggctcatgaaggatcaagggagaaaagggagcaaaaaaagggaggcctttaaccttgttgctaggacttcatgggcttgcctctttcccatgattcttcgcgtagggtgggcttcccgcatgcgcagtgttttccttaccctttggaattgagcacaggcatgcagtgtgtttagggaggtatatgcatgcccatctgaggttttttcctttctccagtggcatgtgccccccagaatgtcatacttcaccgttttgtctcttaacacacatgcccaagaagctgcttctccctggggcctgcattcaattaacactttaatgttcacaagcgtggaccatcaggagattgtctctctctggctaatagattaaatatcatttttagagaggcaatattgtggaaccatcacccaacatttcagtgggtgatgggagaggcttctcctgcccagctcttgcctaactacctgtagcacctgcatttcactgagcagaactcagtcacatggccacgcctgacctctagtctggctgtgtgcccaggaggaaaaataaaagtgtttcatgaaacagtttctgctactctaatgactggttgtaagagagacgtcaggaaattagatctcagacagcatgaaaaaggttgtgtttgagttgaaagcagcatgggaaggataaggacatgtgtatatctagatgagaacatctgcaataaaggaaacagaaagcacaaaggcgggagcattccaggcagttagaaaacaggaaggccagtgtgacagctgtatgttcttgtatctaactgtacttagagttattatcctgacagtacaaaggagttgtctggatcagatatcaaaccatttactcagagagaagactgtttattttctattcctcaattccttatgtagggggcagggagggctgggtgagaaccgggtgtaccttgtgggtacagaaggaaaggggttatgtaccacgagaaaggaaaccccaaaccatgaaactcaattttctttcttccctctggggagtgggggttggagggagagagggaaacagagagagagagagagacagtgagagagggagggagagagagagaacattaaagaaacctttgctctgaaatctaaacaaatcttcccaaaaagaaggaaagcatcggtttgcaatccttggatgtgaaagaatgcctcagggtgagatgtccctgtatctccccaggggtctctatctttagggttgctattcagtcattctttaactcaggtgccagaactctgcttagaaagccctgaccatgaagaaatatgaaaatattcgaggaacacagtgaaaaggaagagtggtaaaggatgaggtcagatacagagacaagagccgaacaatacagggccttaagacacaggcagagagtttggagttcttttagtgcaatgataattttttggttggctgtatgcaggagcgtgacatggtctgattcagcttttgttggttgctctagtggcggtgaaggggatgactgggagtggggtggagtgggagaaggaggctcctgccatagtcagggtctgtaggatgatggcctgcccccagagtggtgatagtggcaagggatgaagctgggcagagtagggctgtattttgaagaaagacttgtagtagataagggttggggctggagtgggggaagaaaaagaggtattcttattcccaggtttttggttgccttggtttgtttgtttgagcagctggtgatgccatttatatgtataaagatttcgtgaagatcaaaatagacagttgggaagtagtaaatcaacaagtcttcttttgcttattatgtctgacgtgctgcatcagacaggtcaccagcaggaaagaggggactcacggagtaagctcaagtttaatgtttacagaggtatgggcggcattaagggagctagcacagcagccagggactcgcaacaatgggaaatcatcactgcccactaccactgtgtctgaaaggggaggggaaggaaagcattactggatgcagtgtgcaagtggccatgagaaaggatacaggagctgtggaatttggtagagaataaggccaccgacataatcacagctgaacgggaggtagcagaagtggcaatttatccattctctctttgtgcttatccatatcctacaggcgcttccctctggctgaatccaaccagagcccagaagtcctaagaacataggcaatgtagttagtagagagcctggcatagggcggggcagagccatgcggagaatgaatctgagggcaacagaacaaacagcacccatgtccacaagagctctttaagaaggcaaatagacattcaaagttggaactcagggagaagtaagggtggatatgtcaactggaaaatattcagcatttcaatagtatatgacaaatattaagagccaatatttgtcaggcccttactctgtgctaggcaacataccaacatttcctgtgcattattatctcaattaattctcctaacaaagctataggttaaatgccattatctcattgtacatatcaggcaactgaagcacagtaaagcaaagcaatttgtttaaggtcacacagctattaggtggcagatccaaaaattaaatgtggccatttctacccccagggtcagtgatagagatcattattacacacagcttctctgtctgaatcaaatgctggagcaatgcatattgggtcacattattattattttttttgtaaactcttctttcttttttattttttctccttttgaaagacaactattctgacaagaattcatcaaagaagagattccaaattttaatgtcccagtttgagtattgcttttgattaaggctgtttgcagactagaatgttagtaaccctcacattccctataccacaaaaagaggagattcacttttatcttgggaacaaagctgtgtagaaaagctttttaaacttattttaattcatgaaacatttatcttcgagtcaggttttgttatagcagcacaaatgtggtccgtcagcatttcctttataaccccatatttccagggtttttcaagagtgccatagagattctactttgaattaaaacttggcattcagaatttgaaaaaaaaagctactacacttttcattaccaattaatcaaatagtttagcgattctcaagttagaaaaggaccaaatgcaaaactttcattaatacaaaaatattttaagacaatttgctaatttatatctttgtaaaaatattaccactcagtatacaagtattaatattacatcactgtatattagttctcaaaattaaccaaaaaatttctaagataatataaaaaactatgacatcttatgctttgcctttttggctttgtaagtaatttatttctattttgagaattgggatgatttgaagttcttagcataattggtttaaagttataacagtgtcaagatactgagccataataacaaggatggttgagattctgagagagtatcaaagtgtttcaatttatttttgtgaaatttaaatttatgtggggaaattttgcactctgtgaacaaagatttgtagcatgaattgattctttaaattgatatttggaagttaacttgctgagtacaatgacgataatgaggaccaagtagagattagtttagttataaagcctttccaactttgcttggttcagagatactccatgaatggccaataacagtgaggggcatcatgatgatctacctttggtagctcattttgcaatctcttctgtaatctctcccagccttcaaagatttaaggttaaataaatacaaggtagtgaatgagagtagatgaagacttttgagtgaatctactcttctgactgacttctttccagccacactggcttccttgttgttccagaaatgtgtgaggcaaacatctacttggagacatttgctctagtttttcttcctacctggaacacttttcctccagaaaaactcccttcctatactttggctatactcccttactatactttcattggctaactcccttactatactttcattcttggctaactcccttactatactttcattcttggctaactcccttactatactttcattctttattcaaactttatcttctgggtgaagccaaactggataactctacttgataatgtgatttcccttagttcccaaatcccaaaattcctactattactaaccctgcctgacaatttcttctcttcagacttattatcttctagtacattttatgcctttatcacaaaatgcccatctcctccactagaatataaggtccgtgagaataaggttctttgtctatttgttgacatatcctaagcacctagaattgtgccgacaaatattaattactcaaaaatatttgtcgaatgaacaaatggttgaatgaaatctgaatttccaagcacatagcaagactctccaagcaatagtccacatatgactttcccttgttctacagaatttgggttatttccctacaagagtcaagaatgcccgttgaacactggtgttcaaaatgaaaggccccacatttagatatttagatccctattataatgtgttataggtccatctttcccggaaacatttaaactgaagctgggatgtttttgtagttaattttaattttagctattatttggataagttaaattgaatgaatagatgtgaagtttggttctcacaaaacaaatgcttattctgtatttaaaaatgccactgtatatattttataaatttttatacaggtaataatgttaatgctgaactgtgaaaattcaggagctaaaatgtgattctatcatttaaaaagaaaaagagagaccccactgcctacccccagcagcagtagatatgctgtgctgaaaataacagctttctaataagggagttcttaatagtctttggcctcagggcttgaaagctatgctaattgagaaatgcagccacttagtgagagtttactaccagctcagtggtgtaaaagcaacaacagtagaatttcagtgtagataccagtactatggtatgctccccgctctaggtctgtactattctgaatagtagttgatagcaaaagctagaattttctatggtgagaatgtattaattctgggaggaggggctaaaaattactttaaaacttaaaagcatctttgaattcctttttacgttccaaaagaaatttatttgactctgtttctgctttgtcttcctagggtatatgtgagcagtcactttatggtcacatgcattctatcaatgatgccatttttgatcccagggtaagttcagttctcccagtaaactgtttttaatgcttcatatatacaaattcatttttataaaacaaatttccaagctaaaatggtaagttaatgaggtgagaagaacaactttaggaattagttgtaaacaataggaaaagtctataggtatatagggttgcagaattttaaaattcacacacacacacacacacacacacacacacacacacacacccccacacacaccccaagtcgtagcaggagtgacaaggaattctactgtagtcaactttacttaaacacatttttaagagccttttgtccaatttgggcttcaaaaaaataggtgggctatagactgcataaaattttaatgaaaaatcattaaaataactataattgctctgtaatttttctgtaagaaaacctggagaagaaaaagcagttaaagaaaaaagttttctccaatttagaacagaacagctttgatttgacagctttttaattactcatggaaaagtttcaaatatgtccttcttcataaaaactgatgacaaaacaaaaatattttatctgccacttgaggtattcattcaggtgtaaggatgatttcacaaacaatgaaaattgttggagagtcctttgagttttctgtggtttgaatgtatccctccaagtttatgtgtcgcaaacttaatccccaatgcaagagtgtttggaggtggagccttataggagatgtttaggtcatgacactggcgccctccctcctgaatgggttaatgtctttgaaggaagttgaagctgcaagttcagtctttttgctctcttgctctttttcctccctccttctgttatgggatgacacagcacaaaggccttcatgaaatgatggtgccatgctctgggacttcccagcctccagaactgtgagaaataaatttattttctttaaagttatccagtttgtggttttctgtaatagcaacagaaaatggattaagacagttgccacgtgaattaaggatgtctttaaaagggttcagatagtaatcaaagaaggatgatttaagtctgttctcagatgaaagagatttgactacatagatgacctctcaggttcatttaaactctatgatttaattatatctaacattttggttgtctcaaagttcccagtagagtgagaatcttaattccaaattccacttcttttccaattagctataaaagaaatctgatggattacttacatctaacatcacaatgatagcatagtcaaaattctgttaccatcctgctagtatcattcttttagaaagaggaaaaatgctcactaaaaattatatctactaagggaatgttgattgctccaattgaaattgtgcttgtgtcattgtcaggcctgggaattttaatgatgggctcaaccaaaattacattttaatagattggtctttgtaagaaatattctatctaattttctgtagtgagccaattagttggaaagtattatagattagttctagataccaaggaatattttatttccagcagggtatggaaaaatttaagcactatggacccattatgaaatagaatatagttttatgctgaaagtccattaagtggcgtatagcttcacatgccctacaaaaattaaatgggagctgaaatgaataatattttgtaaatcaggcattttattttggcaagcaatataataactgcaaaagacagcattttacattctaaatattaaacttaataaatatggaaataagcaaattagatttattgaattagcaatcaagagagacatacattaatttcccatatttcaaagggcaagataacagatatgaggtttaggtgtccaatatcaaagtagctaattttttttattattatactttaaggtctagggtacatgtgcacaacatgcaggtttgttacataggtatacatgtgccatgttggtttcctgcatccatcaactcatcatttacattaggtacttctcctaatgctatccctcccccagcccccacccctgacaggccccagtgtgtgatgttccccaccctatgtccaagtgttctcattgttcaatcccacctatgagtgagaacatgcggtgtttggttttctgtccatgtgatagtttgctgagaatgatggtttccagcttcacccatgtccctgcaaaggacatgagctcatccttttttatggctgcatagtattccatgttgtatatgtgccacattttcttaatccagtctatgattgatggacatttgcgttggttccaagtttttgctattgtgaatagtgctgcaataaacatatgtgtgcatgcatctttagagtagcatgatttataatcctttaggtatatacccagtaatgggatggctgggtcaaatgttatttctagttctagatccttgaggaatcgccacattgtcttccaaaatggttgaactaatttacactctgaccaacagtgtaaaagcattcctatttctccacatcctctccagcatctgttgtttcctgtttaatgattgccattctaactggtgtgagatggtatctcattgtggttttgatttgcatttctctgatggccagtgatgatgagtattttttcatgtgtctgttggctgcataagtatcttcttttgagaagtgtctgttcatgtcctttgcccactttttgatgggattttttttttcctagtaaatttgtttgagttctttatagattctggatattagccctttgtcagatgggtagattgcaaaaattttctcccatcctgtaggttgcctgttcactctgatggtagtttcttttgctgtgcagaagctctttagtttaattagatcccatttgtctattctggcttttgttgccgttgcttttagtgttttagtcgtgaagttcttgcccatacctatgtcctgaatggtattccctaggttttcctctagggtttttatggttttaggtctaacattgaagtctttattccatcttgaattaatttttgtataaggtgtgaggaaaggatccagtttcagctttctacatatggctagccagttttcccagcaccacttattaaatagggactcctttccccatttcttgtttttgtcagatttgtcaaagatcagatagttgtagatgtgtgttgttatttctgagggctctgttctgttccattggtctatatctctgttttgatactagtaccatgctctgttggttactgtagccttgtagtatagtttgaagtcaggtagcgtgatgcctccagctttgttctttttgcttagcactgtcttggcaatgcaggctcttttttggttcctgaactttaaagtagtttttttccaattctttgaagaaagtcattggtagcttgatggggacggcattgaatccataaattaccttgggcagtatggtcattttcacaatattcttcctatccgtgaccatggaatattcttccatttgtttgtgtcctcttttattttgttgagcagtggtttgtagttctctttgaagaggtccttcatatcccttgtgagttggattcctaggtattttatctttttataactattgtgaatgggagctcattcatgatttggtttcctgtttgtctgttattggtgtataggaatgtttgtgatttttgcacattgattttgtatcctgagactttgctgaagttgcttatcagcttaaggagattttgggctgaggcgatggggttttctaaatatacaatcatgtcatctgcaaacagggacaattcaggagcaggttgttcagtttccatgtagttgtgtggttttgagtgagtttcttaatcctgagttctagtttgattgcactgtggtctgagagacagtttgttgtgatttctgttcttttacatttgctgaggagtgctttacttccaattatgtggtccattttagaataagtgcgatgtggtgctgagaggaatgtatattctgttgatttggggtggagagttctgtagatgcctattaggtctgcttggtgcagagctgagttcaagtcctggatatccttgttaaccttctgtctcattgatctgtctaatattgacagtggggtgttaaagtctcccattattattgtgtgggagtctaagtctttttgtgggtctcaaaggacttgctttatgaatttgggtgctcctgtaatgggtgcatatatatttaggatagttagctcttcttgtttaattgatccctttaccgttatgtaatggcttctttgtctcttttgatctttgttggtttaaagtctgttttatcaagagactaggattgcaacccctgctttttttttttttttttggctttccattttcttggtagatcttcctccatccctttattttgagcctatgtgtgtctctgcaggtgagatgggtctcctgaatacagcacactgatggctcttgattctttatcgaacttgccagtctgtctcttttaattggggcatatggcccatttacatttaaggttaatattgctatgtgtgaatttgatcctgtctttatgatgttagctggttattttgcccattaattgatgcagtttcttcatatcatcgatggtctttacaatttggcatgtttttacagtggctggtactggttgttcctttctatgtttagtgcttctttctggagctcttgtaaggcaggcccgggtggtgacaaaatctctcagcatttgcttgtctgtaaaggattttatttctccttcatttatgaagctttgtttggctggatatgaaattctggtttgcaaattcttaaaggatgttgaatattgtcccccactctcttctggcttgtaaggtttctattgagagatcctctgttagtctgatgggcttccctttgtgggttacctgacctttctctctggctgcccttaacattttttccttcatttcaaccttgatgaatctgacaattatgtgtcttggggttgctcttctcgaggagtgtctttgtggtgttctctgtatttactgaatttgaatgttgttgaatgccttgctaggttggggaagttctcctggataatgtcctgaagaaagttttccaacttggttccattttccccgtcactttcagatacaccaatcaaatgtagatttggtcttttcacatagtcccatattgtttggagactttgttcgtttctttttaactcttttttctctaaacttctcttcttgctttatttcactaattttatcttcaatcactgataccctttcttccacttgatcaaattgtctactgaagcttgtgcatgcatcatgtagttcttgtgccatggttttcagctccatcaagtcatttaaggtattctctacactgtttattctagttagccattcatctaatcttttttcaaggtttttagcttccttgtgatgggtttgaacatcctcctttagctcggagaagtttgttattaccgaccttctgaagcctacttctgccaacttgtcaaagtctttctgcatccagctttgttccattgctggtgaggagctgtgatcctttggaggagaagaggtgctctggtttatagaattttcagcttttctgctctgttttctccccatctttgtggttttatctacctttggactttgatgtcggtgacctgcagatggggttttggtgtagatgtcctttttcttgatgttgatgctattcctttctgtttgttatttttccttctgacagtcaggtccctcagctgtaggtctgttggagtttgctggaggtccactccagaccctgtttgcctgtgtatcaccagcagaggctgcagaacagcaaatattgctgcctgatccttcctctggaagctttgtcctagaggggcacccgcctgtatgaggtgtctgtcagcccctaccgggaggtgtctcccagttaggctacacaggggtcagggacccacttgaggaggcaggctgtccattctcagagctcaaatgctgtgctgggacaacgcactgctctcttcagagctgtcagacagggacgtttaagtctgcagaagttgtctgctgccttttgttcagctatgccttgcccacagaggttgagtctatagaggcagtaggccttgctttttgggcactttgtttacctactcaagcctcagcaatggtggatgcccctccccctgccaggctgaagcctcacagttggatctcagactgctgtactagcagtgagcaaggctccatgagcgtgggaccccctgccccgagccaggcacaggagagaatctccttgtctgccggttgctaagaccttcggaaaagcatagtatttgggcgggagtgtcccgtttttccaggtacagtctgtcacggcttcccttggctaggaaagggaaatcccccaaacccttgtgcttcccgggtgaggcaacacctctacctgcttcgggtggccctctgtgggctgcacccactgtccaaccagtcccagtgagatgaaccaggtacctcagttggaaatgcagaaatcacccgtcttctgcattgatcatgctgggagttgcagactggtgctgttcctatttggccatcttggaacagaactcgctaatatgtttttatttgcacactttgttcataccaaaaggactattacaatatagctccaaatcagtatcccacagcctcattaaaattttccattaattgatcttttctttgctgcaaatatttattaactactaatatttttaaaaaataatgtcttgttatgatgactgacattttttaaggaaatttttggtcacttatattaattgttttaacaattatgttttatgtcacatacctgctaagcaatgtcaggaggttgagaagcagctgtgactgcagagtgcagggactcccacaggtctcttgaggacatggcattgagacacagttcatattcaaacaaactattaaagttgtatttaaaaaatccatatgtggtacatatatagaaggcaaaaattttagttatttggtattagccttgctcattacttggtgcctttagggatagacattcatgttgcgttaccatttaaagttgcatttagctatttacataaacatagtttggggaaaattctacaatttcagatttgtaagtaggaatcacacatgtaaaactcaatgttatcaagctagcaatctagattcacagaaacaagggtaatgtcagtaagatggtggaataaaaagtaaccctcaactgggcacagtggctcatgcctgtaatcccaaaactttgggagactgaggcaggcagatcatgaggtcaggagatcgagaccatcctggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaaaaaaaaagtaaccctcctatctccgcccacaagaatcctgcacccatccacagacaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcctccataatgagttcactaacctccatttcacagcagattttgaggtgcaccagactcagttccagctccccttactacttttggggaactatgctgtctatgcaaagacctgctgggaattgcacactcacgtgggccagtgagacaggttcgtcagctgctgtcacacagcagatcctgagagggcccagaccacttgtgcaggacctgccgggaagcacacctgtatggacacagttccactgcgcagagacctgctgggaagcacacctgtgtgggccactggaaaatatttcagtcttaggttcctgctcagctttcatcaacagcctagggaccctccttaagtcttccccaggtccatctaggacagagagccatgtcatccttggaacctttgtgagattcacagcaaacctgggctgagaggttcctctagtgctaagacaacttcagtgatcacaggctcagggaacacaattagtatttttagatctctggaagacgctctgaaaaatgataggcacagtaaagccagactgtgaagactggaacaaatacccagtctttcaaaatgcagacattgtcacatgtccactattatcagtaatattcagggaaatgttaccttaccaaagagagaaaataaggcaccagacactgattttaaagtgacagggatgtgtcatctctcagacaaagaattcaaaaatagctgttttaaggatgctcctcaaacttcaaaaaatatagagaaacaattgagaaatttatcagggaaattttatagagagattgaaattttaaaaaatcaaacagaaatcctggagctgaaaaatataatgaatgaaataaaagacacagtggagagcattaacagcagaattgatcaaacagaagaaagaattagtaagcttggtgacaggctatttgaaaatacagtcagaagggaaaaagagaaaagaataaaaataaagaagttacaggatcctacaacagttgcctgtcaaagaaaagctcagaagtaggcttcactgctgaattctaccaaacatgtaaaaaaagagctaataccaatgtttctcaaactattccaaaaacttgaagaggatagagttcttactaactcatcctatgagaacagcactaccctgataccaaaaccagacaaggacccaacaacaacaacaaccaacactattggccaccattcctgatgaacatagatgcaaaaactctcaagaaaacactagcaaaccaaatccaacagcacatcgaaaagatcattcagcatcatcaaatgagatttatcccagggatgcaaggatgattcaacataggcaattcaataaatgttatatatcacattaacagaatgaaagacaaaaattatatgatcatctcattagccatgggaaaagcattcaataaaattcacaatccctttataataaaaaccctgaacaattaggtatagaagcaacataccacaacacaataaaggccatatatgagaaacctacaaacatcatactaaatagggaaaagctgaaagtttttcctctaaaatctggactaagacaaatatgcctatctttactatttctgttcaacatagcactagaagtcctagccagagcaattaggcagcaaaaagaaataacgcgcatccaaattggaaaggaggaagacaaattgtctctttttacagatgatatgatcttatatagagaaaactctacagaccccactgaaaaactgttagaactaataaattcagtaaagatggagtacacaaaatcaataaaaaatagtaacatttctatatgcaatagcaaactctccaaaaaagatatgacaaagaagcccatttacaataactacaaaaaatctagaaataagtttaaacaaaaacatgaaatgtctctgcaatgaaatctacaaaataatgatgacaggaaatagaagaggacactaataaatggaaagataccctgtgatcatggactggaagaattaatattgttaaaatatctggatcagtctcttctcacactgctataaaggactgcctgagactgaataatttataaaggaaagaggtttaattgactcacagttccacatcgttggggaggcctcaggaaacttaaaatcatggcagaaggggaatcaaacacatccttcttcacatggtggcggcagaagtgctgagcaaaagggggaaaagccccttgtaaaaccttcagatctcttgagaactcacacactatcacaagaatagcatgagggtaaccgcccccatgattaaattacttcccacccatccctcctagacatatggcgattatgggaactacaattcaagaggaaattgagaggggatacagccaaaccatatcaatgtccatactgcccaaagtgatctacaaattcagtgcaatctctatcaaaatactaatgacattctctataaaaattgaagtaaaatttcaaatctttttggaaccaaaaggctgcaaatagccaaagcaatcctgagaataaagaaaaaaactggaggtatcatactacctgacattaaaatatactacaatgctaagaaattcaaatattcttaccataaagaaatgacaagtgtttgaggtgatagatatgataattatcctgatttgagcattactcaatgtacccatgtatcaaaatatcacattgtatccataaatatgtagttacatgtcaatgaaaaacaaaatacatctttaaaaaagattcacagaaacagataggcaataaacaatatttatatatggccctgaaaaactattgaattgaattttatttgttaaattgaattttaattctcttatggtattagagctcggatgtcttaatttctccttgatttctccattggaagtagatatttattttaaacctccttttaaagtaatctgtcatgagacattttaaggaactataaaagctacttattaagtcatttttataaagcaaagccaaaaccaaaaaaggaagatgacagtaatttccagaaaattattaatagccacagaaaattcaatctaaaggaaaaaataaaaacaaaaactgtaaataatacgtggcaggaaaatgagcagggagcctcacctgacttcaaatttccaggaagttgacctaagtcttactaggatggacattccatagggccttctagaagctcttgctggacttttccatttttccttatttttattttgcattctagtctcatcttgaaattagtcatgtaaatctttgatatttatgagatataccaatatgttttattatttctttgcctataactaatttctttcttttctctccttcctgcagggtttcattttatcttgctaacgatagtctctcatagttctttcagggaaagtgtgtgggtagtaaactttttttggtctttgtatatctggaaatgtcattattttattttcattctgttatttcctctgtcactattgttgctgatgagaatcaactataaatctaatagttgatcctttgtagataaggttggatctttctcatacattttaatatcttgcatatttagcttttaatttttctatgctgtgtctacatgtagatttgcttcttttttgtttttctctggacttgatgtgtcttctcaatatgagcacttttgtctttctacaatgctggaaatttttcagccattatgttattaaatattgtgttttgtcaattctctctagtatctcttttaggaattccttttatatctctgttgaatcttctcattcacttcatgtttctttttatatttcctgtgctttactactttgtgtggcatcccaattaatttcttcccaactgtcttataaatcaatctttctttagctgaatcctgtttaattttattctttctactgagtttttctatttcaattactacatttcttatagaaatgtagtattttagattcttttcaactttgtccatccttgtttcattatgtctagtttgattttaggcatatattaatttctttttttactttttgatctataatttctataaattttgagtggcaggaatatttcttcattatcttatatttccttgtttcctagaaacctgcactagcattttcacctcaactattccaatatgaattccaaatcaaaaagttcactgaaactcttcttgagctctgtattgttgtacccaatgagtaattttcattgtcacttaaaatgttctcctctcttgagccctgagaaataaaatatccacaggcaccgcttctcaatctactgtgctggatcctactttattacttgactgctaaatattatagtgtatcaaggctcaatcttaaatcctgttatctagcagattctctttataattcatattatttaaacttgtaacttttaattttatttatatgatgatgattttcaagtaaatcccactctgacccccaaagttaccattagtcattttgcaactcagcctaaacatctgatatctcattaaaatatgttaaaaatgaaacttgctttcccataatccacactgattcctttctccattatgtcatcttaataaatattattctattcatctagatgcagaagtagaactctccgtcatagctagcaattgtcttggggatttttgtctgtttacttttttcaaaaatctctctacaccagaattcagggaaaagaaataagaaaaggatatttccaatttcattttacccaatatctccactatgtagcatagtttgttttacatatttaatattcataaaaggagatgaataaataaatgaatgctgaattcggaacaaatataagcacaaggctttcattatagcattgtatcattagatcttatttatttcaacttgattaggcttccaaattctgcggatgcttagctgcaaactaaagttatttaattatcaggacagattcgctgttccttagaaagctactgtggcatcatagtttaccatgcctttggagtctctgtacaattgtccaatttcagttatatttttctcctattggtacttttcggattctggctttgctattcataagacatatgatcttgagcaaattatttagctcatctttaaaatgagtgacaaaagaacagagaatattagataatacatacaatgtgttttaaatagtgcttagtaactagaagatggtactactgctactactgctattattattactaaagtctgaacatctctaatccaaaaatctaaactccaaaatgttccaaaatccaaaacatgacaccgtaaggtgaaaattcaacacctgacacctttgctttttgctaatttagtgtacacaaactttgtttcatgtataaaattatttaaaatgctgtataaaattaccttcagtctgtatgtataaggtatatatgaaacataaattaatgttttgtttagacttgggtcctatccccatgatattacattatgtatatgcaaatattctaaaatttttaaaaagtcagaaatctcaaacatttctattcctaagaattttgtataaggcatactcaacctgtactattgttaatggagataatgttcctttctagccatttgttttcaaataagtagaagtaaataaaaaataatcacacacaaatatgtataatataaattccttatagtctataatttaattttctataacataatagtagtgtaaacataaacttgccatacatattttgcacttaagcaaagttcaagaacataaaatgttaaaattatcctaaaaaagaatgtgtaactgtatgaaacctgagctaaatcctactaaaaaaataggtataaacttcagagggagtattttgtttcttttatatctggatatgttatacaataattaggcagttaaatgttttaaatttgatctaagataggttaattgcttttcctaagttgccggtaagtagacataaatgcatcaattcacattacctttttaaaaaaccagtgataaacaaaaaactgcaattgcctacctaaaaaagtgatcctgtctccactttagcaaaggaagttgaatttctgatttctcaattttgtttgttacctaagttcaaacagcaagcactcaatatcaatctctggccattttatataaagaaatgcaaacaacaattaggtcatacagtgattgatcccctgaaggacaaatgatgtcaggcagtatttatgcaccaaaattatttcaattttgcttacttttccagcaatccaccttgatgtcaactaccatttagctgggccaataatattgatatttgatgtcagttcttattcattactgcaccaagatgatgcataagtcaaaacttttagatgtgtggtgaaaaacactaaagcaggttctgtctatccaaggaaattggaaacaacaatagaatataaaattaaggcatatgtaatctccatttttattttagaaaatatttaaattatgtcaatattcctacatattcaaaaaataattttatatctcaagcccatcctatactatgtgattttttaaactaaatattttatgaaattaactttttgccttaatactttttgtactttggaaagaaaataatttctagtaaaaagtgaaacgctttaaaaaagtaaagcaaaagaaaagcatttgtataagcagccattaaaaaaattaattagaatataaggtaactataataaattaatagaagtattctatctttatttctactttgttttggtgttagaaatctaatactgtaaatgactacagataaaaatgatacatttaagattctattgcaccacccccaaattttaacctccaatcactcctatagtcaaatggagttcatttcatacatttgtcattttgttgatgggtctatgaaaattgaaagcaacataattatgtcatatttcttgacatttcctctttgaccaaaaaaaatcaatcgtttgttttctatatatgtatctttggataactttaaaaccttttggcatatatgaaaacagttcagtagtgaaatttctacttagcaaccctttacatcaactgtgtcctggcactaatctaaatagtgagagttcagcaatgaaaaataccaagtcctgtcctcaggaaccttatattctcttaataatcagagacaataaaccagtaaataagtgaataatctcaggaatatgaagtgctacctatcaagaatcaatcaggtagaaaacagcaataaggtgagagttggggcttaaaatgcaatgatcagagagagattctctgagagaataaagaaatcctaaaagttctgaaggaagataactcaagcataggcaataagagaggccaagttcctgaagtggtgacaacatggtcccgtggaggaatagcaaaatcgggacacatagagtgaactaggaatagattaaacaggtggaatatcttgaatcatatagataactgattggtaatgtcacctatacaaagataacccagctatgagaagtttgtaatggatttttttatgtgactaataccttaagtttttttaaccctagaattcttagcataattctcagtatagaagcactaatcaataaatattcattgactaggaagtgtcagaaagtcactgtaggtcagaactgaagggatatttaagaggacataggaccatgtttgctgtgacacaacaaaatttattttctatcattgattttaaattttattttgaaatttaatatactttgcagactccccatgattgttttgagcatatgactgccaaaactagttcaaaatattttatttttttataagaaataatgtcactgatcaggatatttgaccactcagacaactggtcttccaatacagtaaaatctcatttaaacaggtttcacagtacgaaattgttctaagtaacgtgaaaatatcaacataaaatgatacactcctctctaattaggatttattatagccagtcttaatttgcatgtgatttaaaaagtataaaaaactacatgtatgataaacagcatgaatttttaagattgttttacataacagggataatgtctaatgcatgaaacattgtttttgaagcacataattagagcaaaaataattgtcacaccaatttactcataagcacaattacaagaaaacttgattatcccctttaatgtaattttccccacttaattgtatgttggtggatgaatgtgaccctgtgagtccatacttgaagaagtgactgttagttaacatgcaaaaccacgggcagaacaagagagtctgccctttctctggaagagatttaatttgtataccaagtggctctgcagggaaactgttttaaaaggtacatcttccagcaggatgggctggaatttcctggagcacctttcaccttgcccttgggctgtcatgtgcatcatcaccttgctctgccatttactcaatagctagacctaaacactcaacagttttctaactaaaggaatttaatctgctacctagattgcattcagaaacctaaattcattgaatttttttctgaaaccattcaagtttttatatatgttttctttttttttaagatttagcaaatattccctgacttgttatttgggtggttgtgaagtgaaagaaccttttgtttctaactttaatacctggttgcatttagatcccttattccacctgagctggagaaagttaggaccacagagaatcttaagtatacactctgtttctttttcatgaggcttgatactggaattggctgcagtcatttaaaatgttctctttttagtctgagggatagaatttttttctaaggaatagctggttttcaatttttacagactgaaatacaaagttatgaaataaatcaagtcattacattatgaattgcttttctatcatgttatgttttgtatacctaaaatggtaaaaacagacttttttggatgtgtgaggttgtaacttcgccctctccagggtattatggatacaattccatatcttcaaagaaatatgattgttttactagtgaaaaaaaatgtagaatttctaagaaaaaataaggctagcaaacagaaggacagtctgttagaaataattcttaaaaaggctctacattttagttaaatatatatagctccaccctgtaatctgtttttataaatcaaattatagattttggatattttatcaagtcacttcaatatgaagtacaggaagaaagatatggcacctttcctcacccatcttaaggatcatagccaaaagtcctgtaacaaaagacaggtttacaagggaaaagtataacaaatgtatttaatcagggttttacttgacatgggagccttcaggaatgaaaacttaaaagacccggggaaaattgtctattttgatgcttagatttaatgaagaatggacaatcacgtagaaatgtgattgggcaaaagaatataatctaatggtaatagaccgagggaagaaatccagtaaggcctgactttcttttccttccttctttccttccttccttccttccttccttccttccttccttccttccttccttccttccttcctttttttttttttttttttttttggcgtttctgtatagcatttctttcacctggcaatggggcaggtcccacctcgaatcacgtcttcaaaatagaagagatggagtgagcttgctaggctttacggagaagggagaagggagaagggatggattgagcttcctaggttttatggctttctttgggggagagaagtttccgtttctatgactcgccttagggaagaggagttctggtttctatgactcattcatgggagaaggagggtcggaagacaggaaggtggagaaggtcagaggcccttccaatttccttcatttcaaagtattcagcacaccaaggagccatacttcagggtgtcgtgttctgagctccaacagtggcaacagccaggcctggtttatggtcatcaacatgaatcttggtattgtaaacattatgatgacacaaccctattcatatattatcaactttatgtatataatggaacttctctgaatttatgtgactgtacttatgcacatattaagagaaaataaatccattgcaggttatcccagcaatgttattgcagtgagcactatattaatcaataataattagctactttaaaagactcttgccaaattgaggaacaccttaggttactatcacaataaataaacagatcttacagattgtgtatctacatcatgtaatatcttctgcaatgatcaaacagcaaaagtacattgttgttaacaatagtaattaacacattgctctcatctttgctagatgatttgttttatttctctatggtgtataaaacatacatatatatttttaaaaggattatccccaagtacttaagaaatgattattttgaaattactagaaatctgaagttgtaaattttttgtagtaagttctctgtaagtgtttgtgaaactgaattcagtagataaaaatattttttcccacaagggaaaagaaatagatttgatggaattttgcagtttgccactatgtcagctgctaatatggacattcaggattccaaatccctctttgacctctaatcactgctgcagaaatctagtgcttctctaattgtcaatccctgccctctgcctttcatatcttggagaatataaaaggactgacttcctccctggataaaggacaacagattaatgaaattaagtgtctgcctcattaaaattgtcatccctggtttactatttcaagtgcagtatcaactgtggctagcttttactcttcagggggtccagtgatgttcagtttcttatgtaaatttatgcaaaaactactccaacaatatcacatgctgttcctttcaaaccccaaaaggaatgctgtgtttctttatctggtagatggaaagagcagagtgggagtgagctgagttacaggttaacaaacagaatactggtctatccaaggaggaggagagtttggaaggaaaacacaatatttattttcaattgtgttaaatcaaagattcacctgtatgtatttcatttttatctgtaaatatttccaaaatgtaaatttacatggcaatgcattttattttgtttaggaggattacaaattagccaggatgattccatagctcatgaagatctagaatcatgtcttacccttttccctactgcatcagtcctgtcctcttcctcaccacacaccctcacccggcactaggccattctggcagggaaagcttgtctgggtgatacttaatgaatgactaatcatgttttcaaaactctttataaaagaagtttcatcatcttaaagtatgtacaaatttctttggtcagtttgttataacaaaataaaaagtagaccagtggtgagatagaaacagactgttctagaaaaaagggtgggttagagcagcttgattaaatgtattaaaaagtggtagaatttagtatttggcaaattgatattttaaagcacttaaatgtcctttaattctcaagttgaatcacccatcatcatgggttgttttaggaagtaaaattatcagtgtaggcttcattcaaatgtaaataactatggcataagtgcctcatttaaaaatagttgttcagaagaaaataagctgacgggcagggggaaaacctctcaagttataatcatttcaggaaagtacatcctgtgtatatgtctatctgtgtgtatgtgaattgcccagttgggtggccacattaattgtgcatatgtgtcatattatgattgctttaagattggttgggagagttattggcatgttttagttaaatcttatatttctcagtttaattgagaaagcaacaagagagattttaaaactctaagctctactcaaggcttttcattgtctggttatgctcactagtgagccacaaccttctccactgtcccctaacccttcttatatttaccctcaactttggccagttccaagattgctgtgccaaaatcaattaatatgcatccaaattgaatgaaaacactccaaagaaatatctttaatctgatttacatatgaatttattcctgtcttcttatctaacggatttcaattcaaccagatttagtttcagatcccaactatcacttaccagttgtgtgaattagaagtagcctaaattttctcatatgtaatatggtgatattacctagtgcctcataaattcatcaagtttaccttgttggatgctagatattttgtatttttacaaatagtcttgaactttgttctggaatgctgtcaagttacttagaaactggttagtacttccagatttgttaggtgggaaagaagcagtgctcaaactagggctaattacttccccgctactaaagcggggaagtaccccttctttgtcttctaatctacccagtgacctcaaatcttgaaatttttcattctgtctgttagggcagtcctcactttcccagtgtaatctgaacatcttttcgtgttccctctaatcatttcaggtagttcttcctaggcccctaagtaatttcctcacagtcatatgccaatcattactgagctaaatactagaggaggtttctctgcagatctccagggttttctctgtgcaactctcacctcacctcttctgtacactctgcctcgcaaattctacctgccttggcatccctggaccctcagcttcgtttctttaattagggagtctgctgtgctttgtttcagttccctgtccttgtgttatgggatagaaatcgtcaaggtagtatgtcaacgtagtcttctctggctgacttcattcgttttcatctcttgatgattattgccctttgttacctaatatgcagtgtcttgtaaaccattgttttctatattttgtccaggtttttggttgtttcaggcaggaggatatacctgatccctttgactccattgtgactggaagtcttttttagcatctgtttttaagtgtcaacagatttcaccagaagatatgcaattgtaataataatagcattatttttaacatttatagttagcccttcctcctatacaaaataaaagttggcagtatgtttgaagaagaccttaattatagttctgcttggaccatgaatttcatgcgaaggcttagacaaatcccttaatttctcaagactttacttttctattccatggaatactttgatctggacaacttttatattatctttcagaaatatattgataatcactaacattttccttttgaaattgagaaaaactatagactatgaatgcatgacttataaggctttttagagaagcaaggatttattttcaacacctggtttttctgaactctgaaagattctttgtgactcaatacttaccggtattaacaaaaaaccatgagatctgtagaggagaaaagaagagctttattttcttaacaataatctcaaattggggaggcatagcctacaatacaagtgagcgtgccttccaatgaacaaagtgggggtctggcttcaatagagaaaattctcaccccagttctcaaccaaatccatttatgcaaatgaagcattcaaacttattcagttctgattggttgaaatagataagccctgattggcaagcttccaagccccaaactggaagtctctagcagccggtgtgagagtttgagggtcgtggccacagtttatcttgacaacaacagaaactggtttggattaatcacagaaagggaggttttgtgacacttttacaacacctttctgagaacatggagtactttctgagaacacagctccctcacttggctgtggccacctggttctgtattaactttgagaacctcagtcagccatgaagacttcattttgtctgttggccagaggcatgctttaacactagcaaacaccacagcaaacctgagatctttcttctgacatacagagtgatgccaaactgtaaaaatttaacaccactcgctcttcagatgtggagtagtaagcttcaatttttacttcatatctctttggttttatttcttcatattccagaaaccctactgccctgctttgacattacagtatgttactatgtaaatatatcaaaagatattgctgcaatgtgacaagtcacatcggcagaaaacaccaagggcctataagacaaagatctcatacatgaatatctgaaataatgccaataatgacactgaaaatgaagtaaactcacatgagagtcagaacatttttttagtgcttttagaagaggctcactgccagagggagaatgcatcaatttcatatgccatgtaaggaacttccatttctccttgaataaaacgttagtttcaaaaattgtctttagagtagaaagactctctgtgatttattaaaccttcttctccccttcaccttcagaaatccactaattttgcatcgtatttggcagccaggaagttgggccagtctatattcaattccttcaggactgtgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatcatgccactgtactccaacctgggtgacagagcaagaccctaactcaaaattaaaaaaaaaaaaaaaatcaaactctatccacaaagtaggtaactatttgtttgtataaggtaacatgttataagtgccaaaagtggctaactaaaagtcagtggagaaaacttatatttacacaaaaacctccacatagagtagctttattcataactgtgaaaacttggaagcaaccaaaatgtcctccagtaggtgaattgatagagaaagtatggtacatccagacaatggaatgttactcgggacttaaaaaaaaaatgaactattaagccatgaaaagagatggcataaacttaaatgcacattactaagtgaaatagccactctaaaatggctacatactgtatgactccaactatgtgacattctggaaaaggcaaaactgtagaaacagtaaaaagatcagtggttgccaggggctggagggagggagggatgaatagacagggcatagacaatttttagggtggtgaaaatactcttataatgatggttacacttgtctaaacccatagaacgtacaccaccaagagtgaaccctaatgtaaactgtgagctttggatgatgaagatgtgctaatgtaggttcaccaattgtaacaagtgtaccactctggtggcagatattgctagtgtgagatgctatgcatgtgtaggggagacaggacatatgagaaatcttcatactttcctcttaattttgctcagaacctaaacctgctctaaaaaaaataaagactttaaaaataatcagtgggtatatcgggtataattcttgaaagagttctattgcaaatatgagaagttttgctttgactttccaggtatggaaataatgattcattcattcatttgttcaaatatttactaagtatataatataaacccaaaactgaatgtgtaaatgatctggaacagtactgtccaatagaactttctgtaataaaaagatgatttttaatctaaaatgtccaatgtgataggtgctagctacatgaggagatttttaactaattaaaaataagtaaaactgaaacttcagttcctcagttgctgtagttacatttaaagtactcagtagccacatgtattaaacaatggtctagaatgaaaagacgggcatgtatataagagattgcagttttgtaacatgaatttatggaagcaacagaaggaatacattgtgtcacttagaggactttagaagaagttgtgttggagccaagttttaagaatggttgatatttaccagaaaaataaataaggaatgagtatcccagtcagtggaaactaagaagaaaagcatgaggacttggtgcatttgaggaatagccaatagagtaacatatggggaaatttaaggaagatgataggcaggaaggaggcaggtcaaatttacatttgagagtctcaaatttgcatttaaaaatgactgtcatggctgggcctatgccttgtaatcctagcactttgggaggcctaggcgggcggatcacctgaggtcgcgagttcgagaccagcctgaccaacatggagaaaccccgtctctactaaaaatacaaaattagccaggcgtggtggcagacgcctgtaatcccagctactggggaggctgaggcaggagaatcacttgaacctgggaggcggatgttgcagtgaactgagatcgtgccactgcactccagcctgggcaacaagagtgaaactccatctcaaataaaataaaataaaaaaaataaataaataataataaaaaaaaaacctaccattagcatagagcaaggtttggcaatactgattttatggactggtaattccctgttggaggtgggggctatttcgtgcattataagacttttatcagcatccctggcctccatcaactgaattccaggggcactttctagttgcgaaatcaaagatgtctctggacattgccagaagtcctctgggaagaaaaaatcacctctatttgagaaactttgctgtaaaaatggccttccaaggctgggtgtggtggcttacgcctgtgcactttgggaggtcgaggaaggcagatcacttaaggtcaggagttcgagaccagcctggccaacgtgacgaaaattctctactaaaaaatacaaaaattatccaggcgtgatgatgcatgcctgtaatcccagctactccggagcctgaggcaggagaatcacttgaatctggtaggtggaggttgcagtgagctgagatcacaccactgcactccagtctgggttacagagcgagactccatctcaaaaataataataaaataaaataaataataaaatggcctgcaaagatagagggttgaagtgaggaagttcactgcatgtgtcccagtgtgagttgatgacaggctaaaataagggatttttggaggcaaatttcaactgaatagaattggaaaggaaagagatggagaatgggataaaaagctctggtgattgcctggagtttggatccttttgttgaaatggaaagtgcagcagaaggctcaagttgaggaaaagattaatttggctttgaacaggatgacattgaggtacgtggggaacttccaagtgagaaatgctatcagtagttggaaataaagacctggaatttaagagagagttgtgaattggagatgtagattcaagagtcataaacatcttaatattagttgaaatcatgggaatactcctttgtgcttccagcagtctggacttaatgacgactcatagtttctgactgatctccaaatccacgctttttgaatcaattcaacacatagcacctgttctttcctgatttcatatatgaaaagactttgaagtctacactggcctatttactgttagcgcttctgcctcagggcccttgatcttgctcttccctcttcctgaatcactcttcattctcacagcacaacttggccccacaaatccattaggtcttaattcaaaggtcacacattcctagtcttgacaggctatttgtatttcaacaccctgtctgccaaacattccttgtctacatttttaaaaattctccatagcttttaacatttaacataccacatattttactgatttatttaatttattgtatgtttctttacagaagcatgcccgttccgtgaggcttgtccaccacctaaaatcggcacaggctccataaatatttgtttgatgaatgaagagataggttttctatagaatgaggcaaatttgcccgaattcagtcaacctcttacttataacaaacttgagtaccacaagaaagcaatcttcacttgtttttcaggatctcagagacacagtcttgcactagataataccttcttaacttactgagactagtggccttcaacattccctttaacgtatcgatatttatgtacaaaacacataagaactttttttacatcatatgtaaaatttacattcctcagtgtgagctccagaaactttggaatttttacacattgttaacctcatcattaattcaccacattccccatggagtagtatgttaatttctgctttgtgctctgacattgtgccgttttcgataaaaatgacaccttcctgccttctcttccctattatttgtccataatcttcatctatctaaaacattacatttccagaaagctgtattcacctgatgaatttatcctagtgttccgctcctagaagatactttcttagattctacagtcttgaattaggtgatcaatttgtattctaaacaatacctacttctagcatttaactcttctattgtaattgcctagttactcctctctctgacaatcaaccagaagcttgttgaggtcatatattaattgtttttcttcctcttggtccaagccagggtcacagtagagttcagtaaatattagttgctttatatacattgtctttatttctagttactcttctgccttgtcaatttaaacacctgcttgcttgatttgttctttgttaatacatgtggtacttgttgacatgctcctaaagctctgttagctgttttggtgtgttttaccccaataacaaagtatgcatgtttatgcatctaagtggtttcatgggtcccggagttcggatgtctgacccctccaaatctcatgttgaaatttaatttccagtgtaatggtgttggaaggtgggacctagtaagaggtgtttgggtcatgggagcaaatctctcatgaatagattaatgccttccctgagggaggggatgagtgagtttctactcttatttcccacaagagctggttgttaaaaataacctggaacttcctctatctctctctctctctgtctctctgtctctctctctctctctctctctctcactcttgcttttctctcttgccatgtgatctctgcacacactggctccccttgccttctgccatgaaaagaagcagcctgaagccctcaccagaagcagatactggcgccatgcttctatagtctgccgactgcaggaatatcggaggctgggcaatttataaagaaaagagctttgggtggctcacagttctgcatgttatacaagaagtatggtgctgtcatctgcttttggttagggtttcagggagcctccactcatggcagaagaggaaggggagctgacaggtagagaaggggagtgtagctgtcacatggtgagagagaggaagagagagggggtagtgccaggctggttttaacaagcagctctcacagaaactagtagagtgagaactcactcactacaagaatgataacaaaccattcatgagtgagccacacctatgactcaaaaatctctcaccatgccctactctaacactggggatcatatttcaacatgagacttagtggggccacactaaccatatccaaaccatagcatcaggttttcaattccgagcctgtgttttgctaaccaaatgactctgggcaagtttaataacttaaaccttggttgtctcatttgtaatattgagcagtaccagtacctaaccataaagatgtagaattaaatgagatagtacatataaatcactttgtacaagttattgtaatgatgtagtgctgtgttgtgtactttagctgctcggtaattatttttgagatttccagctcatatccatggagcatgattggtgatatggtagttgttaatgcctaacagactgatgatggcataggaaagaagtatacacccaaaattacaaacttatccacatctttccagtgctctatatttcctccttctttatacttgaactttctaagcattcccaaatcttaccttctctttccgttctaattccataatttatttgctttatttgtgccattagagtattgaggaaatggtgtaatgagctattgcttaatgctgcataggcctgtcctaagagacatgctaatgtatcagtactaaaaatgtttgaaatactaattttcctcctaatgagcctaaacattttattatagttataccttaataccaagttgcaggtcattaccttcacatattgaaggcagctgatgtttcccggacttaatgtctctgccatttgcttgatgacccctcttacttgcccattttgcatagcagaattttagaaaataaaaattagatcacttgacaggtactgtgtgtgatgttttgatttcattatttctttattcaaaaatatttttctgatgataaaaattaatgtatgataatttcatgaaatctaactttttaaattgaaaagaacaaataaaattaatgtgcattggcttactacctgaagataaccatttctgatttattttcaatatatgctttgtgtatacatacaacatagacaattttgcatgctgctattttcattgaactacatattttttcgtcattaataatcttcggcaatgccattataatagtttagttatatatttatatatgttatctaatgacatatatatttggaaatgccaaaatatagtttagctatataattatacatgttatagttttatatatttgtgtatatatgtatgtgttatctattgatgattttttaggtttctacagttttagcttgtaaataatagtgtgaggaacatctatgtgacaaatttgtatcttattgactatttaatgtatcctgatggggaaatattttctatatttttaaacttttgtgatatactctagtagttttgagaaaataaaatgtaatacagtggataaaatcttggactctgcagttaaccatacatgggcttgaatccacactccaaatcattctaactaggtaattttagggaagtgactttatctctttaagcattattttcctcatttgtaaaatacaattgttgcacataaaaaataatcctataaatattgagcatatgtcatggcaaaaactgttaattttagttgtcaattactacatccaccagtaatacaaatctgattgtattgcagttttatcaacatcaatgctgtcattaaaaatctattctaatttgatagaaaaaaaggacatgttaattaaaaaaccccaaatcaaactaatttaagcaaaattagggtgttcattggctctatagaggagggaaagatcactcccactgcctttttattcttttctgggctctttggctggtccaggaactgaactgatataacagatgaacaggagaaaagcacacaagttttattaattttacatttacatgaggattttcatcagagagcaaagtccaaaggaatggccaaaggaaaatgcttttatattttttagacaaaaaatataaatttgtaaagaaattacacaacaaggggacctggctagggtagtaagttctaggggagatactgggagatacatgagaggtggaaagctagtggaagataagggttatttgggggagattatttattcaggcctatttcaaggctaagtcccagtatctggtgataagaattcttctcacgccctggtactgggaaagcaccccttgcaaaagaatatttaaagcctgctgcatgcaagaaaagacaattcagccattctttttctgaaactataatttctccaatgtttttatctcaaaatagtcaatataccaatttggcatatttgaggaccatacatcctttacttcttcagctcacaaacctagacttcagactgagcagttggcaactggcatttagatttagcaggaaccaaaactcaaataccacctgacttcctgaatggtcttactcttattagtttctttattgtactagacctgagcatcagaaggaagattacacatgtatatgcatattacacattttctgaaaccttttattcagagaggaaatagcttatctctctcacattagtttggaaaatacagggaggtaatcttattgctcctacctgagccagattcctaccccttaaataatgactccatccagggagatgaatttctatgaggacaccagctacagtgtaggaaatgagaggcagttcttcaaaaaaagtgagatagcaaacctatgactgctagagtgatcttgggctgggtaaccaagctaagtggatctactccaaataaaacactgtttgaatttatttcactcaactatagtcctagggtcagtgaaaaggttttcaggtgtttaatcattctttcttctgtctaggtctcatttcaagagcaatatttgtattgtcttagtggttttcctctttatttcttgtatttctttttgttatatttaagacaattttttcaaagtttattgccagttgacttttaaatttattttgttctggaaatgccattttgctgaagaattaacagtgaacattaagtccttcagagcatttggtgtggtttctttaatctctaccatatttttaattatccccttttccctgttgttgcttaattatgacttttttctttgtgattatttttgtctgtttttgacaaacctttcaatttgtctgtctacacttttcaaagagcggcttttgattttgttgatgttatctcttattattttaataactttaattttgcttctcattcatcatatattaattatttctaccttttctattctgtagaaaagagcgtcttcaatttaattctaatatatttattttaaatttcgctttaaaaaatgcatctgaaattacaaatttttattaataatggcttcagcttccttcaacaaatataatatgaattccttcatttggattaattctgagcactgaactctgagcttttcttcctgctcaaattcctttctaatggcctgggtaaagtcaagcctacacgccttaacatcttgttaaatagggcttttttgaggcctgtttgaagcccagtatactgtggcttactttccaacctgactctagcatagcgtcacatgacagataacagaccctttatcttaacctaagcatttgtttttactgagtccaactatttagacaaagcttaactctttcaaccaattgctaactaaaaaatcccaaaacccacctatgacttataaggctctacttgaagatgtcctgccatcttgggccaaaccaatatgtatctcccatgtactggtttattatattacctgaaattcctgtctccctgaaatgtataaaaccaaactgtaacctgatcgcctcaggcacacttttacaagatttctgagactgtatttccccagcatgtggttactctcatgggctcagaataaatctctttaaatattttggcagagtttcctttttctctctcttttttttttgttttgtttgtcaccagttccaaacttgtaatttattttgtgtttttttcttttagcttccaaacttttttttaaacctttggtgtaatttttagtttctaatttaattgcatcatcgtcataaaatgtggcctttataacacttctttgtcatttcttgaaacttattttgtggcttatcacatacttcacatatatttgatgatactatatatttggcaaatactgttttccattttagatcaagctttattttttgaaggggtggtaaaatgttgtatatctttccttttttgcattatctatcattctgatggacttgtattacaatcttccccattatttgggaaaataatttatttttatactcatgataacttttaaaatattttaaaacgtcatttgtctttacatataaatttattagttataccttgtggctagagtattccctttattattctttagtaatagactctagtaatttcttttctgtaattatttttttctgacactgatactattctacaagcttcttaggaattagcatttaatgattttattcctttattttcactcttgaatattttgggaattttgttattgtttctgcttgtttttaatgtttctcttgtaaattgcacatagttgtattctttattatttaaactattttagttgtttcttacttttaattgttaagtatatcccattggtgggggggggggggtggggggtggggggatgtgacagagagagagatatatatttctgtattggtattgccataacaataacttgtattttctgctaatcttgttttatttgcttctttttaacttatttcctgaattttgcttaagataagatttagattaggttagggttagaattagagttagggtttggattcagcattttgtctttgattttaactaaatcaactttgattaaaaattactgaatttttgcctgggcacggtggctcatgcccgtaatcccagcactttgggaggccaaggtaggtggatcacaaggccaggagatcaagaccatccttgccaacatggtgaaactccgtctctactaaaaatacaaaaattagccaggcacggtggcatgtgcctgtaatcccagctactcaggaggctgaggcaggagaatcacctgaacccaggaggcagaggttgcaatgagcccagatcaggccactgcactccagcccgggtgacagagtgagactcggcctcaaaaaaaaaaaaaccaaaaaaattactgattttttaaatatttgtgctcaccattatatattttgaccaatgctatacttaggattttactttttcatggtgaaatacaaacattaatacttctttccataagatatttaaacatttgtattcattaaatgaaaatgcattcaatccaaagtgatatttaactaaagcatagaattttaggttgaggttttttcccccggtacaatgaggacattatcccactggttctaatatctacttaaaaaattaattgaaatgtctttaaaatattttaaataggtaatctgtcatttttcacttgtaggtaaatatctcttcgtccataatatcccacatttttcattacactctgtttaggtgcagttttatttttatgcattatactcaatatttggagcgcaattttagtcttgatattatatttttcttcaattctggcaaagtttcagccattacacctttggatactgctgttctgactgtctttacattatcttcttttggaatgcttataaaacatatattggaatatgtaactccacccccaccctcaagtctcttaatggtttacatgcttttatctttcaatctctgtgtctacaatctagctaaattttccagattgtgatattccaatccactcactttcttttcaactttgtctagaatagagtacatcctatctatagagccctatttcttcaatgactaacattttaattctcttggatttctcaagtcattttagattgtgtttgtttcatttcttttttatttaatgagtaatagctctttattcaaatctttgagactcacactttcaaatctttgagactcacactttaaaatctttttcagtctttcataattttaatctatacagatcacttttatcttccaattattgactatattagctttagatctccttgcatgttatggaaaatttttggtagcttcttttgagtaagtaaaaggtctgatcatctcttttaactccctttatttcttttcctctttctttgtgcttacccttccataactttcagtattgtaactatctcctttgccccaggtctcccaggcccctagttccagggtgacctaggataggctttacgtttaatgtagatgaaatctgccctctggttttgaaaccacagatccagtcactgagtgtgctacttggtaaaggtccaggtggcaagactgtgtgttaactccagagtccttaaatgtatagattaacaaaaattgtagcttcaaacaacattagccggcaacttttgtcagcttcattttgtcaggaaatcttaccccagccatggttttagcagtaagttgatgtttatcttccatctgacacaaagctcttttagtctctttattattccacacaagctgaatgaccagtctgcttccaaacccaaaacccagagcctatgttttcatccctattctctattttgtgtttctgttctgtttttacttagtgcatagtatgcctgtcatcctgtcctcaaactcttcaaggcctcatacttttaaaaatcgttttttagcctcactctgtctttgagacatggtacagcttagtgactctaaagccacatggccttaaatcctggccatttcttttttaactgtgtgaactgtaggcaacttaattaagctttctgtggctcaatttcctcattcataaaatggaggtgatcacctattccatcatagttttgggtttttttttttttttttttttggtttcctgatatatgtatatatctgtatacaaatgcttggaaccctgagtgacacatagtaattacccaattagtgttagctattactagtttttaattgtctcatttcataggtattttttaagaccatcttgaccagggtccttccataaattatttaattcttctagaatatatttagttttatattatgaggtagaatcacagtttgactcatcatatagttgtgagagtcagctgtgacattatttacaggtatgttataagtgataaagaattatgcaaatgtacgattttgtgtcttatgatcacaaaaacatttttttctgagttttagctcatttaaatttctatatttgtgaaaaaattcttttaaattacatacaatcaacattgattactttctactttctttatatttattcattcaattagtgatttaaaatcaaatacctaacatgtagcaggaactgtgctgggtgctagagattcagtgttacagaaagagctccagacctaaatggaaacttctttgagagctttccatgcaaacacatttagtaccttcccattctcagtttcagtacttgtaccagtgacatattttaaagtctcatgagactgggcacagtagctcatgcttataatcccagcacttcggcaggtcaaggtgggaggatcacatgaggccacaggtttgagaccagcctgagcaacatagcaagaccctgtctataaaaaaaatttaaaaattagctgggggtgttgacaaacacctgtagtttcaactacttgggaggctgacgtggaaggatcacctgagcccaggagtttgagattacaatattgaactgcagtccaccctgggcaacagaacaagatcctatctcaaaaataagatttaaaagtaaagtaaaataaaatgaattaaaagctcatgaaataaatagtaatatgtttggcaatgatatttgaataatatataactgttatctttgaggagtttaattatttgtagttattcacatttaaagtattaaaggattataaaaatacacaaaagctttaataaatgacgtaactccccatttaatcattgtacatgtgtattatatactttaatgtaaccacagtttggcataaatttttccatgttttacattggttctataattgttgttttaatggctttataattatttatctaagatattcatatagtcattctacaattatctattgaacatgaactatattttattctaggtcactagaatgtactgctaaacaaacaaaacaaagttccttcacttagtgtttacaacattctcatgtatacatagttgatgtaaaatcattcatttaatttttctagtatgcagtataactctttgacaacagaatattatatatattctattgttcagccttcaggaatcactgaagaaaggaaacaatgtcctgggcctaaaatgcttttattgttcagtaaattgactttccaaaagaaaaaggtatttatatatataacatacgtgtatatgaaacccagcaagttgaaccaagaaactacttagctgactcatcaggttgaaggttcaaactacaatcaaattggacctgagtcttccaaaataggttaatatcctatttcttttagagatgcaatataaagacatagggactttcatagaaaaaattatgttactatataatatttcttaacctgagcactagccccgtaatcctaaaagttaggataatgcccaagtttgaaatatttgttttaaaaaattatacaatgccataagatatgtttatattaaggaatactattggtttataaaatagtattttaattatttatttaaattattaatgacctcattaacattccagttttctccttttctttcttagttttaccatatataaatacatttggaacctctgtgcagagagatagtagttcagtctgcttgtctctctgcatctgttgataacaagtttacataacagttgcctcaagcagttttctgaacccaccacagcccaaggtttacttcttccatattagattattattgcaaatttcacttgtttccattttgtatttataaataatgctacattggttttttcataatacatttttctttaatttataataaagttcagaagtaatagtaaaagtttcagaagtttggacatttttgtgatacttgatacctattgctaaatttttctcttataaattctcagcagcctagatgaagctagattgatcttatgttattctactctctaatttattattaacttcatgtctatatggttttctcattataggatctttaatttggtggtgggaggcttaacagaggcaatcaggagtggtgactattcattttcatctcagctgtaccctttgtccacttggctaaattctactggcataattaaattcatttgagtcttatgaccacaaagcatttttttgggcttcggctcagttaatatttctatatttttgaaacaaattattttaaatcacatagagtcaacgttgattactcttcattccctttgtattcattcattcattcaattgtttattcaaagaccaaatgtctaacacgtagtaagaactatactggatgctggagatgcagtgttacaaaaacaatcatagctctcaatctgagctttctgcacatccaccttcagtagcttcccatcctcaggatcagtactactaccaatgataaccagaattgcattttagagatttccaaacctcttgagtcttgactttcattaagattgtcatgaaatctcacctatctttaaaaacattttctttgaaatatttcttaatttacgttaaatgccttaaactatagcttgactgtcataaattgtaggtaaaatgacttttccctaggttgtcaactaatctccttcccacatctctccatctccacatccctcaaaactcaaactacacagtttggattaacaacattctagtttattctgtctcgaggaaggagattggcagatggccctccaattttcctgaaatgggagaaagaagaaggatacagggcattagaatattctaagtattgattctggattctctgcctcttccattgctttctgtcttgtaagtgattcagacctatcagggttggaattaatattcacctgcaaaactgctttggaaggacttggaccaaaataaaacttttaggtaacctttgtggaagcattactcatctatcagcttaacaaatacttggttgagctctgctatgctccaaacactgtaatagacactgcatctgcctcactagctaactggatatatagttaagctgttcttccgttaccaagtatctttcagttctcaaatctaaatgcaaacttatttctattacttaaaatattaccatatttggctgggcgcagtggctcatacctgtaatcccagcactttgggaggccaaggtgggcagatcatgaggtcaggagatcaagaccatcctggctaacacagtgaaaccccgtctctactaaaaatacaaaaaattagccgggtgtggtggcaggcatctgtgtagtcccagctactcacgaggctgaggcaggagaatggcgttaacccgggagacggacattgcagtgagccaagattgtgccattgcactccagcttgggtgacagagcgagactccatctcaaaaaaaaaaaaaaaattttcatattcattttaccataatgcatactttgtcatggcttttaagtttctaaggcaatggaaaaagtctagctaaaggatgttagttattcaaaattgcttgaagttgctatgtactagtttattaatgaagcatttagcacagtacctggctcattaaaagcatttcataaatattgactcactttcatattatcaaactattgcacttgatcatttgacagcaatagaagtttcaagtattaaatgtaaaaatattaaaactatttacctactcattttcacacaataacaatgatgaaactattttttattttaagtatacttcctcaaattttaatattcaatgggataaagtatacttcaagattttctttaatccatagactccagacaatgaaagaacatcaagtccatccacctgcctgtggcaagaggtgcatccagattaaattccgataaaaacttacctactctgttcccaaaattgaaaaaaatttccattctgtgacttctctcagatcattgaaagcccttatatttggaaagaattctttctaatttctaacattaatattccttgccgatactgagaactgttctttccttttctgaaatgaaattcactgattcctcacaattcttataatacatgtttacatatttgagggcattccaagttctccatgttccttttaagtcataaaaaagattaagcatctcatttattagattggggacaaggctgttgtattactgtgccagtgacaacagttatagaattttaaaactaattgcattcattgcattactggtgtgtttagagaaaaacaatgagtccacttgaactgtaatacaggatgtactatttttacagaaagaatagaaatcaaggagtaagtgagaaaatatgtgagctagttcaaaatgataaggaaaattataggataattaaggtattaacattaacattttaaataacgtagggagaaaatgagaggatagtttttaagttgacattaaaaaatttgaactgcagctgaaagggaaactgtacatcaaatgggaaacagtatattgatgttttataaacataattgatgattttaatgtggccaatactcattcaatttgtgagtggacaaagaaattaaatgaccagaatgatgagaatgagtgaagactatgagttgctggggagcagaaacccctcttattcaccagcatatctccaatttctgtcacaaagtagatgctcaataaacatttcctgagagaccagcaggaggcgtgtagacagaccctgggctccaaactgaactgatgagcctgggccactgctactatgctgcaaaactatctctccccaccttccattgccatgtcacttgaatccattcacccttccttctgttttccttcccctttatccaattaccttcttccttgttccactacatgttaccaaagcaagcccaactatgttttctgagaattttgactaacagactacaataggcaccatttcattgccatcaacttcacctggtccctgtcattctacctgctatgcgatattcttctctcactgtgtccattttacttcctacctctttttgttttttctctatttgaggtataaattatcaatgctaactaactgtgagcataaaagctgagatatgcatgtggtataattttcccacattcacagtttttatgtgtcacatatatcatatgcattatatgatatatgtatatatatgcaaattatgagtgtacatgtttttgttttgttacatcttctaatgtagttaaaatgaaaatgcttgtctgaaacgttaactccaaaaatttagtgtaggattttatatattaagaatatcattttaataattttatgtccaaaataaagttattaacaactatttcttagtttagaggaatgtaatcttatggctgtaataaaactgtaacacttaccttttgtctataggttactatatgtatttgtatatatgtagtgtgtgtgtgtatatatatatgtgtgtgtgtgtgtatatatatatatatatatacatacatacacattttatttttgtttatcttatattttgaagggtcacatgatagcatcctgtgatgcctgtggggttacaaagctgtgggactttcggaagctgttaccaattgtgtccatcgatataggtccaagtcctggcaatgaggtgaattttgattcatcaggtaggatcatttttgtctaatgtttctgactaagccaataacattaatatttgttctgaaactattttgtttctccttaaatgtatgtatttctacgtaaatgtctgttcttaatattacattatattacattacattaagatatattttatcattacgtatagcatgtcatatgaaagaattatattcatatatttaaagtcagaaataatataggtgataatgtgtactaatctagatagcataggtttgttagcagtgccatgcaaaatattcaaacctccattcctcagaatcatcatccaaggtaagcaaattcgattttctaaaggcaaaatagctaacagtagagaagaacaaaagtttagcaaaaatgaacctgaaatatttttagtgtaataatttaatgttaaaaatttaatgaattaccccatattgtgtagagtttacaactaatttgagataaacatttatcttattgttgcaattatgtgctgtgcattctataatgttattatatttagtttttattccacaatgatataagtattatcaattagataaaatattttatccttgttgatgaggaatagtgtagcagctgattttatgaaccacacaataattccagttgtccatttataaggttaaaaatacagttgcatctgcatctttaatgatagagtttactaaataatgtatatatgttattgaataatatattttttctttgctattgtgatacatgttttaaactattttaagttttgagaatattttgaatctttgagcattatttgtggtaaatcaaagttgtggcgatagcaaaaacttgattttaggtgaagaagtaaagaacaaataagaagaaaatattttattgttttaagatagtccacgtttattctttagtccagaaagtatgaatataccaggagtaattctagagccagaagataattgtgtgtttcttgggactggtttcataatattgccatcacatatctgaaatttagaaaatggtaagtttgtcttcttaacaaactttaagttatgttcccattacagattggcatatgaaccacactagtaacaatggcttctttaaaaatgttttagtaatattcttgttaagacatttatggtctgccagaattaaaaaaagaaaacactcttcaaaatagaagtctcaactatgggaatttcatcttatattgcaaaagcctattaaagggtcaatttatagtttttggcatatataatctacattgacaccatagctctaaaggaactcttacagctttcacttgattttcataaacatttcacatccttaaatccctttttattatcttgagctagcattcaagtattcatgtctttgaattttgaactccgaaatttcaaaattttgtctgtacttcctaatagtagaagttaaaaggtgctttgaaatatcattacaattaataatagccatgtattttattgtcattaaatatgttgccacttgctctttgccatccttgtcatccagcccaaaagttatttgcatacttagataaacatgattttaaataaattacagtacctatcttctgtcatacaggtcagtgtgattttaaggcccttggtacatcaaacctatttttttctctccatgactgatatatacttggtgatacactaatattaagaaaagcataagaatcagcagtagaacagcaagaaacatcaaagacaacacgtatgaacgagggactctaatgaaaacactttatcagtctgaaggaatatgatttcaacctgaccttcccatccctttgaccatttctttaaggaacataccataataaattttagttccatgtgtgtgagaaattactgtcataaggattttctcattgaataatgagaaatctgtgcttctgtacaagacaagtcctcaatgactcttcatttaaaaggttgaattatatcaaaaattgaagaaactggggaaaacaaacataaaatctaatgagagaatgaagaaagaggtgaaagtcacaaagttaagtgctagaaattatgttcatctcaagagagtaaagaagagtgcaaattaagagccaaacaaaattgaaataaggatggggcacataggtctcttctagttgcatttattcaggaaaaaaaatgatttaaagagaagtgtaacaaaattgtatcatgaaaatatgagaataaaataaaatctaatttagtaatctcaaaatacacattcatttgaatatacctttatttattcccagtggcaagccaatacaagcctatatgatgtaatctttttcaaaaaaagcaagaatataattgaccctattggcaataatgaacatgtattgagggctcacattagttatgtctaaccattttttctagtcaaaactctgtgacagaactaaattgtgcagttatatacacctagcgtgttatttgtcacaacttatataatgtgaggccaggcaatggtctgctgtctccgctgtgctcttggactattgaaaacacacatgtaatgtcatcataatgttatgtaacacatgtggaattataaatagcatcctgtctgagatatttcatataaggaatgtgggtggttattagatactttaagtggccattacataaaagttgctaataatatttaatgtctctagatcagtttaatttaagggtgtctcaaggttgtgaggtgtactgtttaaaaagagttattttcttatgaaatgacagatctttataaataagggatttcttatcactgcaaatccaacacagtataggaataaattgaaagtagaggtcattaaaaggctgaaactgttatctataatcttaaatttcaaattttgatgtataacaaaattttctctatttattaacctcataagtaaatattgcttttgtggatttataaaagtatatatgtactaataaatagtaccttatctgtcttaaaatagagattattcacagagtatcatttttaaaatgtagctttggcaaaaatgttggaaaaccaaaggtgaagaaaaagaatatagactatatatttcagacccttaggtttaatcacatgttcagcaccttttagactttaggcacattacctatttctcctcatggaaataatggaagagacaattgccttgcagtgttctaacgtggactcaaagggataatgatattctctaataaggaactcagcatcttcatctactgtagggaccaaccccacaaggtcggtgggtctctccctgtgtgcggcgacgagagagtgtagaaataaagacacaagacaaggagataaaagaaaagacagctgggccccagggaccactaccaccaatgcgcggagaccagtagtggccccgaatgtctggctgtgctgttatttattggatacaaagcaaaaggggcagggtaaagagtgtgagtcatctccaatgataggtaaggtcacgtgggtcacgtgtccactggacagggggcccttccctgcctggcagccaaggcagagagggagaggagacagagagaaagacagcttatgccattatttctgcatatcagagacttttagtactttcactaattgactactgctatctagaaggcagagccaggtatacaggatggaacatgaaggcggactaggagcttgaccactgaagcacagcatcacagggagatggttaggcctccggataactgcgggcaagcctgactagtgtcaggccctccacaagaggtggaggagcagtcttctctaaactgccccggggaaagggagcctccctttcccggtctgctaagtagtgggtgttgttccttgacacatttcgctaccgctagaccacggtccgcctggcaatgggtgtcttcccagacgctggcatcactactagaccaaggagtcctctggtggccctgtccaggcataacagaaggctcgcactcttgtcttctggtcacttctcactgtgtcccctcagctcctatctctgtatggcctggtttttcctaggtcatgattatagagtgaggattattataatattggaataaagaataattgctacaaactaatgattattgatattcatatataatcatatctaagatctatatctggtataactattcttgttttatattttattattctggaacagctcgtgtccttggtctcttgcctcggcgcctgggtggcttgccacccacagtctaccatgttttatcctagtgctgaaggggtctgagaggtcaactcattccttttagggatgagagaaattaaacatattggtgcacaagaaagatgcttgaggctgggtgccactgtagaagttttctagggaaagcataagtattaataaacaaataataaaagaaacaaggatcaaaacctcacttttatgtaatattaaaaattgcttaatcagtaaagttatatgtaatgcgatatatacatatatattttaagtcaagatataaacatataggaatcaccccctagagtttagcttttcctgttgctgtaaaaaatcagcctctcatacatttaaaaagttgtatgtggcacagcattatttacataatgttttattatcaaatacattgcttgtgacaaacacagatacatgtgtatagtagtatatatttatatcccaagtatttgtgaagggataagtgctcctttctcattaaacagaaagcctcctggtaatataatgctacacatttttgtgaacattcactacctaaataatgtctctcacctggcctactcaaaatgccatatgtttgatcattcaaaaatttattgctatttcagaaaatgttaaatggaattgcgtagtgaaagtaataaaaatgaaccatgagaatttatatacatacttttccacgtctctcatttcaccatgtttatgtagtttagcaatatttttctctcctttgtaaaactaattccaggaaatttgcaaagaagtcacatcctaagtcctaagaaaatgcagaagctgaagtttgagccagatgggcactttccagtagaaagcttatcagtatcagatcattaaaatgagcaaagtttcccaacattatgttctccacaatcggaaccacaatagaaatcccaaaatgggacgaaaatatgactccattcaaaatgcaaaaagtatcagaccccccccccccattttttcataacctaacaagataactctaaaacccttggttcatatttgattcatcagtttcttctagaaaaatctacagttcatcattttttatttaataggaaatttgcagttaattccctctgatagaagcagtatagtgtaagggagagaacatttatttagaagttagaagcccaagttttgaattttctctccactagttactagcaaaatgatcctgacaaaatttccaaatatttctgagcctcagattttttttgtatttaaaatgataaaaatctgtagggacttctactaccagacaagatgttgtaacaaagaccaaccagatttattcctaacctaaaacgattgaaagaaacaaaaatgtatgtacatatatgaaacaagggctttcagacatgtaatatttggcaataaaaaactgtaatacctgagagagagaaagtaaacaaggtgagccctatgactgctccagaatatagcctggagaaagtttctaggtttcaactcagggatgaagggacttttggctaattcccagagttgaagagccagtgggtagtccaggaaggccaaggcagcttgagtttgcagggcagggtacaggagagttatgagccacacacagagaactggagatctgcagagtcccctccagtcttcagctggctaagagtgaatacatgaaagcctgaggccagaaaaaaatctatcttaagcattagaaggaaaatcccaggagctcacacaggcctggaaataatttgtgttcgcaccaacaagaatgggaaaaccttacaattcaaaaagacagcaggttggcaaactactgcccatgggccagcttggcctcttttcatatatggagctttattggaacacaacctcgcttatttatttacatattctctaaggctgttttcaaactacaacagcaaggttgagcatttgcagcagagatatatggcctgcaaagtctaaaagatttacttttttttttttaaagacggggtcctatgatgttgcccagtctggtctggaactcctgggtgcaagcaatcttcctgcctcagcctcctgagaagctaggaagacagacacgtgacaccatgcctgagggtagcctaaaatatttactatcttgctctttacataaaaataaaattgctgagttagagtgctcagaagaatatcgcctccatagtgaagcaacattaactcacacctctggatcttgtcctacactaaagtcttttgaaccaccgtgttggctcatgtattcacctatttaattctcaccccaactcaatgagattgttactcttgcccctgttttatagttgagaaaactgagagacaaagcattaacaggcccactgtcacctagctgattaaatgtggagttgaaattcaaatccagagtctaaatccagagactaaaatctgtaagtttatgttattctgactcttattctaataattgtatttggctttatattgatacatggcatctgttaggagaaatgattcatttgctatgaatattgaaatagtcccattaatgacacttagtgatagttgactcaaagctaagacatggaatcctgttattgacattagttttcaattagttgcctctggaagaaaacactaaaagagaatctccctagtattatcttccaggtttctgataggtcttatgtgcaagaggcattctcattacatctgttttcctcctgggagctagaactccaaccttacactgcagtgtaaattcctattcaaggaattagggctgaatttagttgtcaccacaactcaaaatgagattgttattcttgcttctgttttatagttgagaaaactgagagacaaagacagccagcacctccagagcacttttttgtcttttatttaaggcctggtctgcttaaaaataattattaaaaactgaaataggaaaagaagaaagtggactgggccaggcatggtggctcacacctgtaatccgagtactttgggaggttgaggagagaggatctcttggccaggagtttaagactagcctggacaacatagcaagatttgatttctacagaacattttaaaaataggcagatatggtaggacaacagtagtcccagctactcaggaggctgaggtgggaggatccctgagcccaggttgcagcaagaggatggctgagcccaggttgcagtcaactatagtcctgcccctgtactctaacctggatgagtgaatgagaccttgtctctaaaaaacaaacaaacagacaaaaaataatttaaaaagaagaagaaagcaggccaacttgttttatctctaaagcataaggcagatccaaactaagatgttcttccgaagaacaagcccattctaccacatctggacacagagctgtaagaggagaggataaaatacaagagagaaaaggtgaccaggtggtccttctgaattattttacaatcccattatttcattacctgttgagtgaccctattgtatatgcaaatccattttgttcttaagtagaatttgggcctcactgattctggagaaaggaactggagaaactgaaggatgtcagactatgtggctctttggatgcacaagtctatgactaatacctggaatgaggtatgctatgctccaggaatcatgcttcctttttcaatcaccgcagcacatgagttgggtttccttcctcccattttaaagttttaagagatttaattacatgtgtatattaataaatacacatgttcttacagttctgtaaaagtcagaattgcatttcattaaaatgtaattttaatgtaatgtaaattaggaactgtacagtaaaaaaaactgttatgctttatctggaaatttaactatttttctctttgattttgtcttcttatcccctaggctagaagcaattttatttatctgccagcaagtatggaaaataacatattaataataatggggacaccttgaaaactttaactaaaaacaaccaaaaatatattaatttagggataatagtcatagttgtgcagttttataaccataaacctgttctgatttgtataatgtccattctgattggttggtgatcatgtcatatcagttattaaatatttagactatcctaatgatgactcataaattatgataactaaaatgcatttcaattgcatgatttatgatagattaatataaattaaagttattgacttctacaaaatataatttattcaggaaacgaagtcttgttcctttctgatatcaggcttgaaagattgtatacttaatctaatgataacatcattgcacaaattatgaatcctcccttttgtaattgtcttcacaactttaagcacaatgttttaaggttccccaatacccacaaatcttttctctgagtctagactgaattttcagaaacatcgagaaattattcatgtctccatcagaaaaggacatttgaatcaggaacaaacgagggtctaaacagtaaaattgttgttcatctgtgatttgtaatatgaaattgagtaggacacttaacctctcttgacctcaactttatcatgaataaaatacaggttttgattaggtgacgttatcaattaggttcacagcctaagttttaaacaattgcattttttcctatgtttagaataattagaacatgatatcctgagtcaaacataatattctaaaataaaatttaaatgctcctctatgctattttaaacttgaaaataaaacatcaaaatgtaagtaaaacattccacttttcctcgatccaaaacagaaataaaatttgatataaaaatattatttaaaaattgagccccaaacataaatggcagctgtattgctcagcaagactaaattgttattctcgcatacctcacaacacggtctctgtagcaacaggaattttgaacaaaaaaaatgcataaattccaacattttaataaattaaattaatgactggatcaaagtcttcttacaggactatataagaacctgactcattctgattaaatcagagccgaaaaataactttacaaattgcagcattatgcaggtgcagtcaaaggagtgtcattggttaattccttaatttggggtagtatttttaaaataggtatatttataatttttgtttagcgctctgatacagttacataaaagtataattgtaataatataattggaacgctataggtatagacaatcaaaaggtgcttggaaatattttcctacttaaatacctccttggaaattgtttacaaagcaactatataacgatgcacacagttatataaaaacaattttaatctagcacatgcccaaataatgatgaattctaaattagtgtaatcatatttagtgaagatatatgtatataaacaatgtgctaatgccaaattatttttcaacacatttaagaaattcaaaagatttgtatctatgtggcaagtatgagaaattagttgcgtaactatacacatcttagtatcatctaggcaagaaactactccagtgcatataattagctatgctggtatgtttgcagatataataaaaattacatgtataggctggcataggtcattttgaaacatgaaaagatgacattcttcatacatactttaatcaatagaaataaatttatacaaagaaagaagagataattagaccttttacttttttcctaaggagcagttattacatttaagaggaatgtgttatttagatctaatagcatatactagtcattagattgaaaatcaagagttaaaatttgcagtgcacacatactgcatgacccaaagtcaagtagctcaagaatttgtcatctttttaatagactgtgtatacaaaattgaatagataatcatctttagtctgccaagctgatactttttaataggataatcctttaagggaagctgtagttcaacagatgtgcaaatcaacccagaacaaatagcacactactcttggagatagagcctgcacagttggcacttgtgataacttgtagttatatttatctaaaattgaatttcaaactatattcaaatatgatttactcaaatctgattgaactcagaagtatattttctcacttgttctataagagaagtgtaaataaaaattgtttaaagtcatcttcatgtaacatctcctaccatgcactctatcaccaatagaaaaaataattgaaaggaataaatagcatattgttattatgaaaatcaatactctgtaaatattttgaaataatgataagcatctttgaataatagacatacatttcagaccatgtcttctatccaaaaatgttatcattccctctcttatatatctgttggtctaacagtgagaattatgttaattcggttgacaaatatttaatgtaagcctactatatgccaggcactgttctaaattctaggattcagtgttaaagagatagaaaatactctatttacaaagcaaattgaaacaatagacatgaatttgcaggtaatgactaggagtattgcaaacaaactgttccacatgttatatgctacatgtgtcatctgagtgctgtttgtaaagaatagcatgtatttgaaggtggagaaaaaagatgggcattcctataatattagctatataaccacctaattctcttctaatggactcaattaaattaatggactcagtaattagtgtaagttttgattattactgcttttttgttttatcctttatgcctttcataatatttgatttttttcttgtatttatactactttaggtaccatttttccttatccaaatttggttgtaacagtggatccttctgctacttgtgcttattttccttctacttcttttgctgttcttactcccccttagctcctttctctgtaatcatttttatcatccttttttttctttttcatcaggtacaaataactgaattaatcatacttctcagtatgtgataaacttattaatctccttttatgtgccgttcctactttcattctttcccattctccatggaagtttttaaatgtctttaatatgttctcttagatctgcagatatccttgaagaacgtatatatagagaaaattattctgtgtatgtacgtatgtaagtttctaaaaactatgttttgctatgcattccattcaatttcttgctttttcattttacagcatgttcttacattttacccacattaatatatgcctatcaatttaatcaattctgtctacttgatagtatttcatattattcatcttactattttatttatccattgctgtaatgatggatgcataattttcctataagccccttgctacctaaaggcattctgcactaaacatttttctcaaacagaagtttactgatttcatctagaatgtcttttattaaattgaaatatttagattatattgagtcaattgttcagctcccacttataagtgagaacatgaagtgtttggttttctgttcctgcattagtttgctgaagataatggcttccagctccatccatgtttctgcaaataacatgatcttgttcctttctatggctgcatagtattccatggtggagatgtacaacattttctttatccagtctattattgatgggcaattagattgatttcatgtttttgctattgtgaatagtgctgcaatgcatatatgtatatatgtatctttgtaatagaatgatttatattcctttggatatatacccagtaatgggattgctgaatcaaatggtatttcaggttctggatctctgagaaacttccacatcatcttccacaatggttgaacttatttacattcccaccaacagtgtaaaagcattcttatttctacacaacctcaccagcatctgttgtttcttgacattttaataattgccattctaactggcatgagatggtatgtcattgtggttttgatttgcctttctctaatgatcagtgatgttgagctttttctcacatgtttgttggtggcatgactgtcttttttgggaagtgtctgttggacagtgagagcacatggacacagggaggggaataacacacactggggcctgtagaggggtggggttgatgggtagagagagcattaggaaaaatagctaacccacgctgggcttaatacctaggtgatgggttgataggtacagcaaaccaccatggcacacttttacctgtgtaacaaacctgcacattatgcacatgtactccagaacttaaaataaaaataactttaaaaataaatttaaaaaatttttaaaaaattaaagagtcaaaactattttgtttgtctttgtatttttttggaggagggattgctgaagaatatcaaccctgctgttaggtcacaaaaatattcttctcttctagcatctttctcttttagctttacgttggtagcttttacattttaggtctttaatccgaggtgcaagggagtgttatcagtccatttttcctgcaacaacaaagaaacccaggatcttcctgacttatagaagcatttgtttctcgttcccttatcagaaagcttcaggacagttcaaggctgacttgctttcctgggctcagcctaatgccatgtgtctgatttcagatcccaggaccttttggtgggacatgtcctcatagaatgagcaggtcaaatgaaaaaccaaacttgtgcaatcacatttaaatcttttttgagatgtcacaaattttaagtctgtttaacattccattgaccataagaaggtcatagcaagttataaaccaagtacaaaaccactgagatggggacatatatcctattactacagatatcaaagacaagtttcatggtaataggtggagatttttaaccctattacagggaagaagtaagtactgggaacaataatgactatagagggagattcaactttatttctctttctaataagtcagttttcttaacaccaccaactctactattgaaacttgtctcgttgatttgtgatgccacttttattagagatcaacttcaaaccaatagacacatcattttctgaattttcctttctaatatgctggtaacattgcctgtttctgatctagcacaatactgtttttgttgccgtgatgttctagtattgtctgcttaatatctaaatgaagccacactctttgtacttctttttaaaaagtatccattgagttttctatttcttgagacttttggagttatcccttttaaaatttcaaactgtatttcaatctgttagagaacatgatctgcattaagttcatcttctatgcaaatatagacaatttgttcactgccccttgtttaggcaaaaaatgcatttctgtgcagcaattggttgattcaaaaaatttatagaactttcaatttagcttattaactagttattcaaataatttatacaatttattttttgactgcttgagatctcagtttctgacatgcatatattaaaatccttaaccacaaatggtaactaatttatccatataaatctgtcagttttcactgtatgtattttgaggctatgtttccagatacatatatatgaataatcattatacattcttgatcttttttccctttgtcaaatataacatctctttcatgtgattttgccttaagttctattttatctcacattaaagttggcaaacctttttatgtcatattttccaagtaatcttttccatacctttactttccatacctttttatggcaatttgtttttatttatttttgtttttctccccaatctgatatttatatttttgagatggttaatttactcataatagttgcattgtttcctacatcagtatgcttgcttagaaaaatttttgtattggtcagtattctccagataaacagaaccaatatgtgtgtgtatatataagaatgtatgtgtatgtatatatgtgtgtgtgtgtgtgtgtctgtgtatatgtgtgtgtgtatatatatatacacacacatatatacatatatatatacacacatatatacatatatatatagagagagagagagaaagagagagagaggaaaagatttattttaaggaattagcttatgtgattgcgggggctggcaattgtgaattcacaggttaggcaaacagtctagaggctcagaaaaacttgatattgcagctcgagtccacaggtagtatagaagcagaattccttctttcttgagggccttagtctttctttattaacgctttcaactgattggatgaaatcattggattggatgaggcccactcacattatggagggtaatctgctttacccaaagtctgtgagttcaagtactaatcacgtctttaaaaaaaatacctgtacagcattatctacactagtgtttgaccaaataccgggtaccatatgtacaatggcctatccaaattgacatataaaattaaccctcacaatgctacattgtgattgtcttgaccttgtctttcccttgatgatcttatttctttcaggaaatatttactatgccctattctagacagtaaaaatagagcaatgaaaaaatatatctgctctcatagaacttacattctacttgagaaagaaggttcagtgaatgggaggtggatgataaatagctaccgaaattaatgccaacatatttgccaagtggtgataagtcttatgaaaaattaagacaagttaagagaacaaagagtgatgaagtggaatattactttagaaaggatgttctgagattacttctctatgaagtgatacacatgagcagacacctggatgaattgagggaatcagtcaaatggttatcagcaggaagagcattccagaaaaaaaacagcagtgcaaaagatttaaatctaaattatgctttttgtgagtgagattggataaggaaaactatgagagatggatcaaagtgttagccaagggcagattatggatggtcttgactgtggcaccaacgctggtctttattctaaaaagaagaaataattataagttagctcaattttttaaatgcatgtacatttgatggggtataggtaaattaaaatcttgccaagagaccaacacatgcaacttaaaagagagctaatatatttgatctcaaataaaagaacaaccaatgaatttgtctgctattaattatggatgatcaatccacagcaaatcattcctatttatgtctaaagacatggtgggacttaaatcagagacttaacagtataaaatggtgtagaaatttaaatgctccggacactgctaagagacagcaattaataatatcatgtaatgaaaaattttgtaaactactcttatattcttgtataagggctattagatgttctgctgaggaggagatagttcatgagtttgctactttctagttccacatcaatggataatttctccctctttactgtatggaaatttataatatgtagacattttgatgttgataacatttagaagtgtttaatttttagtattatcagcctgacagacataagttttattaaattagtttgagaatctctttgaagatatttgcatctgcataagtttgcatgaaaaaaaagtttgcattttagggggaaaactattatatcagtgagaattttggagtattttgcttattctttctggaactttgaagtaatgtgaaatagtgtttagaaacctcatctcaacgtagggggcttcttagtaataatacactgtatctgcatacccgtttataggttttaatccaattcattccaccaacatatcttctaatgcttagtcctgttgtcttctcatgatcaaaaatgaccccttttaaaaatgctttgcatcaccatcctttttttttttttttttttttttttttttttttttttgccaaaattgacatccagtttgttttaagacagtttcattaggtcatatgtctagatttgttacctccattcttcctctgcctgggcctaaactattctataatttttctctgtccccactgccccccacccccttgaaatcatagtcaacaattaaactttgctacttataagaaagacttgacctggctttgggacagccaactgagcataaagtggtgaatatgctgttgagagtagtgcttataaccccatcatatgtcagtcaaccagattagcatactgctccactattttcattaatgaaggcagaatttgtgttaagaaagccatatttgctacaattcaaagtcaattagctttctcgtgaaaaaatgagtttctcatttaggtgcttaatgttaaaataaagagggcattgttcatattaattataaaataattcaaaaagacatctctagacaccaatcaggaaaagataatcactgaagattatctgaaaataaattaaatgtctaagcataagtcttgttcaaatataatatctcaaatccatgcaatggaataccatgtgactattaaaatgtcataaatgtgcatataatgaaatataaagatagattttcatagtacatagtgaaaacaaaggcagtggaaaaatgggatataggatgtaacttcacaataatcatctagatagagaggtatatagacaggatgctgtgctgctcattctccattggccccattcctccactcatccattctatgttcttctctgccttcctctattccctgggaggctgacttgcctattgacttgtgtttggaattgacgaatgggaggcacttacaggagagtgaagggcaggaagagagggagattggagcatctactccctccacgcccccgggctcgggtgcacttgcacagtggctgcattactctccagctacagctcccatcaggccgacttactcctgagactggttctcagccaggctcctgttaggccattttctctcctcaagcctagtgtcagtaacaactcttcactgcttctaatttacatatgtatttccttaatttattcctctatctttaccccttggtaaatatttagtcccttcattaataagtctctttaaaacttccctctgagagtgggctctttgtttcctggcggggccctgaccgacacagttgctcataaaaggcctggcatgctaaccactacaatgtgcgtaggcattctctgagaagtgttttgccttttgttctaaattttctaaagtgaatatataacgagttttcaatattaagaaaatcaagtaaaaatgtttctgtacatgaaagagaaaaaatgaaaataaataatgctagtatgaaaccaagaagagctggtatctttttaacttgttttaattggccatattggtcttaaggacctcccacatctaacactaagtcttacccatctcctcccaaatgagttagaaagagaggaggagaagggcagatgaagaagactcagctgaagccaagtgaaagttagcatttatacctaatggaagttaataaagcttaactccttggacttcacatatgtctggaaggaagagattttccactctactgtcagggttaaaacacttacatagcataattctaactccggctctgtccctccttcctctctccctctatgaaagtggtatctatcttggtaactggtgtcattgaatagcctctacttgtgccgctctccttggaaaaacttgtcatctagtcacacaggttcttccatctattactgccagcagacagcaccagcagtggaggcctgagttaccacaatgctgccaataattaggtgggcatggttcattcactgtggggagtgttaggatgcccatgagccaacaaatttgtgttatgtgttcagcttggccttatcacattttagctgcattctgttctccctataaatcctgtgccttttcctgggggtggttccaaactggagaaggaaaggaaaggatactttactgatgttctcaaaacacagtaacatttagatcccttctatatgcccacaggaggcaatatttttttaaatgtgtatttttgttattctaaatgtcttataattactgcagtcatttttgaaaagaatatgaaacacatgtaaaagaaaaatcatgaaatcataaaagagttaattgtatactttttatgaaactataaaatcactatataatatatatttgataatataatgttttcagtctaattatatactttttttttttcattttagttatgtacagggacagtagaacagttaggaaccaaggtctccagagtgacactgactggttttgaatctagattctaccacttattcattctctaaccttgggcaaattccttaatttttcttttctttttctttttttctgttttcttttcttttttctttttctcttttttttttttttgagatagagtcttgctctgtcacccaggctaaagtgcagtggtgccatctgagctcactgcaactccgtctcccgaggtcaaaggattctcccacctcagccttctgaatagctgggattacaggcatgcaccaccacacccagctaatttttgtattttttttgtagagatggaaattcaccatattggccaggctgatctcaaactcctgacctcaagtgatctgcctgcctcagcctcccaaagtactggaattacaggtgtgagccactgcgcctagacagttccttaatttttctatgcttaagttttcgcctctgtaaaatgagaataacaaaatagtgcatgttgttttttgtgagccttaatgaaatattcatataaacatggtgaataaggcataagtctctgcccttattgtttacacagagaagcagaaaattaactacctctttctttctgtctctgtctcacacatgacacgcacgcacacacatgcacacacacacacattcataaatggtataagcaaaataaagccatgttaagtatacacagtgaaagagtggatagtcatattttagataagatgtgcaggaaaggcctctgagaaaaagcaactttcctaactgaggaagcaagtcatgcacaggtcttggcaagaacatttcaggctgaaagttccaggaggcagaccattagttaaaaaaatgttgcagaggtccacgtgattagagtggaatgaataaggaaattaagataacgctgaatcgattacctgagagcaaaggggaacaaaccccccgggtaggttccagactcagtatctgagaacttccaaaggatgtggtactattttacttaatggtgggaaactgtgacaaggtagcctgagcaagtgttgttacttcaaatgcagctatctcaccagcaggattttgtgtatggaatactacaattaaacattgaattaaatattttatgttgtttccaaaactaagtcattatgattgtgtatgatatatcccaatgttttctattaatggtttccagaaacaccatctttcttttgtaggttagaacattatcatatgaaataagatgccaagaaaagaacttgttatatcacgtaactcataatttgataatccttgagtattcataattaaattgaaaaagtcattatttcttggactataatagtatctgagatgtaaattaatgtatttatttgttactaaccaatataatttaattttataccactttaactccccattttgtgttaaaaaagaacacaatcataatttgactcctttattcaaaggaagtaaattgaaattcaaagtgttgcgcttaaaagtgagttggttagtgtttaactttcttttgagcacttctgtccccaaagccggtcagtactttgcattttggtcatttttcttttgctgagataatgagggtggggactctttacaactgcaggcaattgctttgagctccgagcactttgaagagattagccccattgatattctctccaatatttttggagagaaatgctgccttcccttgagtgtaagacgaacggctgttgaatagaaacttcttttgtctagcagagagtatggtaatacatattctcttcttagagacatatatacaacattagaaagttatctaagatgattgggagcctcactacactgacttgttaattttgtttaaactttcagttaaatgtggtctcatttacctggaaagtatccttaaagcgtttgagcctggattgtattgctattaagccagtgaacttggtgatgaacaagttaattatcctggggataaaaagggaaaacggcataatttctgccagcaatacagtgaaaaatatatgagtgaactatttggaggcctgcccactcagtaggacttagctggccagtaacctgatctctctggtttgagttcatcaaagacatttctttgatctaaaaatgttacagaatgctaaaattcagatgaagccatataaataatataaattttataccacttgactccacatgcattatgtttttgtttcagagaggttcagttagcaaaaatatcaattcaaatgacttttctgtcattaaaaaaatgccttttgtgggagagggatacacatacacttaggtgtgtatacatatacacacacacttaggtgtgtatacgtatacacacacacttaggtgtgtatacatatacacacacacttaggtgtgcgtacatatacatacacatataagatataaattaaaataaaattaattaaatatatatttaatttcattgctgcaattctacctagtgtctcacataaatacaagatcatcatctactgattagcttgctcctgcagacaatcggatagatactaaaacctcctgaaggtcatcataacctcattttctgaaagcatcccttgaagttcaatagcttagaaagtttctgttgcatttgtgtcccttgctgggttgtatatacataaaaagggatattactttcattcagagaagataataaaaccttgtgatttaggaaacagggttatcatcaaataagccttttatttatgctattcagactgcctatcttcaggatatcgcaagtactgatcaatttcaggtcaattggatgtgtgaaatagaagtgttgtggtataagctcatgattatgtcctgtagcttgaaacagtgaatttgattacatgacatgttgctgtaccctctttggtcttattgtctgcacacttcaaataatctacctgtgccaactctaacagcccatttcattctctaggaaataaccttgatataactctaaccatttcttcatggtgttagaaattataaactcataccaccttcatccttagaactttttaactctagtcccaatatcattatccaggattctgggcaggctgccatatagcactgtgatggataaatacaaatgggtgtgggatttgctgaagggtgtctaggctcagaaaattgccattgtgcctttacatccaagagcgcctcacaagattacaatattttgtgactccttaaccttggaaactagagtccatgagacttttctaagatcataacaactttcaggaaaggagataattttctgtacctcagaaaattctgaggtacaggtctggccacttttacttcaggccaccaccttagttacactggaccttaattatcatggcaaaaatgtgaagcatcaatttttgactcctttacattgaaatagatagtttatgggtgcttagactgtcaaagctctcctttatcagtgttcttttctctaatttacaaaatatattttgttgttttgttgcactttgctgagttatttatattccccttgtacagatgctagcatatcaataaatagtttatatattttataacatcacagaaaacatttattgagggcctttgactctagtcattatcattacttttcacaaacttgcaagatgatttctaagaaattctcattaaactcttttaaagtttaaattcgaacatattttctcagcaacttttctttgcttttaaagaactttggctccttgcactaacagaataccatcaaatcagttctactcctatgtagtaagacaaattttatctttttccatagaattgaataatttcatgatactagtttaagaataaggcttgaagatgctgatttgcaactgatactggtgcatcaagtatcataaaattccttaagaacaataaataagtaaacatatattttaagtgaaaagttattaatgtttttttctttttaaaatacattttattgtgtatatttgagatttacaacatgatgtatggggtacatatagataaatggttactatagtgaagcagatcaacatattcatcactttacgtaattacttttctgagacaagatcagctaaaatctacttatttaacaaaaatatctaacatagaattgcatctcatgttacacattagatctctgatttatcctgcatactttgttttttttttaaattttattattattatacttaaagttttaggttacatgtgcacaatgtgcaggttagttacatatgtatacatgtgccatgctggtgtgctgcacccattaactcgtcatttagcattaggtatatctcctaatgctatccctccccacttcccctaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcacgttttatggctgcactgcatagtattccatggtgtatatgtgccacattttcttaatacagtctatcattgacggacatttgggttggttccaagtctttgctgttgtgaatagtgccgcaataaacatacgtgtgcatgtgtccttatagcagcatgatttatagtcctttgggtatatacccagtagtgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgaacattttttcatgtgttttttggctgcataaatgtcttcttttgagaagtgtctgttcatgtcccttgcccactgttggatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccgttgcttttggtgttttagacatgaagtccttgcccatgcctatgtcctgaatggtaatgcgtaggttttcttctagggtttttatggttttaggtctaacatttaagtctttaatccatcttgaattaatttttgtataaggtgtgaggaagggatccagtttcagctttctacatatggctagccagttttcccagcaccatttattaaatagggaatcctttccccgttgcttgtttttgtcaggtttgtcaaagatcagataattgtagatatgcggcgttatttctgagggctctgttctgttccattgatctatatctctgttttggtaccagtaccatgctgttttggttactgtagccttgtagtatagtatgaagtcaggaagaagttgaatctctgaatagaccaataacaggctctgaaattgtggcaataatcaatagcttaccaaccaaaaagagtccaggaccagatggattcacagacgaattctaccagagctacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatctgcagtaaaatactggcaagccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatccttcatgctaaaaactctcaataaatacggtattgatgggacgtatctcaaaataataagagctatctatctatgacaaacccacagccaatatcatactgaatgggcaaaaactggaagcattccctttgaaaactggcacaagacagggatgccctctctcactactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtacaaaaatcacaagcattcttatacaccagtaacagacaaacagaaagccaaatcatgagtgaactcccattcacaattgcttcaaagagaataaaatacctaggaatccaacttacaagggacgtgaagagaagttattaatgttgaaacagttcagttaatgttgcctgcaggtattagtttaatgttaagtgctgaaagaaattaatgcaaaaattaatggcttaacatcatcaatatttacttctcactcacatcaatccaatgtgagaaggattctgtgccatacatacagtatttcagtagcccaggatggcaaaggctgttccattttcagtatttagcttcaaaggtcactctgggcataaacatctagccagtggacaggaaaagatagggaaagctttcttcatcacttttgcacgaatctaaaataaatattttccactactagggccagaggccctcaataaataaccacttcattcagttagcaagtactagttccataccctgcctagataaaaaggagactgagaactgtattccttggcatagtagccattttcgagccacaactctaccctgcagaagccagtctgaatcttcagtggagagtcaacctgtgtctacctgaacctgtaaattgttactttatcagctataattcttgggttgcagtcaacagaaattgattctgctatctctcctaagaaagaaatagattagaaggatatgatgcagtttgcagaattcgaaagaaggttaaattgaggaaccaggaataaagaaatatatatatatataaagaaatgtgtgtatatatatatataaagaaatgtatatatatatataaagaaatgtatatatataaagaaatgtgtatatatataaagaaatatatatataaagaaatatatatataaagaaatatatatatatgaatcagagaaattctgtgaataaaaggaattggattgatgaatgtggtcttctgagtactgtcaacatgagtacgtctcatctcaagatgagatggctctagccactttctgtccaggtgttattccattcaagatttgaattaaagaaaagaacatctgattagcagagcacttcctcttggctagtggagatcggggtatcttgattgacagtcctctaagattttacccaatgagacatgggaagacacctcaaagccaaaacaaaaaagagcaatgtcaaaagaaggggtgatagaggttaggttgatcaaacaatatatatgcttttaaaaaatcagttatttcagactacttttagtttaatacattaaaaagcaagaaaacagttcctggtcagaacagcaaggagaaaaaactgataaatcattataatcagtataaaattcttcttcctttttgttgtaatttgatggccttgaataaaattttgaatccttcagtagttaagtttctttatgtataaaggtgcagatgagagtactttgtcatatgaggcagtggtgtttggttgtggggaatgggagggaaacagcaatgagaattaatgtgttagccattttatatgttgtgatttacttggaatatcccataataaaaacatttttactgcttataaataaaattatactttgccaaggagctattataatatactaatttgtattccactgataaattcatcttttaatgtatggataccttcagattaaatacaggtttattaaaggcttttgttgatgacaatgtcctcaaatatagcatttaccaccatttcctgacaaataactatgtggtgaaatggatccaaatgaacaatatctaagtagataaatgttaagatactgtaaaggaaagaaacttctttttttaaaaaaaaaacaatattattgctagctagaggtgctatagatagtcatccataaaaataaatgccaggtttgaaaactacaggatatacctgtagaatatcataaaacttacaatgaaaaaaaatcctccaaacagatcttaatatgcccctcttatctgttcactctatcctgtagctgtagttttccaagtaggctactaagcggtctttcaaagatttattttaacaaatggctgctctgtctatgcacaaagaaaatgaaataaccctataattttgtgaatttttaaaggtaagctaacaaaaagattcctttcctgttcctttgattccaaagaatgtatagttgtatattattttcccttgggagctcggtaagacaatcttcccctgagtctttattcaagtatttcatataacaatagaagtacagtgatggtcaatttcttttaaaattttccatgtatgcttactctagagcaaattccactagtgcccttaagagtctctagtggaatttattgaatgtgtgtgtgtgtgtgttttatatatgtatctaaaaatagttctttggcaaaaaaatatgtgctatcaattttttaaaattacactggcttttctagactttattaacgtatctccggagccagaattttatgctaagctttttttaaaaaaatttctatttgtggtatatctatattcagttataattggggaaaaaccctcacttctggagtgctgatgaatatagaattatttaagaattaagattatttcaagaattatgtttggaataaatctcttaaacacaattctcagtatgtgagcttatgatatttatatgaaaactaaaaccatttttcttgccaatggatatgaaattattgtcctattagacacctagaccctatttcctgcagaaaggagcatcattcataccattgcctaagctcaaagtccctgaattttccttaacttctttttcttaacatatggaccattaccaaatgtatctattttgcttgcagaataggttcaaaatctaaccctttagatgaattgtctttaaaaagattgacttaatggtgacagttccattttttaaaattcttaatgggacctatggttctaccagcaattctctagtattccaggaattctcaggattttacatctttgctgtgactttcctgcttctgcctggcaaaccctgattcattctttaatattctattcaaatagtactttttctaatatcactccctcactttttctcccaactctattttttaggcgaaataaattcttttgtcatctttgtaagaattatgacagaaggtaggttttttgtgaaacaaaaatgcttcttatggaagttatatttgctttccgttgtacattgatgtgttacagaatggcttagtacttagcactgtagtttgctgagtatttatagtacctctgctagtatcaaattaacctaacaaacaatgaagttttataataattaataaaaaccataagtttgttcctataagtaaatattttatatgtcttaattatggagaaaagttcaaggtaaattttaagttaaaaaagcagaatatatatatacatatatatatatatacatatatatatatatatatggccagaattgttatatctaacttcacaaagtgtatgtatatatatatatatatatatatatatatatatatatatattcatactttatttgtacatataaactcaagtagatatatttgtgtttatatatattttcaaatacatttacacagaagaaactgagaggaaatataggtacttacttttattaacccaaattagcttatttttaaaatgtcattaaatctaaatatacctaactagggtattttgagaataaaacgttcttatttgactgaattatctttcttcagacaggagatatcagagttttgcaaacactgtgctatatttttataataaaccaatctaggaaattggaatgtaggagtttaatggttgctatattatgtagtttgtgaaataatgaaagtgagggtaatcaatgtgaaaaactgcatatataaaattagaaacagatgctaataaacaggtggttgaacaaaaaatactatggtactggttcagcacgcttgtgctgaggaaacatctggatgtgggtgttttactccaaagctagaacttgctaacaagaaataaaaacaagaaatttcttgagtgaatagagtgaatcaaaaagtgattttcaagatgatctttaagtctatattgcttttgaatgtctatagagtaatgaggctgattcacatgcaggaaaatatgtcgataacaaatatcataaatagagcacacgtgcacatacaactaagtttgttttgtagcacacccagtgttttgaaaaatattaaagtaatatttctaatttctattacccagtattcgaagctgaatttccttacaaaaacattttgatgatttttatcagaaagaaacatattttgaaaatgtatccttctgaaaatcttcctagaagtgtttattatatatagtatgcatgcaaataatatatagtttattatatatagcgtgtaaataaaagcccagttgttaccgtcatttagtagaaagcttatacaattttcttttgacgtatgaacatttcttttgcaaactaagatgacccactctacaatctacaatcactataaaactacaatacctgagtaatgaaaatattgccaaactctaatcacttctctacttttagaaatatttagtaacacaaaatttaagtgtataaaaccaaaacaaaatcatctagcctgtaggaatttgttgcaatagtatttgtttttcaccatttgccaaattagaaaagctggacctgtgatctaaaagatccaattctctggtcaatttttttatagcctgcattgtttccattgagttttatgctatcagttggtataattttttttttctgtttggccataatattgtaagcatacgaaatgggcaatatgtcaggaataattaggcactgtggtgctgaaaccccagcgtatatactgcttcttttatagaagaaaccagttacctgtagtcttgtcagtttaacttagcaaagaccatctgtttgcagccacctcttttctcagaggagcattccctcttccacaaagaattgctccatgacgtcaaaaacacttttctctacaaaatggtctctcctgtcttcatttctttctgttttctaaactgggttgctttttagagaatcagcaaatgtggcactagataacttaagaggtgaaataaaatgaatccgatagacagtgctctcaatagaatagatatgaatgtgcttagataaatgtatggctacaggaggctttcttgtggacaataactatccaaaaatatttacatgtatttgggagtctaggtttatttgcaacagtaagccaactggtatttgtcaattacatttaaatttaaatttaatttcaaatcatactgaacattatgagtggaaaataaatggttttatgtgcttagaatttaacagtttatatgtaatattatgttttggaaaaacatgtaaatggtgttagaatagttcagctattactaagccattctgggttagcagttattcaggaaaagactgtcaattttatataaaacctcttagataaatagtatgggtatatgcgaaattacacagataaataatattctgcatctttcatccctccttcccatttcatgacaaactactgttttactaaatatgacaatgtatattttaaaaccaccagaaattataatacctatatttcctgcaactggggagtaattcagagggaaactgggaacttacccagtggtgtatgcttgagtttatatgttttatacatatgttgagggaagaatgcggcaagcctgacatttctgcatatttcatggtatttagggaatttgtccagagcagagtggaaattttttgttctagccctctttgttcatatgttgccacagtgatctatgagttaacaattaatggctgtgatatttcagtgcaaaaggacagttgatcatcaaaataactcagatatatagtcctgttataatcattagaatagtatttagtatccaagtatttccaaaataaattcaataagctataaatagataataatttccatcttatttaattaccaacaaactttttctttgtagtcagtattcatccttcctttaaatgacaagttagtgccataaaaacaaggtagcattcaggaaagcaatatgcactgcactgatacagaataatcaccaaagtaagaaaaaggatgtatacttggagttaagacacctagacacatatttttataattaagtgcaaattgtaaattatttctttgcagtatgggctctgatagtggttccaggattagatttttcttatacctaaagaatattttcggaataattaacaactcatattgaatctgaaagttctcacattgggctagatgcaacgtgacctttaatctttacctagtttaaactcatgccaaaccaacctgggatcattttgggccttgagtggattttattacaaacttctgttgtctctcagttaaagttgcccccgattggtttagttttcagttttattaaagatagttattatgtaccatccaaaagtaaacaagacttctgggtaattttacttagcatagtttgttttccaaataaatttagaaataattttataaaaatgacataaatattgcttgaaaggcattaaattagcaatagtcagaacatagcttaacagagaacatctgagaagaaagagaagcaataaatgtgagtagatgtaacaaaggaatatctaacatgagaaatgtgatttttatattttcaatttgtgtccctctctgcctagtactaacagacagaaataagaactgaacatgatgtaatgaacagagaaaagggaagtcatacttcttggctaaaggaatggtacaaaatagaggcctctaacttgacatgacagaaagtatgatgggattttcaaggcatcccaaggcatcccaggggagctttagacgtagcttcctatcttataagcagtcctttttctcactgcctgcctctgctggccaccaattctatatatgaacaccatgaagaaacataatgagggcacatgtaaaatctgctccactcacagatattctctatccagggtgcaagctttgctagaggccgtctctctctaaatcctttttcttcttttcttcctccactcttactgcattctttacacatctaagtttaaattccataaagcaaagagtcttgcaattctctgccattgtcacttccataagatgtaaaattgtatattttagcccagcaagtacccagtagtcaagtagatgtgtttaatttttacattaaagtgtaaacaataggaaaaagacgatttgacctagtcaaagttgtggttgaaaggctctctatctaccatgcctcttgcatcacagtgacttaaagtgcttttctagatggcctctaggcatcacaactgcatgctgttaaattcagccaccaccagcacacacatactcttcatacacgtacaaactcattgagaacagaaaatgcaacagtgatttaaagccctatgttatctaaaaagcttcatggtctttaatcttttaaatgttttctacttgatcatggaataaaatgaactgacagtttatctctttcttctctctaccttttgctggagatttaaatatatatacatatatatattgtacatgtatatatataacaaaagaagggaaagtaataaaatcaaagatcctagaaatattccataccagataacaagctctgttgttatcagtttgtttattttattattcttataagtttgagactctgggtaatcagttttcttgattttaaaactaaatataccaatgcctccagtagtacactggatattcttaaataccgtctatgccttttcaaagtatatagtctaaaattgatgtgaataatgaacagatggactaatatgtgcgttacacaactaagattaaaaagtaacagccagtctcacaattgtttcttctgtccaatataaatgctacaagattatagacatgtaccttaggtaaatgtattttataatagggatgaaaaggactgcaaatctttaagtcaaagttagttgctttttgtttctttgtttacctttaatcctttcatggctgttacctgatgagtaagccaggaagctagagatatacaagatatataaatattaatgttataaattgggataaagaccaaaataattgctccagtagattctgtggtttttatacttgctctgtattttagcaattgtaagaaacgatctccttacaaggtgccagaatcatgtcactttattgtacataaatatcagatcacattgctcagattttttccaaacttcagaaaaattttgaaaaaaataatatgacatacactttaaattttattttattactgtggccatcaattatgtgcttcttatatcccaattataaggaactctagaagaggtcatagcgatgaagtgcctggcatatagtaaatacacaaatacttgttagaggaatcaatgactctaaccattggttattttcctaatacagtaaattagtgataatctccagtttcattattcttcctcttttaaaaatattcctttgtatacctaaatgtaccatccctatttgaattactgcccgcttccctcactttgaaaatccatacatctactacatatttttctatttgtggttatctgaactcagacttaacctgaagcagatccatttctgtccccatatcatgcctaaatttacttcttgagattactatgccctattatagacagactttcactcagggacaaagaggagaattactggtgaagagaagctttaaaaataggggctatttttcttagataacaaggattctggagacaagagctactattattggtgtgaaggctcaatgacatcagggtgtacacctctgcaagtctctcggcccttttactctcagctaaaatgtggctactatggctctcagcttgttcaagtcaggaaaaggagtgaagtggctcatttttcttcaataaagaaagcagaagctcttccagaaaaaccataacacacttttgtttatacctaattggcttgaactttgttacatggcaaaccatgatgaaagggaagcagggacaagggtgctggagataggtcagccctatcactcctgtctcattttagctcagcttagaaacctgtcctggctgataatattttcgtcatctgtgtagtccaaacttgcagtgagagcctgcttgtcttttcctcaaatgtgcttttatgaagaccaatgaaaggcttcaccgaagcctccgtgtatagattaccccatctgagattataaagaagcaatcacaagtggttgaggcaaatttaagctccatacaggataagtacatatcttaaaacatttgggggttttgacataaatcttgactcattatctcaataccatttaggtccatgctattctaactgtggtctttactatacatgtatttatagtacacattctaaatgtttattttcaatttatatacttatcatggaccattaacaaagagttggcaaaccagagccagtttgccaaccatatatcatatgaaataaatatgcttatagtctgatatttttgttcttcactgacatgtggtaaacatctctctgcatttcttgtttcttttgtttgtcattttgatgataaaatgcataattcttggtataccatttaaataaaattttattataattattggatattaaaactcaccaaggattatttttgtcatataaatgtaaagttagttgaaagcttttcaagctttattagtaatactaacagccactcatcccaactatagtgtctctataattgccaatttttactagtttacttttaatgtaattgggttagctaggctcactcataaaatattaatgtttacactgatttgttttgctttaaatgacagcaaaaaaaagacatttcttttgtcaccccacaacattctcagggagaactgtggtacgttatgaggctaactattgcttgaatattacctgtgcattacttaagggggaatctgcaaacagtttcagggccaaaaacaaaaggtcataatttgataaaaatcttattgcctgatagctcgcagacatctgtcagcagttttggtttcttttaaagggcagcacatggctgactgatctcatagtaggatttataagtataattattgccatataattcaacaaatcacttttatcactgaaaacttaaagctttccaatttttgctttttagccatttaaattttagggaaatagtcttctgtccaataaattttaatttcaaaataaagtcttcactaaaatttaagtagtttaatgacaaaatagaaatgaaaattttgtctttaaaaattttttttttgcttttgcatttagaatattctatggatataaaaatatagcagctgggccttttaggattacattgattattaatctcaataatcagttgtccttattaacattcataattaacatgcatagcttattgacaaaggtaatttgcttgcatgaaaaaaataggcttatttgcagaggctgaaaaatgctttgaaaagtgctcgttctagaggctcactgctttctaagcacactccactgtaatctaacatagacaattcaagaaaataacctttctgagcttgggtctacctatctcataaggttattatatgcataaaatgagacattttatgtaaatcagtgaacacaattcctaccacataatatgcacctgataatttatggttattgtacagaagcttatttcttagttactgggtagaagcagtttgtgtttggaaatgagaatactaatttggaccaaaataagaaacagaataaaataaattcgcataaatagatatacctgtcttaaatgtccctgaaagaattcctatgtgataaaaaaaaaagtctacagaatgatgatgagataaactgcacatcaagaaaactagagaaattacaaagaggtatttttttaaacattaaacagttacataaatgtattttttaaatttcgaagaatggacaactgtacataaactggagtgatgtgagaaggtgtcacagagcaagcaaaacttgcaggccagacagagacagaattattggagacctgtccaagtgtgcctgcgtagtctgtgacaaaggggcaaaggctaaatggaacagatgtatggtcatgtggagaccagagagcagagggacctgaccactatatccaaagcagccccacaatacacacccaacaagatatgcccttttagcctttcatcctgtttgtttcctttatatcatgtttcacaatccatactcatcttgtttttctattcctttaactgttagcaacctatctcccccactataatgtaagttctgttagggcagagtccttgtttgtcttctacagcactctgttcataaatacccagcactgtaccaggcataaaataatgttcaaaaaataaaagttgaattgataacaaagaatatgagctgaaaattaaatgattctttcaacaagcattactggataaactggggaattatattgtcaagtattaaaagaattccctgacaccttcaccctaccacattgtcttccaccacagaactgtgttgaataagctccccactgccacaggaggagtctcatagctcacagtgaagctggagtataaagcataagattgtcacctctgaagttaaaatgcatggtccaggtatatgaaggaaagatttatgagaatctaattactctgagtttttccttcttctaagcaaataaagactccatgggcaggggcaggagagaggggaagatgaaagtcattggggcttgagaagaatgaggagtgaagatgatgaaattatttagtaaaatgtaggaaaaattgtacgtccagagaattagaagagttacagatgaatctgtagaatctggatgaataaccatggctgagaaccatacagcttccccctccttccactgaaataacatgacataagtgttctggagcatacatgtcactccaaagagaaggaatagatggaggtaatgaatactaacctgactaagtacactacaaattgtcaaaattcctctcctatgggataaaaaagagctcaatacagaaacatgcaatatgcaagtagttgtttttttgtttttttgttttttttttgaaatggagtctcactctgtcacccaggctggagtgcaatggcacgatctcagctcactgcaacctctgccccctgtgttcaagcaattgtcctgcctcagcctcccaagtagctgggactacaggcctgtgccaccatgcgaggctaatttctgtattttgttttagtagagacagggttttgccattttggccaggctggtcttgaaatccttaccttaggtgatccacccaccttggcctcccaaagtgctgggattacaggcatgagccactgcacctggctgcaagtagtttcaacaggagggataaatagaagctttcaaagtttacacttgaggaaccactatggtaggacactatatgggcgtactctcatttgcaaaaatagttatacgttaagtgtaagtacatacaccaatatatatccccacacacacacacacacaaagttccggtatattcctgttttaatccatagtaatctcttgtttcaaatacttctcaattattctttcacttttgtctaggtgcttcataggtgagaggtactatgctatgtgttacctagcaatattttatatgggcaagttgatgtaaatcaattcaaaaagggaaagtaaaatcttggcaaacaaatgttttccttagctatgattattaaatctaagtactcattcatctacccattaattcattcaaaaagaattgtcccttttatcagaaagcaagagtttttctacattttattagcaattaaactaacatcttactggcccatatgaacaatatcatctcccctagcttgaacggaagctgagaaacaggctttttcatccactgtagcagaagacagcaaggaagaaaaagtctgggaattagtcatgtaaacaataatgtctgccataacaaacctcaggttaagacaaatccgcctaaccaaatcttggctatctaagctgtccagtttttcaggttactcttataactccatatcgcttaacctttttttttttctggtcggaggaaaggatgaaatgaggaagaaaaaaaaatgtaaacaaaatgaaataggctccaaactttcggacaaagtagtactttgagctattctctctagccatacctcttctcctttaatatcaaaatgcactactatttaagcgatttttgtattggatggaccttgagaacatatgactttaaatgctgacggtttattgcagcagttccatccagaaccataagaagcccaagttatgagaaactgggatagataggtcagagtgtctgcccctcctctgcccatatcatccctttctttgcatatccacttctccctggatacccacatctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtatttcttcatatccataaaaatgcaaactctttgcaaatgcaattgctcagtcttcagaggtgagatatctttacttctaagtctcttcctatccttatatttacctgctgtggttctgaatactaattttaggaattcttttgatattacactgaactgctatttttcaaatttgaaaatctctgttactgcaattacttccacacttcttaagcaacacatctattttttaactcatcctttactcatagcagtcatcaactaatttgatgataatcacttactgattcaagtgtggggtcctgcatccctttctgtgcttcatttatagcaaggtgtgtcagtctgggtgtgatttaggaggaaacaggtaacattttatacatagcaacatctcttgtccaggaaagacctcaactctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaaaaaaaaatcaccaaagctattaaacactgaatgcatcttatttttcatgtcagctaggtttatcattgtctctgccaggacattcatgatttttctgctgcaagtaatgttgagaagtttttgataaccattttaaatgccagtcaggtaaacagtcttcttttctctggacaaagctctatgtacctgtgcattttgcatattttaaaataagggcttgaattgggagaatttttcaagactacagtgaaatgtgatcctaggagactatcaccaaagcagcaaatgctaaacatgatttttttttgtattgaatgcataaacacctttttttttgcatttttctccatgatattttgatagaactattgaaaatactctagggaagagaaaagtttttaagaggtgcttttaaaaaatcaacttaattatatagttaagtcctttatttgtaaattaatttatgtaattcaagtagatatatgtgcttctttaccaaaaactgagctcctatagattatattttgcatcatcaaaattatcaacaatcccctttaacaactagtaaatgccacctgaaattttccgaaattgggatcatacagttggaaaaaaattgaatgaataaaaattttaattgactgaaccagtctccagaatgaacatcctactctgaaattatcttccagtttcctgttttgcactatcaaactctgtcttatctctttcctttttctctttttaccttgatgcatgcatatagacatatgtagccacacacctgtcactctctacacagtcatactacaatgttactagaatatgctccacgtctttcgtctgtgtctgcctcaatactggtaatctctcccctcctcctggcattactcttggagtgaaaggtagttgactaagattaaaagggaatatgagtgggacctttacaagcttcctctcctccctacttgccagattgtgttgtttgctttggaatttatataggagaaataatttgaaaatttttgagcagtgcacttcaattttcttcttcatatatgcccccaaattttgaaaacgaatatataccctcatataaaattgatagctcaaattatttttataaatttaaatggctacaaagactattatatacccttgtatacaattgatagctcaaattatttttacaaatttaaatgactacaaaggctattatctccagcctgttgtatatgatatatcatcacagatcaaatctttatgtctgcctcaaattcatatgttgatgtcctacccccaaatgtgatggttttcagatgtgcggccttaggtttagatgccattatgagagtgggggccccatgatggcatcaatgtccttataagaagagaaagagcctggagctccctcttcaccttgagaggacacagaaagaaggtggccttctgcaaaccaggaaggcgccctcaccagatctcatgatagcaccctgttcttggacttccagcctccagaactgtgagaaataaactgttgttgtttatcagctaattggcgtatggtactttgttacagcagcctgagctaagatagaaaagtgctgtaaatacatatttgtcaaaagcttgtagcgacaggtttagattattcaatttatagtaaatggtaaaaagccagtcctcattatcaaaccagtctgccaaatcaggcttactatgggtcagaaaagcctacctcaattatccattcttcttctgaattctagatagaatcacagaatgacagaattgtagaagaggagaatgatcaatcaatagatggacagataggacagagaccacctagcagaagcaggggtccttcactgagatatttttgatttagtgagaaaaaaggcacagccactttcaataatgcttatcagaactctctttggttcccttgctagactcttccagtgggagctatgcattttcaaattgccccttcgttggtataccaactaatgttataccttgagcagtaatttgctcctctttagtaaggtaggaaaagtgtgatgatgaaaacagaagttagaaaggaaaaaccagggccgggcatggtggctcactcctgtaatcccagcactttgggagaccaaggtgggcagattacttgaggtcaggagttccagaccagcttgaccaatgtagggaaagcccatctccactaaaaatacaaaaaattagccaggtgtggtagtgcatgcccctaatcacagctaggtgggaggctgagagaggagaattgattgaacttgggaggcgaaggttgcagtgatccaagatcatgccattgcactctagcctgggcaacagagtgagactctgtctcaaaaaaaaaaaaagaaaaaaaaaaaaaaaggaaaaaccaggatgctgtgaaccaatcataaaaaagagttcacatagaatttgaggttctagaaaacgatttccgtatagttatgtgtccatgtacttataagaatttatttgtgatcccaagggaacacgtacaatttgaagatccttgcttaaaatggttttaatatgcaaattcctgagcttcatttccattagtttcttattcaagcagtctgaatgaatcattggacattactttgggaaaaaaaaaacaggactaggacaaaagaatggattagtaaggaagtaaataaatattgctctaagagaagctaaagagtttaccacaaaggttgaaaactctgtgaagacatgcaagtttatgattcctttctaggtagaagtttatgacaatttgaacaaaaattagagggcttcaagaaacgaagcattctacctttccagtgatggtgttcatattagtgacaagttcagaatatattaaggaaggcacgcaaatgattgatatagaacagtgtagtcattttctccttcactgctcatctttccttaatgtttcttttttcctgatgccttaagaaaatagtgcctgtgtgaaataattaatgaataatgttaaatttgttaccgagtaactttacaatcctggtgaaactctttattttctatttcttagaaaaaaatggagatttgtttcttctatgaaagattggttctgctgtctcaggagcaaaattgaggagaaaataatattttgttcacagagtttatttagctgtgtttagctatgcttttgtaatgtattctttcaaaagctgttttcttttctctttgtcatatactatagtttgttctgtttattgcacttagtagtattgtatattcctttattttttttgtacttttccaaagagacagttctaatattttatggcatttgggatggttttgtttttcttaagtgtctttcatacactgtatcttctggttaacagagacccatgggtaagcaaaatactctgtttacaaaattgtgcccatatatgattattactctcttgctgtaatgcattgtaaaaaataagtaatgagactgcaataagcttctgtcttacatcaagttcccctagaacagcttgagattttgcaatggggatttgtatgcaagagagagcttttaagagaaacccaaatggaatgagagaagcagatcagggaagggacagaagccaagtgacgatgaagttttagctcaagtctgttgtcagcctggtcctacaaggacctctgctacatgatcagtactatagagttgtcccatctagaggcaaagcgaccaagctttgtatccccatatcagtcggctactggctgttaaggccactggtatagagggtgaggcataatttctcagacatttccaagcaaaatggattttatcaaaaggtaattttaaaaaatacatctatgagcaattagcagccaacacttccagtagctggtggatgggtgctgtcctgaccagagaaagggaactgggaggagctctggtcgcctctactagaactgctgcaccaagatactcatccaattaaaattttaagagcttttgctaaaattcattaacatctaattcaaagagatcttttatgtgtgtgtgtgtgtgtgtgtgtgtgtgtatgagagagagagagagagagagagagagagagagagaagggggtagagctcaaagctatgtctgccaagattttaggcagaatggttcagttaaataaaaggtcctggcagtaataaatctgtgtgatttatttgctgtgtaaccttgagtagttacttaacttttctgaatccagttcatcatctctgcaacgtctgtcatgggtagctacctgaggattattgtgaaaaaaatgtgtgtcaagttgctgacaaaagggagatactcactaaatgatggttcctattttatattcagtacaggttattgtcctccatttcatgacctcagacacttgctttgaaaacaaaacaaagaataaaaccaagtgagaaaatgtggctatattggtgcaaatgttctctctactgcaaaaacaaaacaaaacattcaacactaagtatcatctctgtgtaaaaaagtagatcatttagtttaatttctttaatgataaaattctcagacactaccaacgttaaagcaatgcaccattcagatgcacctttgcaccagaaaaaattggttggcattctttagagatgtttaaagagaattactctttatataatactcaactattatagtcagaaaatgctaaacatgacttggacaagcaagacattatttaagactgtaactgactcattctaaagcaatgcattatatgaccagtaggctcaaatagttggcgagttgtcatggggcttttgctttttctagcaatacatgaaatggcaatacatgaaaattcacttcagtcttgattaaagacaaaatatgccctggatctccaaaatctactataggcaaacctgtctacctagatcataatagtcatgaagtatatgcactaatacacatatgtgtactcatagactgtatcctcttcctcatacttgctcagaaacactatacttttactttacaaactattctagtttgtatgtttggtatctgaaattacaggaaaactggaagcaggaaaatgagatagaagaatggtacacacagtaaaacttcacattgtcaaattgacatctaacagcccagagcaataattcttcaaatttgtgtctgttttactagcataagacatatttgtgcacattattgcattagatctttataacacaatagaggtttgctagtcaaataaatattctcattttacatgtgaagaatgactcaggatgtttctgacactttcaaagtcacaacattaataaaatggcaaaaagggatgtcagatgcatatagtagatcacaaaatttgcatccttatcatattgttagattttaagaaaggaggatttttcctgataactcagaaagccctgtttctgaaaccatttggtaaagggaaaaattctgcacatttactactacgactggaatatgtaaccatatcttttagttaatacacatttattacacagcatccatatgtggtagccattgtgttaaactctggggatttggggatgaataagtaaaacatagcgtggccctcataaaacttatagtgtaatgcaataggcagataacagtagatacaaaaataattataatacattttgaattacatgaatgaaagaaaataaccagcagaagctacagggatggcctcttgagaaagtgctatttaatatgaaacctaaaataaaaggaatagtctgccaggaaaacaaataacacttccaggcacaaggaatgatgtgtataaaagccctaagggtggaaaattctttgcaagttctaggaagagttaaaaatgtaggaaaaggcagagtgaccaggggaagatactgagttcaaacacacacagatagatgagagatgatagatagatagatagatagatagatagatatttgagagatatatagacttgacatatttcaagcacagaatgttattattcaattcacattttacaaagattactctaacaactctaggaaaagaattacagggggttagcattagatatgaggagaccactgatggggctgtaatagaagtgcaagattgaactagaaacagtggtggaggtggagataagtgatatattagaacaaactttgcgcataaaactgaaagggcatggtgatggattagagatgggagtgcagaggtgagtaaggcaagtgacttgacccccttggctttctggcttgatccagtgactaaatagtgtctgaggtcattactgagatgaagaagactgggcaaaagtagaaaacagaatcaggagggaaatcagcagttcatgttgacacttggcaagtctgagattcctatgagaatcagatgaaattcaagtaaaaaaaactagctatggaagtctagattctgacggggaatttcaagctggagttatgaatttgaagtcaccaacattatgattttatttaaagtcaaataaacaactgctatcttccaggatcacagagagagtgatattagtaaaaatgcccaggactgagccagaggaacaccagtacctagtggtctttctactatatcacagtacttccttagaaaaatgttcaaaataagtgtaaaaagttaccagaaccagaatcgcccatatttaataataatgaaaatttcaggcccttaaagaaatattttcactatgttttcttaatcccgtgttgaatgtcataaccatcagtattgtatgcctcgggaaggtggagatataggacagaaggaagaaaccatgccagagagacagaaatcaacatgccatttcaatctttcccctttgttctttgaacttctctaccgttttctccctgtggagccttggcatcttaagatcttgattatcagaacttaagcatgaaagaatttcttgtcttgatgccttatctcttctgcatccagaggaacttcatgatgtttagataccacttaacaaatacgaaaacagaaaaactaccctaagatagtagacacagaggccatccgtattgactgtttaatagttcagggattgcacaataaaggcaactatcattgctaaattcagaatggaagaatggtaaatatcacttagtcccagaatattctcctaattccaactgaaatatacactacaaaccaagaaaaatgcagaaggtgctcagaaactgcaaagaaaataattggaaaagaaagagtgaaacacaaagagtgaaaccagtctatatgcctgttacattatttgtggttgaattttaaaacatgcatcatatacaaactaggaaaatttcttaatttaattggatttaacatttaagtatcaaaagcagaatactaatttagctgagctaagaataatgtagggaaaacctgaaggatagtataatgcactgaatcatatagcacaatataatccatcaaaaccacagagcctacaattttctcgctttatattcggttgaaaaatgacttcagagtatgtgcttataagaataactgatgagaaatctaagtggagggaagaccacttgatgccagcttcttatgataatgtataaatctaacagccataattaataatagttaaaggcttaaatggccctgggatattcagttaacagaagacaggtacacctgccaatatgaagctttgaaacttgcttagagaaagttagggcaattaacctgactatattccactcagttttgagtaaaaatgaatgttatgaaaataatgtaggtcagatattgacttgcaatattatttagagttctgatacaatatatcttaaacactgttcagtcattttgaaatctgtgaataaatctcaacatgtaatttatacagacaaaataaataagaaaaatgcttactgagtttatattcccattttggcgttaatatcatttttaaaggctgttagctttatttggaagtcagagaatttctgaattaataaagttcacattaaaataaaacatcattgttttggacatagtctacaatatgaatggactatgtataatggactatgtataatggactatgaatggaccatacatactgtatggactacagtatgaatggactataaataaatctccatagtgaaaattctcaaatctcctacacatttactgaaaaattaaaatatcattgtcattgcaaataaaatattattggcattattaataaaactgttttgggtactctatacaacttcttttagaggtattttctcagatttttgtttcatcagagttctacttctgttatttacattttggtacttttcattgtaatgtatgtgatagctatgtgtggtaacatcagtttacattataatcacctgtgttttttatatgtgtttttccactgaattaacctattaataaagtgaatattaaacacccagatttctaaaatatatatatattatgaaataaatattatcatatcgattctcactctttttatcagtaaaaggtaatatttaggcccaatttgctattgactttttacctggccattgggtgaaaatggcccaaggtttttgtaatcaatgactccacaaataaatcgtgtataatcttatagataacttgttttcactttatttcaaacatggtagcagaattgacctcttttattgtgtaatttttatttttatttcaatagtttttggggtatagctggtatttggttacatggataagttcttcctagtgatgatttctgagattttggtgcaccgtcacctgagcagtgtaccctggaccctatatgtagtcttttatccctcacctctctcctacccttcccccacccactgagtcctcaaagtacattatatcattcttaggcctttgcatactcatagtttagctttcacttacaagtgagattatacaaaatttggtttttccattcctgagttagttacttcacttagaataatggcctccagctccatccaagtttctgcaaaaagatattatttcattctttttttggttgagtagtattcttggtgtaaatataccacatttgttcattaatttgttggttggtagacacttaggttggttccatatctgaaattgtgaactgtgctgctataaacatgtgtgtccacgtatctttttcatataatgacttcttttcctttgggtagataccgagtagtgcaattgctggatcgaatggtagttatacttttagttctttaaggaggctctatactgttttccataatggttaactagtttacattcccaccagcaacactgctggtggcagtgttccatttttaccatattcatgccaacatctattttttttattcttaattatggccattcttgcaggagtaatgtggtgccttattatggttttaatttgcatttccctgataattagggatattgagcattttttcatatgtttgttggccatttgtatatcttcttttgagaactctctattcatgtctttgtccactttttgatgggattacttgtttttgtcttgctgatttgttgagttccttgtagattctggatagtggccctttgtcagatgtgtagtttgtgaatattttcttccactctctcagctgcctgtttattctgatgattgtttcttttgctgtgcggaggctttttcatttaattaggttccatttatttatttttgtttttgttgcatttgcttttgtggtctgaagtcatgaattatttgcctaagccaatgtctagaagagtttttccgatgttaacttctagaagttttatggtttcaggttttagatttaagtctttgatccttcttgagttgatttttgtataaggtgagagatgaggatccagtttcattcttccacatgtgtttgtcagttttcccagcaccatttattgaacagggtgtcctttccccaatttgtgtttttgtttgctttgtcgaagatcagttggctataagtatttggcttatttctgggttctctattctgttccctgggtctacatgcctatttttataccagtatcatgctatttgataattattgccttgtagtataatttgaagtcgggtaatgtgatgcctctagatttgttctttttgcttagtattgttttggctatgtgggctacttttggctccatatgaattttaggattgtttattctagttctgtgaagaatgatgatggtgttttaatgagaattacattgaatctgtagattgctttaggcagtatggtcattttcacaatattgtatcttcccatccatgaacatggaatgtgtttctatttgtttgtatcatctatgatttctttgagtagcgttttgtaattttccttgtacagatctttcacctccttggttaagtatattccaaagtatttgaattgttttgcagctgttgtaaaagggattaagttcttgatttgggtcgcagcttggtcatttttggtgtacagcagtgctactgatttgtgtacactgattttgtatcctgagactttacagaattcgctgatcagatctaggaactttttggatgagtttttagggtttgctaggtaaacgatcatatcattagcaaacagcaacagtttgtcttcctctcttccaatttggatgccctttatttctctcttctcttgtctgattgcctagccaggacctccagtactatgttaaatagaagtggtgtcttgttccagttcttgggggaaatgtttttaacttttccccattcagtgtgatgttggctatgggtttgtcatagatggcttttattactcgaaggtaagtctgttctatgccaatgtcgttgagggttttgatcataaagggatgctagattcaatcaactacttttttacatctattgaaatgatcatatgatttttgtttttaattctgttcatgtgatgtatcacatttattgatttgcatatgttaaaccacccctgcatccctgatatgagacccacttgatcataatggattatctttttgatatgctgttggatttggttagctagtattttgttgaggacttttgcatctatgttcatcagggatattggtctgtagtttccttttttcataacgttacaaagagggggaggtgagaggattgcttgagcccaggaggcagaggttgcagtgtgctgagattgcaccacttcactcctgcctgggagatagagcaagatccccatctcaaacaaacaaacaagatctcataaaatataagtttataaaaattgtaatctgataaaaattcaaagtttataaattcgaggtttttgagaaaacaattaattttaatgtttgtgaaacaaatatagaacatggatacacagacaatattacttaacaccaaaggcctgtctcctttttccccagcccattagcttttgattcaagaaaataaatcaagtttaacatatttgataaataataattaccacacatgggaagacattgtctgagacacagagtaattgtaaagagagttgcttcttccggccaattaacaggtgatccactggatcagctcagcttttgtgtttgcccagatactaggaaaaacttctggaaaagtggtgtcaatatcaaagggacacagactggtattgttttgtggatcaattagcaaaaataactgtaaatgtctctttttctaaagacggagccaaatttgtctacagggccacaattaagtagcataaattcttacttcagagttggtgcttcaccatcaaggtatcaataaaatccaaaatagagattcctgactaaacactttcgattagtttcttaaaatctagctgctaagtgaaaatatttaaataataaacattttaatttacttgtaataggggaaattaagatatatcccatttcagctagctagttttcctgcccttgaatacatgagagatacctgcaaactctaagctttcatatgaatgaattcaggcctcattaatgcacagtacatgacaagatagacctacatgtggtttgcatttgtatttatgaagatagccattggaaagaataagtagccatataaggaggatgttaaaagttcctacaaagaacaaacatttcatatatttaaatgcatcaattttcatacatttaactggtgtgctactgaggtcatatgctagttaggtcacttcagcatgtcctctacaatgcctgatatgggatagactacattttattggcataacaccaaccaaaattctggaatagattatatgatattctctggaaataatcttttggatcaaattaattaatgagtatgctattgcctgagctgcaatgtcaaaaatcacatttctttcttttcttttcttttcttttcctttccttttatttatttatttttattttttagacagggtcttgctctgttgctcaggccaaagtgcagtggcacaatcacaactcactgcagcctcaacttcccaggctcaagtgatcctcccacctcagcctccagagtagctgggactacaggcatacaccaccatgcctggctaatatttgtaattttgtgtagaaatggggttttgccacattgcccaggctggtcacaaacttctgggcttgagtaatctccctgctgggcctgccaaagtgctgggattacaggtttaagctaccatgctcagccaaaaatcacatttcttataacacgtttatttactttggatgtgggagacgttacaccaacaaagtcagtcatttagaaagaaagagtttaacttgaaaatttttttacaacctaaatacattaaattgatggctgccttatgatatgtctgtatttaaattgatgacaaaagtatttacagaaagaaaagagggataaggaaagatatttgagcaacatgggagggttgctgatggactttgaaggacataaatgactaatatttaatctcagtctgtctgtgttcctagaatatgaaaaccttcagtaaggtaaggtatattaatactaggaaaggccttggatgagtatttaatgaaaattatagagaagggataaattctgactatggtcaccatcggggcagaggtaaattatcctcaagaaagaaagattgaagccccaaaatccatagaggtagggagtaggagtcagaagtgatcacgaagccacatgcactggcaggagtttgaagcagttttaagaaggaagttgcacttcccataaaatatgaaagttgggtttgagctaatctgatctacatctttaagggccaagagacagagaattgaatctaagatacacaaataaatggccaaagcatcagtctccaaacaaacgtattcaaatagaaaaacaaaggaaataaatactctattttgaattttctattagtgccaccagagaaagcatcacagatgttttccggctatctcctaagctgttaaagaatatgattctgtgaaacagacctgagagaattgccttctcttttggtacaaaaaaaatctaaagtttcattttctgaaatctctcacgaggtgaagtcagtgtagaataccaaaacaggttttaaattctggaaacctaaattattctcttttatgttgtcagcaaaggtgctttattcacactaaatgaaaaatacagtcttcatttttctatatctgtgagagatttataattgaaaataaagataattatatcatgataaatataattggatgatgtccaatttaaacataaacttccatattactttcaataatgtgttttattttattttctggttctggtatatttctaagttctttaaagcatttaagttgaaggggggaaatggcagataggaggcaggactaactttcagctcccactccagtggatagagcagcatgtggagactcaaatcgtgaattttggctccaagaactaccacaggaacataccagaaagccgagagaatccacagaccctttgaaggaagcagagctgctgcaggccctgggagacagccaaaaaactgtgactgtccaaagtatgaaagggggatcatcggcctgaacacacatcctcacatcctcactggggaacctcaagttccagatcaggggataaggatttgaccttacctggagctgagacaaatttagagagctgagtaaaatatgggaatagaagaagcagtgggaagagccctgtggacactcgcggtccccagggaagccatttctgactttgtctcccaggggtccttggggagggctaccagaggaactggaaaaagaccacaggaagaaggaaatttccagctgaacttcgtaacaatttcaaccaaagtttcctggacggaacctggagaagggggcgaatcaggggtgcagacaagcacagaagctgtggcaggtggggaagctcaaaacctgaaagccctgcttactttcacagccgggaggctggttgttggagcaagttctcagctctgcctacccactgcctggaaacaaactcagtaccgttgtgggggcacagtgggagtgagaccagccttttgggctgcataggagctgatgaggcctgtaactgccagctttcccccacttccctggtgacttgcatgatgcatcagaggcagccataatccctctgggaacatgactgctttggcctgaaaaccacacccccacccccacagcagctgcagaaagccctgcccaaggagagcctgagctcagacatgcctaaccctgccctcacctgatggtctttctgtacctgccctggtagccaaagtcaaaggacataatcttttgggagctctatggccctgcccaccacctgatcctccctatactactgcagctgatgctgtcttgaaagcaccaccttctggctgaaagccaaccaacacaaaactagcacaataaacacaactacaaccaaggaccctcagagtccacttcattcccctgccacctctactagagcaggtgctggtatccatggctgggagacctgaagacagttcacatcacaggactctgtgcagacactaccctgtatgagcccagagactggtagttccactggatggctagatccagaagataaataacaatcactgcagtttggctctcagaaagccccatccctaggaaagggagaaagcaccacatcaagggagcaccctcttggacaaaagaatctgaacagtagccttcagatccagatcttccctctgacataatctacccaaatgagaatgaaccagaaaaacaattctggtaatatgacaaaacaaggttctttaatgcccccctccccaaaagatcacaccagctcaccagtaatggatcgaaaccaagaagaaatctctgaattaccagaaaaagatttcagaaaatcgattattaagctaatccaaaaggcactagaggaaggtgaagtccaaattaatgaaatcaaaaaataaaaaataaatcagctgggcacagtggctcatgcctgcaatcccagcactttgggaggctgaggcaggtggatcacttgagaccaggagtttgagaccagcatggccaacatggtgaaaccccgtctctactaaaaatacaaaaattagctgagcatgttggcaggcatctataatcccagctactcaagaggctgggagaattgcttgaacctgggaggtggaggttgcagtgagccaagatcacgccactgcactccagcctgggcaacagagcgagactctgccaaaaaaaaagaaagaagaagaagctatatcaaaaaaatgatacaacatatgaagggaaaaatcttcagtgaaatagcataaataaaaaacaatcacaactcctggaaatgagggacacacttagagaaatgcaaaacatttaagttgataatgtattttacttttgatgccttgttgtttttattactgtaggagttaaaaatcataagatcctgaaaaacataataatttcatatgttcaattttatatttgtgacttcatatattgaataatttttactcaaagaaatataactttaaactacacagtcagtattatacaaaagcattggtcacacatcagcttgagtatataaaaaattttgaagcacatctcacctaaagatatttatgctttagttgaggatataaaacccataaataaaaataaacaaaaataatacatcaaaatatgctaaattaggctatatatgtcatcaatttgagggtatattgaaagatttcttattgatccataatatacctatttatggaatacatgtgatattttgatacatgcatataatgtgtagtaatcaaatcagagtaattgcagtatccattacctcaaatgcttatttttgtgtgtgttgggaacattctacatctcctcttttagctattttgaaatgtacaacaaattattgataactggccgggcgcagtggctgacacctgtagtcccacactttgagaggccgaggtgggcagattacgaggtcaggagatccagaacaccctgaccaacatggtgaaaccccgtctctactaaaaatacaaaaaaaaatagctaggtgtggtggcatacgcctgtagtcccacataatcaggaggctgaggcaggagaatcgcttgaacccaggaggcggagtttgcagtgagccgagattgcaccactacagagtgacactctgtctcaaaaaatatatatatattgatatctattgaacttacaactaatttctcccctctagctgtatttttgtacccattaaccaacttctccttatctctttctcccactctttctcccagctttctggtaaccatcattctcccctctaccttcatgagattaacgtttttagctgccacatatgagtgagaacatgtaatatttgtctttctgtgtgtagtttatttcacttaagataatgtcctccaggctcatccatgttgctgcaaatgacaggatgtccttcttttttatgggtgaataatattccattgtgtatacatgccacattatctgttcatctgttgatggacacttaagctgattccatatcttagctatagtgaataatgctgcagtaaacatgggagtacagtcgtctcttcaatatacatatttcccttattttggacatatacccagcagtgagattgcaggatcacatggtagttctatttttagttttttgtggaacctccatactgtcttccataatggctgtactaagttacattcctaccaaaggtgtatgagagttcctatttctctgcattctcatcagcatttgttattttttgcttttttataatatccatcctattataatatcacccaactgggatgagataatatctcattgtagttttgatttgcattttttgatggttagtgatgttgaacattttttcatatacaatattgagagattgatgtaaaaaattaatcttagaaaatgtataaagatctaagtcagaaaaaccattgccagaggtttgatctcaacctcattaaagttgatcctaatataatagaaaatcagactattaaagaggtagtttctttagaattgccagaacatttaatccttcactgagagcattctgcttcttggacctattgtgtagtgtgatgcacctccaggctaaaatattaccttcaaatcagaattttataaggggtaccattcttctattcctgcttgccctgggtgccagaatgctgattctcaacatcaggtagggtccacccagttcaggtgctttttcttcaacaattcttaaccagattagtttatgtggaacttaccaaagcagcaaaagattcatgactgtttatccccttcctttcctgttcctctcctcatcatattacatcttccaccaataaaattgataatttacttgattatgtgctcagtaaagatataccacaatttctaattccaaagtttcagtttttgctcattaagcagtggatcctgtttctatgctagcagtgctgatctatcttctcaaatatcaggccccaaaaggtggccttattttcattgatttctcatgcttatttcttattattatttctcatgcttagcttttctttattttgatggttaatattacgtgtcagcttgattgcatggaaggatgcctagatagctggtaaagtattgtttctgggtgtgtctgtgagggtgtttccaaaggagattaacatttgagtcaggggattgggagaagaagatccaccctcaagtgtgtgggtaccatccaatcagttgccagcgagactagaacaaagcagagaagaaggtatgacaagctggcttgccaagtcttctggcttccatctttctcctgtcctggatgcttcctgcccttggacatcagactctaggttcttcaacctttagactcttggacttacactagtggtttgccagaggctctcaggccttcggccacacacggaagtctgcactgtcagcttccctacttttgaggtttttggactcagactgagccactactggcttcctacctcctcagtttgcagactgcttattgtgggactttgccttctgatcatgtgcaccaattctccttaataactctctttcatatatacatatactctattcattctgtccttctggagaaccctgaaaaatacagatttcggtaccaaaatctgtattatgttgtcttttatgataacataaaagagaataatttaggtttccagaattaaaaacctgtgttgctattctacactgacttcacctctagagaaatctcaaatttctctagagagaaatggaattttaaggatggatttctttagttggttttggagtttctggagttctctgtttaaactgattagacgccaaaatggtaaggactctacttctagtagtatggagaatactgatagtccttggcatgaactgtgtagacatgctcaaagtaaaggctttgagtgctgaatctttttcaaactatttcagttgaagactttattttgtgtaatgagcccagaaaacatatcagtcatagtataatagtataatagttaaaagcattggctctagagctagaatgaattaatccaaatttcaactctcccactgtgtaactggattaacccatttatgcctgaggttgcaattttttttttagtttttgcaatcagaccttggtgatgacattgagcagtaggatataaataactcccacatgcttagggttccaataatggaacactagggataaatgggctaatagctatataacatagacagggcacttaatcttcctgtgcctcagttacttcttctataaaatggggattataatagtacctacctcataggtttgtggtggggaagaaataaataattacatcattgcatggcacatagtaaactttcagtagttaatgcaactgtttttgtttttatggttacgggatgaagttttctatttcttgaacccaattgctctgttttttgttattattattagtcttttatcattattttttctggctgctgcaatacctacctgggtctttatttctcccaatgctatcataaatgttttagatcccattagctaaaaggatcctttcctacctagagtccagactcaaaacagaccacttcatgcctctccatgcctaaataagggtcccttcacccactatggtagtgtagttattatatctcttcatgcctgatgtcctgggaatataactaaaactctagataggaagaaggatcagaaactccccagcctaattgtagagaaacccattgcagcctatctgagaaatgggaattttgcttgtgtctcacacccctagcatcactgtctcctgagccataaaataacagtaaacaaagttctcatttatgtgaaactttaacagcatgcatcaatcgagagatgttcaaataccctgggaaaactattcaaacaaaagcatatccactcacacaaaaagccacaaagaaatatcctctgctcttctttcttgctcttgctcttgctcttcaacatcttgaaagagttttatggaccatgggaagtaatacgtctttgcagctgacctagttgtcttaccacaatagtagaggtttctagcctttggttccaggtattgttaccaatttgactagtgctcccaattcatcagttactggtactgaggctcatagcaatgatgtcttggctttgcccagaaacatgaacacttccaccttatcttgagccaaattaagcctatttaacctgcaaccttccatagtcaataaggttacataattgattaatttgtcaccaaggccccatactcaagtatatttatttatttttggaaatggagataacctcagggaagttcctaaggccatctacagtgtttgtcatatgaccttttaccagccctactcttatacacatttttctcaccaagaaaaatggagaatttaaggtttataacaactcccagatattgaaccaaattaccattgaaatcaatatgccctcctacatttttcttaatctgcttgatcaacttgagtcagctgtgatttgtatcagctgaaactccaggacaggattagagggtaaggaagaagttggggggaagggtcttatctccctatcaatatcagaaatattttttaagtattcatgaaagactgtgttttcagatccttatgataattttgagtacaattgaccctcgaacatgtttgaactatgaggtccacttatacatggattttttcaataagtttactgaaaattttcttggagatttgtgacaatctgaaaaaaacttgcagatgaaccatgtagcctagaaataagaaaaaataaaaggtatgtcatgagtaaattcagtataaaatgtatttagatattagtctctttatgtgttaattgactatgatattgataacagtaagatattagtagtcaagtttctgtggagtcaaaatttatgtgtggattttctatttcctgggggttttgtgctcttaccccatgcatatttccaaagatcaattgtgtttggtaataggtttgaataaatgttaacatatttatgtaactctgaaaaatacacttttaagcattacaaatgattggaaaaaagaagaattatttaataaataatctttctttggtagatgggaaccagtaaatatcaaaggccttagaaacatgtataactcaacacaggaattctattcctagaaatctttttaatgaggtaaccaaaagctccacaatttggaattaagcaaaaaaatacacacacacatgcgcgcgcgcacacacacacacacacatatttgtgtgtgtacttatatatggatcttatgatagttatataacaaaaataatatgtaactgtttaaaatcatatttatctagaatatctgacaacaaaagaaagatgccataatatatttaagtgataaaccaaagcaatgaacgttatgcaccatgtcatatgagtcttaaagatgataatgactgcatggatgataatattgctactcacttgttttattttttactcttgagcacgtaacattttccccacagttacaatgcaataaatttaattcagaaataattatttttagtaaagaggcaaaaaaaaattccctacatttgaatgtattagtctagttcatgttggctgcatattagaatcaccaggggagcatgaaaaacaaaatatctgagacctactctaacttgctgaatcaaaatgtgtttcatttttagtgtttgttgttgttcatatttttaacatggttctcaaatgattttgaagtggtcaggcccacaaaagtccacactgtcatatgggtacaactggccttgaggataatattgctaactcctcaggatcttttcagaatgaagtgaaataatgtgagtgagtgatcctacagtcatgggggaataatccatctatgggcctatttcccaggacactgatatctgagaggtcttacatcttttggaaaagacctcttgtaagtagtttggtagaagtgctatgtctcttcagcacttcttcactgccttcttgtggtagcaaatcccagctccctgactagagaggggacctgcaaccaagactgagaaagccacaggctcctatctccctagtggtccaaggagtggtccaggcttggatcaattgatcattactaagaatttttcttatcatggccagcaaattgtcaagtaagcttgctccatcccagttttccctgaccagaaaatggcactattattcccccaatatgatcagagtaaaatcatctttccttataccctacattccacccatcagcaagtcctgctggttttcctttgccacaacccccaaaacttcccacttctcctggcctccaatttaccactctagtttcgggctactgtgacacttggtgcctatttggtcttccacttcattcttatcttgctaaagccgttgtccagagagcaaaatatacttgtaaaatataaaccaaattatgtatgtaatttcttagcttaaaattctccagtgaattcacattacatttattatagaacaatatttactctctgtggcctgacaagacatacttggtttacccctctctaaattcctccatttctccctcactctcttgtttctgactgtcttgctgttcctcagacatggcaagctttccctgattttgtcttttatctaccagaactgctcatcacccagacctacaagtgatcccttcacttatttctttcaagttttactcaagtatcaccgcctcagaggtaacttccttgacctccctatgatattaattcctccttctcacctccccgaccacccactccctgcatccatcaatctctttgctttcttcctttttggttcacagaacttggcactacctgatacacgggttacatgtccattgtttgactcttgtgaagtgaaggcttcacaagggcttccaccgtgattgtgccctgtatctgtacctagttgaggaccactatttatatgctaagttagacccccattgattggataaagtcaggctccagaagggcagactaaagccaccaagcaaggaacaagaactggaagagcttttgtttccagaatcaccccagctagctctactctttctatttttcatcccttcgatagatgaaccaaaaaagtctttcttttctcttcagttagtttgaatacaatttctgtcacttgagattgaaagatccctaactaatagccagttgaagattcagtttcaggacctgaggaattttagagggagaactgtgaaatgccacatctctgtgcacagcacactagaacatgtaagtccacacagcacagactcctcacctgcccgttaacctctgaaggcacggtgggccaccattattgtcaatataatcaaagaactttttcctcccctattgagtactttgttctttgtgtgttgtgtattcccgtcatctgctgcctgaacaactcagactcagctgcttcttatccttcttgtcctttcccttacccttccagatttgcaaatcattccagagttgtgaagggaattctaatcttttaaaattgattttcccagtttctcacacacacaggggaagcaaataatgcatgcaccatattatgtattaatacctttattcctaatccaatcttaaagcagactgattatccacttatccccacccctgaatttttttattcaaatgttcatacaaagctgtcacttattcctgaatgcctgaattttaagcaaagctgatgacttcacagaactccatacacattgagcacactgaaaccacctgtgcaacaacgcaaggcagtgtgaacaggcagggagctgtgtcaaggccagggtcagagaccagctgctagaattcttccctgaacccaagggagcaagcataggttttgtggcaatcttctcaactatagcattattgttgacattttgagtttaatataatgtacaggagctgttctgtgcattgtgtgatgtttagcagcattcctggcctctaccagctacccagtgtggcaaccaaatattcctccagattttggaaactgtcccctggaatgtatgtgctcagagaaggattgagcccaattaagaatcacatgtattcaaaaaaagaacttgtgtgataactcaaaaaatcaattctatctactgggtatactactatctcctcaaaatagtcagtaagaggtcctgggtaggtgaaggtgctacctctgctttacagttggaccataaaggtcatggcctttatgaaccaataagtatccattagaagtaaaattgtagatgagtgtgatctgtttataaatttgaaattttaagggatcttattttcttcatggccccttcatttaaggtgaaactctatttatagtgccttttgtgatagaactcgggctctcttctcaaacctacattcccactattccatcgcatgtgtcctatacccagccatatcaatatttttttattctatggaaacaatttgctttcttatatctccatgtcattcatacatactgttccctctgcctaaaatatccttcccaaccttcctttttactttttttttttttgagacagagtcacccacgctggaatgcagtggcacaatctggctcactgcaacctccacctcccaggttcaagtgatccttttgcctcagcctcccaagtagctgggattacaggcatgtaccaccatgcccggctaatttttgtatttttaacagagacaggatttcaccatgttggccaggctggtctcaaactcctgacttcaggtgatctgcctcccttggcctcccaatatgcccagtcttccatattttctttgatatgttacttcttatgatactgaaaacttcccttaattcctgttccttcctggcattctctattccaggcctgtaggtttgtctcctctctgattcacctattccaatgcctattcttataaatatcagttgagtttcttacccatctccaaatgatgtacttgagagccacatcattttatttaggcagatctaaattttgtgggtacagaagtttatgcaatctgggatgccctctttataaaaaaagaatataatattattaatataaaattaggtatatttatttagaactgggaaagaaatcacaacaaatgcctggaaatttaaagactcaaactcccttgtcaatttaccagaaatgcttacatagaaatatttcctaataggaacctggctttttctaccatctagaatgctctgcagctgtcagtatctcacagcaacctgtgcagttgagggtcaccagagcctaaggttcattacatttatggcaaatctgcctttaaaaaacgtatctctgcatctccaaggcccagtacaatggttatatggtagaaggtacttcataaatgttagtgatgacaatattaaattttatttaaaggttaagaaattccatcactcttttgttccagaaaaagacattgccagaaaccacctttctcaatatgacttagacaagactcatagatgacccccttgttcacataaggcaaggccagacacagaccctccaaattcccattctttgcctcagaaatgactaatggaactgcttgtcccaactgatcagctggaacaaaatgactgttaaccaaccttcctcaagatccctgacctctggctcacctccaggtgagccagcattcagctcctcccaagaatagaatagactggcctcacggaagatattctccaacctaccagcctatcaggccacctttgattccatttccccacactgcttctttcttgctttgtttactcctcccttcagaagcttgtagaccttatggtcacctccttctccccagtgcaacattatctttccccagccttctaggaagtctcttgccacagactttcaaataaagtctctccttactaagtctgaacttgctttttatgtgacagtgaaattactgaagaaaataagtgatgaatgactgagtgtgaactcttgtcaagcaacaagtgttctttgtaactctttcccgtactgttgcaatgataatgctattgctttcctactgagcctatgtggtctctcttttgacctctgttccttctgccagttgcaatacactcctctgtcaaccattactataagcttaatctgtcaatattgtcaaacagttctgacctctaccttgattttggcttaaatcccacctttgttataattcagtctagatcctaatccattcagactttttcctgccttagttccaagaaaacatgactctgtttctaaatcaaaatagagtatgtgagttagctttgaaaaggcctgatagatacccattgcaaaaagttagtgaaaggccattctggttgcaaacaattgcatgtaaagtcttggaggcaggaatttgaaattcatgcctcaggacaataaaattagccaagttttattttaaattggtagaataatgacagaaggttggagaaagcattttatgaatggatattgattgggattgaaaattatgagcattggttttttatgtgtgaaatttcagatattggcaaaatacataaatagtatcttataatgaatgaaaaagtactgaaactagaatttgggagacatttggattattcaaaatctttgaaaaatgctgtgatgatgatgatgatgatgatgatgacgatgatgagatggagtcttgctctgtcgccaggctggaatgcagtggcacgatctcagctcactgcaacctccgcctgccaggatccagcgattcccctgcctcagcctaccaagtagctgggattacaggcacatgccaccacgcccagctaattttttgtattttagtagagatggggttccaccgtgttggccaaaatagtctccatctcctgacctcttgatctgcccgcctcggcctcccaaagtgctgggattacaggcgtgagccactgcgcccggccagtgctgtgattcttaaaatgaaatcttggagcacagtacatttttgcagtacaaatatattttccaaattttgggtaaagactaatattttctcacctttataaaatacattaattgaattctctgttgatttcacaacttcatgttaattatagaatgcagattggcatatttaaaattttcaatgttctgaacatctaactacataaaggacagttttaaacttattctttcattggaggcaggtattatgttgaaggaaactgggcagataatgaaaattctgtattggcaccctgcataggcacaagatattaatatataaaactatgattaagataacattaaattataaagtaatttttacaatctttttttatagattaacaaatacaaacttcatcagacattaaaatccattatttcagataaggaacaatgatttataagagccaagtggtggatttaacacaaactcacattttaataaaagtgttacaaaattttagttattaaaaattcaaaaaggttaacattttagatataaaaagagcaaggcacaaatcgatttaatgggagataaagggtaaagcatgcaatgcttagactttaaaaatccaattattccaattgctctgcatacattaggcagtcatattttagtgctatcccatgccttacttgtcttgctgccttttgtcaaagctcctgtttgcattttaattgacttggggaaaagcaagggagaaaagaaagggaagttgtaaaattaaagaaagggctgtgcatgtttgaaagcacctatgtgaccccctctgactatgttatgccgatgctttaaatatcattctgctccaaaagtaagatccctatcagtctggctagttttaaattgtcacttccaaatttaaatacattattttatgaaagtttatcccaccactcttaagagtacttaataaacacaaaaatcatagtagagatacttggaaacagccactaggctatacacactttccacatgctaaaagaataggccacaattttgtttatgttatgtttcacaactatttaatatctgcaaactttcatgttctcatctgaaaatgaggatggtgagagcagctttataagaaggctagtagaatgaaggaaacggtaatgcctgggcatgcctgatgaagtgcaatgtagcttccctgggagtggctcatggtgttttgttagacattctgaagtgcttttgtagctgcttctggggcagtgggtctcaaacttctgtctccaaccctttttatactcttaaaaatgttactgaggactccaaagacctttgcttatttggattatatcttttgacactgactatattttaggttaatgcatattttttttcaatatgtataataaactcactacatcccagcataaacaaatgttttatggaaatctacattttccaaaacaacaaataaagagagaatgatagcattgttttacatttttcaaaatgctttaatgtgtcgcatgaaagacttcgattcttacatcagcttctgttgtcagtcttttatgatgtgttgttttggttgaagcataggaaaaaaatctggtttcacatagatctggggttggaaaagggacggcctcgaggtccccttaaacagtctgggggacccctagaagtcctgaagccacccttgagaattgctgttctggaaaatagaagcaatggggagaagagtagagggtgtgtttcccagcactggtttgtgccaaatctgggaaaacttgacggaaaaatactagagaccctgagacttatgttttgcctccacgctgcctttaatctgattgcctgtccattgccctgccgtaacccattcccactttgctcctgccaggaagatcagaattctggtctgtactcatttggcagaagaacctgggaagagaggataagagatacttgtacaataacgccttcatattgtgcaggttttactatactacatgaggagagtggggaatgtgatttgatttattattgaatattatagatccttgaaatatacagatatgacatttacagtttcacaagtgacattgaagatgcatggcaggtagtcatgtcactttgttgaggcatgagtttggaacaggtggcaaagctagtgggtaaatgtggcaagtcactgacaagtgggcttagctgactctcagcacctccatcccagtgtaatttaccagtggccactcttgttgggtgaacttctcctaaaataattaaaattattgttgaaaggcttgggttttgaaggggttttgttgttttgtgaaaaatggccttgggaaattaaaaatccaactactattcttggaaatggaaacagaaggtgaagctatagggcttatttaaaaaataactctacatttgttttggtttactatttatgaaataattaaggacccaaatatttaaatttaaactttattgccttttatgaaggtaattaaatgtaattgtggtatccacaaatttgggcatttggaaatatcaggaatctcctgttaaatctgaatttacatttaatattagatgaatcagtgttgttattaattctcagttttgtatggtttagaaatcttttgttaaatctatttttaggagaaactgaaaagtattgattattgattataatgagtagtatttatagaaactttgtaaagtaaaagagaaacaacttatcaaatagaattatttgataacttatcaaatagaatagaaacaacttatcaaatagaattatttacttatgtaaaattttatgtactatcatctatgaaggactgaatttaaaaggcttgaaatatttgcctcacatatataaagtgctaagtgtttgctatttttatactttcttacaaataccaattttttaaaaaaatccaagaagaagaaacaaaacaagataatttattgagtacctgctctgtgccagttacttttttaggcatttggaatagactgcccagaacagaactagatattgtatgtcatacatcacaatattttattccataaaagtctccaaattcttagaaaatgtcccttctagtttctctgtgtctgtgtgtgtctttactgtaacttattcaaatttgctctcactgaaatatattattgcatgtggcaattcccagctgtttatttccatctgaaataccaaaccaaatatttcttaattactgttaactgatgatggaagtatagacagtataaaccttattaataaacttactacacatgaaaaaagataatttagcaaaacctgttggcaggttcatcctctagagatacattacattttgattatttttttattgatactccttcatatctaatagtttataaggacattttacacatatagttgaaaacatatcaacatattaactttaatagaatacaagatatagaatatgatgtttaaaaatagaagactgtaaataggatttttatacctaagttagcttaaatatgtaagtaactatttaaatatcttataagaatgttaacacatttttagaaagtcttgaatccttggtccagatcttcttatatctaatctgcttataacttttacctagaaaatcagccttagatgattttaaatgacttagcttacctacagccatctaaaaacttgttttggacttctgattctggatagatatagtttcagataattgaagattaccaaggtactgtctgcttacgacacggaaaagcttaatgtttggctaattttagttgcatttgagtttgttaatttttaatcagtaagatttgttaggtaaccttaaagttaagtcactgctactccccaacccaaagccttctcagactccccattcacacctctcacgtccaatcataattaaacactctgtgttctcataacactttgtacatatcactaatatggaatttgttatagctgaatatgctaaaactggatggcaaaattcagggaatcgaaggcttctgttaggtttctccctctaatgcttcaggtagtgccaggaaataataaacccccaacaagtatttatagggatcaatggattaatcttgaaggggcttttttacttaaaacgtaataaaattaacatggttaaaataaaagctgtcatatgacatgtgctgaaggtattttatattctatcctttatctactttatcttttggggagcatactcactacattctttttccatatggttaaaagagagtgattcaaactctctgccttaggggtgagcatgtgattcaggacttttgtagtttctttttcacccaattccccagttatgagggccaatgtattcctttattttgcttttgataattctaacggagtgtcacacacattcaatagcttcctggctaaaataacatctgcattttagaatttccccataagaaatatttatcaggttcaggttctttagaagtttaactacagtttgatatgcatatgaaattctattttattgcctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaaaaaagtgacatttttactttccagagcctacacacagacaaaaatggctttaaaactctatgcatcagaggaatgctaaagaaagaaaaatatttcatgttatttttcgtgttttcactttagcatttcaattacatgcttgttagtgtacattcttcttatgtttggggttggttttgatgagtgtagtagcatgatattttttagaatgttttattacaaaatcagccaatactgtttaaggattacattaaaattggtaaactgccaattgaaaaaaaacattaaaaatagataatatctgaataattattttaaataaaaatatgtgtttttgcctagtgacatccattctcacagaaaagtggtattgaatgtttcatggtacatctatctcacagctaagacattaaaatgtgttgagaaattagtttccttgctattctttttttttttttttttttttttgaaacagagtttcgctcgtctcactcaggctggagtgcagtggcacaatctcggctcactgcaacccccgcctcctgggttcaagcgagtctcctgactcagcctcctgagtagctggaattacaggcacccaccactatgcctggctaatttgtgtatttttagtagagatggggtttcaccatgttggccagcctggtcttgaactcctgacctcaggtgatccacccgccttggcctcccaaagtgctgagattacaggcgtgagccaccactccctccttgctattcttgagcacattgtagtaaaatgacctatttggagccagaaatgaaccagccacctacacaaactcttgttaatcttttcagccaaattatagccttaaattttaatctcagaagaaaatttttgtcactcaatctgtgaaatacaggatcaaataaatggcttttgctttaattttttttacacttcatgacatagttgcttaccatgtagaatacttattgctagcaatgtaattatcatgaacagtgtctgaaacatccatttttagtcaagttctgtgactaatcaagctaaaacatacattttcaagagatccacctgaggactgtctatccatggattttctatcccactgcactttaaaattgactgggagcttctataaaatgctctctggatgtgcctcataccaaataaatagtaatctttgaaggtgtggccttgggttatattttttaaaactctacagataattttaaggtgaaccaaggttaaataccatttatttgaaccaaatgaatattcagaaacatgttattcaatttttagtcacttgttgagaactaatttcttgacaaaaaagacattcactttgtggttaatgtcaaaaattttacctttcatttcttaatatgaaatatattgcagaaatccctgataatcacaaacacctgcattttaaaagatttccattattatgaactattttttattattatttggatcttcctggggagactttatctcactgggaggtaatctatgttaagtcttaattcaaaaaatgaaagttcttgagaaagggttgaagcatataggtcattagcaaaaagctgatgttgaaatattcactgaagtatccattataataatgaatactaaattactataagatttattttcctagaatagtaattttcccatgtgagcactctgcaatattttacagtagtaggttcacttcgagagttgtttctgaatacgtatagcatatgaactaaatcaaattggtaaaaataaacatagaagtgagggagtaaccaaaaaaaaaataaagttatatccaaccttttgtttcagaacaataaaatgcaatctactgaaataaaatatttgattaatttaagaggttggtatttagtagcaaaatttaaagcaataaaatagttttggtaatggtatttaaaagtaacctaaatttaagtatttcttctcatcaaaagatacttctattataataaaatatcaattttaaattataattcttaaaatatttattaagtgcaaagtttaatgatatactgtaccagagatataaatataagtaagagatgattcctgcctttaataaataggtattcaagtgtggatgacacagacatatgcagaaaactcgcaatgtagtgactgctatactaataaagtgtggtgatcagaagagggcatgtttcagttatgaggcattgaccaaggctgaccaaaggaagagatgttgaaatgggttttaaagaatcaggagaagttctccatagggagcagaatgggtaaagtgaatcaataaacttagagcattctgcagaaaggtaagctgttcaatagggacagaaatgagaatgtaagtgcaaagaccagctgttagtggggctgtagtctccttggccccagatcataaagggccttgaaagttaagccaaggtttctgctcttcttcccaggggcaatggaaaaccattcaaacaatgtaattttgagtttcttaagactcctgtttccttggccactttccttagcctgacaccagcttgccttcctacagccatacatgaattttctttcatattgatgattttgctaactaattaaaatgtttcacaaacaatgacttgatttcttaaaaatcagaacaaaaacagtgaatgtcccataaatatatgtacacataatttatattatttctcttaaagatgagccattatgattgaggtttataatttcttcagtatgtgcaaatactataattttgatgtataagtacaatcacagatgaaatacaaatttagtttataataagtttgaaaaagctttgcaaccaataaataatgcctacttcatctgaaaaacttgagaattaaatcagaggaaggagttgcagactaagggatttctggggaaaggctgtacaaataattaccctaagaacacagctgtgtttgctttgttgttggataaaaaatggtattaaccttaaggtttcttttataatcctgggaaattttaagttttcaaaatgttttacttgttgaaagtaagcaaattaatactacaaacaaacattcattcattcaacaaatatttatgaaacaccaatataagtgaggcaactttctagaaacagagtatgcagccaagaaacagagtagaactgtccctgacctcatagggcttatcttctagtgagggttgtcaatatgtgggcaggggtagagtcaaataatagggaaattaactggtgcacaatattaacagataatggttgctgttgaaacaagaagagattggattgctaacagagggaggaatttgttcatttttattgaatagttggagaagggttcacgaataaggtaacatttaagccatgcatatagaagagagcagcaagaacaaacctcaagtttaaaaagtgctccccgctgttcaaggggaagcaagaagtccaatgtagctgcaagacaataagtcaatgataggatgaccaacaggagatgtggacaaaatgtagagatgcgtggagcaagggagatggagccaaatattgtagggccttgctggccatttggggaccttttttttcttttactgagtgaggtaggaattcattggacagtcttacattttagaagaattaatctggcttttcctaaatctagattgtggagaatgagggtataaggagtctattgtgataacccaggggaaagctgatggatgcttggatcagagtgaaagcagggaaggcagggacacatggttctattctaagtgtatttgttttgaagacataagaaacatgaatatcaatatgtaaaatattaagttactatctacttaatatgaaaattatctccatatatgtgacaggcttttattattaccaaaaacacaataatcacaaaggcttcttcaactctaaaacagttaagaaaatatttcatatatttttcattgacatcaaacatcaaaaaggagagaggaaaaactatctttgtgattgttgtgtgtccaatctatgtgttggcacataaatacatttactttacttataatatagtatctgatctgaaaaataaactgttggaatatatgtggatgtttgtttccttctaatcatttaaactgactgtgttattgaaatcaaatttataaactgcctgcctatgtagacacccagaagcaattacaaatgcattgaaaacatcattacttacattctggccctatacagtctagaagtggtatcttttcttcctggctaggtagttattctgaatcaaggagtctgactacttccggtagaaagccaacagtgggacttcaaccattacttaaatgtaggctggagacagaatctgaaaaggttttcatttgcaaattactgcataacatactacttcaaatttattagcttaaaacatgaagcacttatgatttctcataagtctcaatggatctcagctctgcttcttcccttgtctgaagtttgctggcaggttggtaggggctagcccgtctaggatagtcttagctggtatgactcagctctgccccttggattcttctcatagtgaaggtgaaagtacatgggacaaagtgaaaaatgcacatactttttcaaacctctgcttgtgttaagtctgataatgtcctattggccaaatcaagtcacctggccaagcgcacattcatggtgtgggggtaaaaggtctctgattatttaataaaaagaacttcaaaatcacaagaactttaaagagcaaacaaaacaaacagcctcaaccacaaacacaaaaatcattacaaccatcatatctgtgacaagtgtcaagtttggaagacaagcaagtttggttaaggccttattccaaattctgaccttttgttgttcaccaaaatgtggttgcagtgcctagaacagaaaagtgattcaaaggctgtttaaaacacttccaaatactccccccaaagcttaccctggtaagcacactaataggatcacacaagatcacattttggacacttaagtgaaaaataagagatacaagacatgaaattcaagaactattcagttcagtctttggaaaaagacaaggcaatttctggttggagctgatcccctggctcttaaattgtacttgatttcttcaagtttcaataatcagatctttgaaaatttcaccccatgcactctgatatcttatactttttctcttttattgacatcagacaacagctaaattggattgccaagtatgaatcaaaataattcaaagatgattaaaatattaaggatgtctcaaaggcatgacaatgtaccagtctagcacactagtccagaaaatgtaaccaagtctagtgtagtgttttccagaaggtcttttaatataagcaattaatttttaaaatgttacaataaaattaatataaacttcatgcctagaatctgttaaactcattcttcctcctgataattattccaattaatttgtggtcaaataatagtgattatggaaattttagagattccacatcttcttattctgactataaaccacagtctgggtaatttgctgcatcaataatgtcaaaattaataagctaaagtcaaaacagtattagaaacagttttaatatttactacaaatatacctaaaatctgctttagacaagagagaattaagtaaataaaagccaacaacattaagaatttattttgttattaccaaaaactacatataacatttcctattatccttgattcaacgcttttgccagttaggactccaatatgtacttacccatatcccaaagacccgtattctgtatcctgatgcctctttctcttccttccttgattaatcattgctgtaactgctgtagctgttctatagcagttctctcttttctgccatagatggaagccattttgaaaattctaacttccagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaagaataatggctagtttagagatggaagtctgaaaaattcctgaatctaagcagttaaccttctttctatgttccttttgatgagattctgtactgtgactatttgtaaatataaaagcagctccctgagacagatggttatttacagtgttttctctattatgcaggataaattattaacaagaaaataattgaatattgaatatgccctggcaaagaaataatctttcaccaagtctgtcacacagtatgctgcaagcatgcattccaattagtagagtgggccaagtagattaatgtatcaaattgtttaaattcatgattcaatcctactttccttaagaacttagtacaattgcaaatcaattattattcaagtttgttaactttctgcaaatttcaactatattttatgactcatggatttaaatcataattcaatatgcatataattgaaaaagttttctcaaaagcttgttttcatttattttcattttgatagcattatatcacagctgatcaagtaatttatcatgttaacatattaaaatgcattcataggaaatattttacctcatttttataagtaattttttaagctaccaaggattggaatagaaaagaacatagttaggagagggaatagccaaattattttcatatctttggatcatactatcaataggagaaaaagcaaaactgtttaaccattataaaataacagtagactatatcaatggttctcaaagtgtgcagtacctggaaatttgtgagaattgcaaactctatcaccccagaacttctgaatcagaaagtctgcaattagggcccagccatcagtattttgacctcaaactgattctgatgaaaaggtaaagttgcacaactactctcctattgagcttttatctcttcaagcactgttgcagtcatattatcatttaatctacatttaaaagacaaagtattatcacaatatttaacaaatgagaaaaatgaaattcaggaagattatgattagcttcttcaaagctcctcagctacattgatggcagaaccaatatctgatttgactttcactaacatttgtctccattaacaaactcataattttcagcctaaatggatagaaacattaaaggaaaaggaaagtctaagtcagctgcaaagaattatgttacatagtttctgctatggagccaactttcattctttcaacaagtattataccagggactatggtaggtacaggagatacaaccagaagcaaaacagagttctttctcttatggatcttgccatctaccacgagaagcaggaaaaaaaaaaaggataatttcactatagaagaaagtatataaaggatgtaaaggtcactacgatgggcacataggaaaaacgcttcttctggctctaagattaaaggaagaggaggcaggtggttcctggaacatgaggtgtaactaatctttcagtagagtaggggagaaaatatcttaatccataaaaatagctaaagatgtgagagagaagaatgggcatgcatctttattatcctgccatttgttatctaaagaacagtgcaaacatttttaattttcattattatgaagggctattgtctgtatattatatttatatgtatgtgtatatatatttatatgtgtatgtgtgtatatatatgtgtgtgtgtatatatgtatttgaaatccaaaatgttttcaattgagttttcttattagaatgcaataatttaaatattttagagcataaaaattaagctaatattcattcagtttattaaaaaactataatttggaagattaaaaacaaaaacaatagttcacagcttattttatatttgtgggaatcagatacaaaaaaaaggtgacttgatgcccctagaaaatatttacagtcaatacaaacatgggagacagctttgaatatggtgtagaatacatgttaataaaaatgtataatatacacaaacttctggtctgctgcagtttgtatagcattatgaaattaatgaaaatatattattttcataacaagtgtcagcaaaatgcagcacagtaatgttaaactattctatttttgcagattcaacctcatattcagttttctcttacactccagcattacatatgatgaatgtgaaaaaataaacaggcaaacacctaatatattatagcagatggagaaaaaatagctaaatcggaatgatttccctaaattttcagtatgtgaagcaatgaaaataaaaatttaatattcagcctcctcattttaattatttcacaacagtgaacccatagtgatcagggtattttgtgtattaaattatattgtttggcattattgttacgtgattctagataatatttctatcagctaactaatttctacattaaccaaaatgtatagctaataggccaataaacatgacgagggaaaagaggactttctaaccctttgtgagtccacaaaaatgctcatttctagaaaaaccaaagaatacattgacctcactatcaatcaggtaatgtcaatgttagctgcagctctggctgtgcacaaattctttttgcaacaaggtgagacataaataaatatcccgtcagtgatattaaatatttattacattaaacttttaagtattgaaaacaacttttaatctcaggaagaaatattatgatagtttaaaattagttcataaataattggatatttatagatacagtaggttgctttcagagtttgctctcagcagggaattaaaatgcacctctatgcacatgctggtgcagaagagatgaaatgcaaaaccaagatctctccagaggacaccaacattcttggacaatttccaaaaggaggcacaaagtacaggctagttctaatttggtgtctgatagccaagagagaaggccattgttgtggaggtgatgaatggggaggcaatgaggaggggtcattacagaaatagcaagcagttgtggcagttttttgagttaaattttacaaagaatattttgaaaacaagatgggccaaacagaaccaaaccatctgtctatcttgggtctcaaagctgttggggaagagacagttattgagaaaccatatccatcccaaagatcttaaattggaagcatagtcaaggggttataatgccttctttggttgacaagttctaacccgcttcagtctattacaatctcagatgttgtctgtaataatgcttggtgtcctatgtcgttggatccagacatcgttggaataaccaaccatgtcccagaacagtgcttaatggaaacaactaagtgagtctaggattaggtcagggtttgatattatctatgctatttattgactaaaatatttcaaatgcaatctagcctggaatagaaaggtagacaagtcaatctagaatagaggtaaaaattattcaaattaattttgcaagtggatgttttaaatgcatgtctattatgacatgttttctagactctttaaagaactatgtcagatatgaagtagtatttattcgacttcagagtgaactgagacaacccatgatttagaaatgaggcaaaaattgtctcagaatagactacagttaaataaataatacttataagtttataagtattgtataacgatactcatgcatataagaaatcatggtatttctccatttacaattttgaaatttctattttcctattaaaataaagaaaaatacatcatctatgctagagggcttcatgtagccaagtggcattactccagcattgagcccccaaaagaagaaaagaggtgataggataaggaaagagcacaaagaaacttgcagtaaactgcacatacttttgtccttcaagaggcattatattttccttaaattcattgccagttttccttggggaccattgtctgttttctttaagagaatgtgaggatatatttatgtattttaactgctaaattaatagttaaaaattcaatgtgacttttatttctttcaaagaatgagattaaaattttaaatggtttcttttattaaaaagagactatatgcagttttatccaaatactttttctatgtgtttaattattgtataaccactaaacatattatataatttgtttttatgcaatagtagtggatatgtttttaaaagtttaactaatatatttttaagatgaatagaacaaacatttaatatcacttaaaagtgatattagaatgtactaccctgcactaacagctatttttgttacataaatctttaaatacactttcttattcttgcagtcatagttaaggaagaagttgtagaaaaaaagtaaacatatggtagatgctatttattcttttttctggtaatatgaaaagtcaaatttagaatttcaagctagaaatatctcagagagtatagtatcttttaccttaaatatattctaaattggtatgaaatatttcagtatctcatccaaacttgtcataaagttcactttattattttcattttcttatttaatattctcttctgataactgcaacattcgtggtgaatgtgattcagagttttcagtggctgtgaaaagtccagttagtcatagaattggtagctatggaagaactttggagaatatttcagattcttatagtgtgttgagaaatataaatcattgcattcaaatattaactaaattactgctcacctctgactgtgaaggagtcggggggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaattgacttgcaggtatcaatacagttactctaaacacttccacacatattattgattagagtttaatatttccatgaggcagtgcaactcaaatctctaccagatatggaatgttattgtcccagaaaattgttctctcgtgccccttttcactcaatctccatctacctctctcagctgcaatcattaccagggtggttttcaaccatatattagtttttgactacagtaaagctgcaaataaatggaatcttttgtgtaagatttcttcatatgtgttaatgtgtatatcagtttatcccttatttctgagtagtattctattatatgaatatattggtttgtttacgaattacgctattaatgtgggcatgaggtgtttttggttttcagatattatcaataaagcttctgtgaacattcttctacatagtctctcatgaaagtgttttcatttctcgtgagtaaacactgagaaatgtaaagcctgtcatagggcaggtataggtttaaaatgatctcataacttttctcataataaggatataatgttatattcccactagtaatttgtagaagtttcagttccacatcctcaccatcatttggtgtgtcaacatttttaagtttagctattctggagtgtgaatattagtatctaatagtagttttattttgcctttccctgatgtctaatgatgttgagcaccttttcatgcacgtattggccattcatacaccttttttaatgatgaacctactcaatattttgcccatttttaattggcttgtttgtctttttattgctgagcagtagaacttagttatttattgtagacatcagtcctttgccagatatatgttttgcaaattgttttttctagtttgtggcttgctcatttatttcttttcttttacggttagtgcctcttaggacctgtcctagaaacctctgtctacttcttatttgaaaaggtattctcctttgctgttttctaaaagctttatagttttaatatattgatctatgatccatctgaaattaacttttctgtatgttataaatctgggcgagagtttttgttgttgctgattgttacctgatgatttcagcaccatgtgtttaaaacaaacaaacaaacaacaacaacaacaagaacaacaacaaacccttaactgtccacactgggttcctttggtgcctttattaaatgtgaaatggttgtatatatgagtctactttctattgcctcttcagtttgttacattgatctattgtcaatttttatgccagtaccacactttccttaatgtagcattataataagtcttaaagtcaaacggttagaagtcctccaaagctgtttttcttttcaagattcttttacctattcaaagtttttattttttgcatttccatataaattttaacatcttgtcaatttgtttaaaaaattatgggaactcttttggtgtggaatgtatagattaatttgggcataattatattttgtatcttgcaatccgtggaaatgatgaatctcatgacttatttagtgttctttaatttctctaagcaatttttgtagttttcagtgtaaagctccaatattgttttaaatgcattcttaagtaatagcatgtattttcatacttttatatatagaattctctaatttttgaactgctgctagtataaaaaaaatgtgatagatttttatatacttagctcataccctgtgactttggtcgtttcacttattaatcatagtagttgtgttgtcaagttcttaggatcttcttcataagcaatcatggtatctgcaagcagaattttctttctttccacttgttgtgactttatttatttcttatcctattgcgctcttaagacctccagtaaaatgttgaatagaaatgatgtgaataggtattcttgctttgttccccattataggttaaaacactcaatatatgaacatgaaatatgatggtaattgtagtttcttaatagcttctcaatttgctaagagtgttatgaatgagtgttgatcatcaaatgcttttcaacattcattgaaatgaccatgtaattgtttcttatttattctcttaatatggtgaatgataatgatttttgaatggtaagccaatcttgagcttttgtaaaacagcgaagataaacaacattatcatgatgcattgttctttttatatattactggattaatttaacaataatattttcaagggatataaaggacattaatatatggatttatatttgtaaatgttgtattaatggtattgttgccttcataaaaccaactgggaagtgttctcactctatttgatgcaagagtttgtttggattgatgctatttcttccttaaatgtttggtagccttcactactgaaaccatatgggcgtatagtttttctttatagaaatattttgataacaaatgaatatataatagatgtagagctactcagattttattattcatttcatgtttttataatatttatttttcaagaaatttgttcattgcacttatgttgtagaatttcctggcatgtggtagatattttatttttcatttcagtaggtttgggagaacaggtgatttttggttatgtagaagttctttagcagtgatttctgagattttgatgcacccatcactggagcaatgtacactgtacccaatgtgtagtcttttattcctcacccccctcccactcttcttcccgagtccccaaattccattatatcatgcctttgcatcctactagcttagctcccatttataggtgagaacaaatgatatttggttttccattcctgagttacttcacttagaatagtggtctccaactccatccaagttgctgcaaatgccattatttcgttcttttttatggctgagtagtatcccacagtgtgtgtatgtatgtgtgtgtgtatatatatatatatatatacacacacacatatatgtacatatatatcacattttccccattcatttgttggttgatgggcatttcaactagtttcatatttctgcaattgtgaagtgtgctgctgtaaacatgcgggggcaagtgtctttttcatataatgacttcttttgctttgggtagatacccagtagataccttaatattgtaccacaggctcctgagacactgtttattatgtttcaatcttttaagtttttattcttcagattggattatttatattagtatatcttcagccgccttcctttcttcagttttcttttccttcagttagttatcaccactctgctattaatcctatctagtgaatttttaatttcagatatggttctattatataatttcaatttggtattttatatagtttccatttccctactgagtatttttatttttattctttgagaacataatttcttttatgtctttaagcataattatcatagttatcttagacttctttgctattaatagttccaacaactgagtcatcttagtgttgtggagtattacctgttttttctcttaaatatgggtcacattttttttcttagtatatcatttttatttgtattttggattgttttaataaggttgtagatacttttaattttgttacttttttcctaaggagggttgattgaattcattttagtaggcatttgacttggatggactaaaactacaagtctgtctcttttcaggtggccagcaactcaaatatcagttcagttgttttaactgtggctgggttgtttggcatttaccttgtgcattcctgattcagtggtcagccagatatttgggcagaaaaaaaatacatatatataatatatatgtatataacatagtgtatatctacactatataattatatatgtatatatgtgtgtgtatatatacacatatagaaataaatgcgtacacacacacgtatagctttttttttttttttttttttactttctggctctctcctttcctggattgtcacctgcccccctcacccctcccccacacacgtttcggcagatataaccctgagccatttccttcttccaggcgttcactctccttcactctccacctgcctatttgatttttggttggtttggttggtgtttattttgttttgttttcgtctccggttcctttgtgtagctttgtttttgtactttgtttttgttttcgtctgtattcctaaatttggttgttttaataggagatgaataccataccaaaagcacaattcccacaatgtgtgtttgcatttgtcttctaagtgaactcctgaattatccagctgcgttatctacatagagagccagatcatctgtctcaggcagttctcctttgaccagatctttccattatgaaagctcagggacattaaagtggttctcaaatccctttgttaaagaactgcgccattttactaagattatgtaatttttaatcttttaatacaaaggaagaaaattttatttagcagaggattaaactattctgctatgattttgtagctaaattaaaagaattatacttaaagatttttgttctgattagtgggtagtgttatttttatattaaaaaaacagataaaatctcagtccataacttcagggacaaaggaaatataatttttaaaaattttctaagtgataaaagactatacattgggtacagtatacacaggagatgagtacaccaaaatttcggaaatcatcactaaataacttatccaggcaactaaataccacttgttcccccaaaaactattgaaatgataattttaaaaagagctcccagaaaaagaatatctaattttttttttttcttttcattgtaagcctctaccacctggtaggagaaggtaatagtaaatttggtatcttctccgttttcttcccagggagtatttccacatgctactgtgttatagatgccaaacattagagaaaataatttagtccttggttcatctgactacactggcatccattaaaagtctattatttctttggttatttgtcatctatgcatggctttcttttcatcttaaggactcctattaagtcttgttctctctctcagctaactcctgggattctctttacagcatgagttcttgttcctgtgtccagagatctgttatcatgtttctaatttcttgatgctacttaccctcaaacacatagtgcctgggtatctatctttgactattcaggcattagccctttctcttttgcctctctcctggcaccatagagtatggtaaaattctgagacttggccaggtgcagtggctcacaactgtaatcccagcactttgggaggctaaggcaggtggatcacctgaggtcaggagtttgagaccagcctggccaacatggcgaaaccctgtctctactaaaagtacaaaaattagccgggcgtggtggtgggcacctgtaatgcaagctactcaggaggctgaggcaggagaatcgcttgaacctgggaggcagaggttgcagtgagccgagatcgcgccactgcactccagcctgggctacaagagcaagactcagtctcaaaaaaaaaaaaaaaaaaaaaaaaaaaaaaaaaaaaaaaaaaaaaaggaaaaacctgagattttgctgctgcattcctgaaactccctcaggactgtaaatacctccctctccctctctttttctctctctttcctttctccaccagcccctcccacgataccatcacataccgttcactcacacagagagctaggcttcagaagccccctggaattcccaatactgatgcactccctgattctcttcctgtccctggagaaggacttcttttctagtctggcggctaagaaagctctgcctttataacaaaactgtttatactcttagtctctcaggatttagacttctgaaacccaaaagctttgctttctgaaagtgtggatgtgagaataaaaatctagcttgaaggaagtaaagttataagtttgataggaattgagggggaggaggtagtgaaaattagttaattttttggaacactatcttatcacacacatttgccctttatacatttattatttttgctattcaaataaaagtaacaatatgtattttaacagagtaattttttatttgtgcttattaagttaaatttttcttttttctatcatcttggatataataaacgaagtgtaaatatatgtatatacctgtataattacagtcaagagtttaaagtttgtattctaacttgtctcatttataatttttatgctaaagaatgtgtgatgagagacctctgtggaattttgatgcaaatgtcaaccaaaaattcttggtagcatagatcatctgtctaattcaagacctaatgctgaattattagacaaacatctctgtaaatacaagattggtttatttttatcatgaataaaggggaattctcatacagttttattttactgtcctttagaccttacagtttaatatctaaatattagacatttacattagatatataattagactatctatctgatattcattagatagcctaatggatttgtcattattgtccttctgtcactttccatgtttaaaattttcccttattattccagcatcttcagtgtattatataagaaaaacatttatcaaactgctcttagcatgagaaaacataatataccaaggaaacaggagggaatttcagaaattagaataaattaaaactttgagttaattttttgaacgagtttttatgtttaaaaatgtgccatatttgtagggtctcttgaattacctgtaatatactataattgatttcagcttgatatgtattttttaacgtaaaaaaagatttcatgtactttgaagagtctttgttatcattatcttaacaataatgtgatatttatgttttaattaccacaaaacagcaaccaccacagactaactaaaataaactttgtatagcttccatgctacacacaaactaatcattcaaagttttctcaggatgatgaaatttttaagatcatgttaaattaaccataattttaataataatttatgtcaaaacaatattttttctgtatccttcatctccgtatctataaaatgggggcagggttgactaagtgattccaagatcttatttggctctaaaagtatttgattctaataaacaatgaaataaccgcaaataccactaagtatagacaatgagtatcaaaggaataatgacgcattgctctactatataaataacctttttttactgtaatcattctttacctgctattgtgaatcagtagttttgatgttaaattgtggtgtttttaaacaaacagtatcattttattttattttattttcctcagttttatttaggtataattgacaaatgaaaattgtatacatttaaggtacacacgtgatattttgatatatgcatggattataaaatgtaacaagctaatgcctctatcacttcatagttaccttttattctatagtgagaacaattaagatctactctttaagcaacttttaagtatacaatgctttactattaactacagtcaccttaatgtacataagatctccaggactttttcatcttataacagaaagtttgttcttgattgaatggttcactgagggcacaggtgcaatgaccccacacatgcataaattttatatatgcattttagcttcttgactcagcataatctctcatctgtcctctccggtgaattcttaattactgattatttatgtctttacctgctttgtttgcaagttttgcaagaaattttgcatattattgtatgtgtgtgaatgtgtgtatagcaatgaaatcatttctgttataagcacttgatagaagcatatatctttatatcagtcttgcgatttcagagtacttttgcatatatgagcgatcctaccttattttattgcctcacattgcaaaataaccttggctgttatacttcaaggtctcaggtgttgagtcattagcagctatggaatagatcagaattatattacagctgcacaactacaaacaaaaggtaatccaagatctttcaggcttaacatcagcatatggacaactccttagcacttggctgaaagaaagttaattcgggaatttcaagctaaattccctcaggatgacttctctgaatgatttttaactcctgtaatacaaatagaaaggcatgtgaaaataaatagtatgcaattaaaacagagagcaataacacagatatttgtgtatacatcttccaaaattggtcattttataaagaatgtattttagcatatttagtttatacatgcatgcacttgggaattatttagttcactgacatcctgggtagaaactagtaatagaaacagatctatgacaatttattagaattattaagtctatacttttaaaattaagcacaaagtggcatctaccagaattataaacaagaaactgaatttcagaacatttaaatttcagaaatctgtgtggctgtctggactgttgaaaccacctcctgttcttcctgcttaaaccctctctctgcctatactcccacccatatgccctaaatccatactcctcctaataggcaaattgatcttggagaaatcagatcaaatctcctatataagaccaagaatatttttccagtgtaccttatataaattaaaaccatctctgtggactctaagtgctgtcacgactgcatctgcctcttggacttcatctttcactcctctctcctcagcattgcagccacactagcatggacatgccaagtgcatttctgctatgctcactaatccatttgcctagactgccctgcccctgcctgtggatcttctaattttttttatttaatagactttatttttagagtagttttaggtttacagaaaaattggacagaaggtataggaagttttcatataccccctctcctttctcacccccttacactatattttgtattattaacattttgcattcgtatggtacaattgttataactgatgaagtaatattgatatattgttattaaataaagtccattaaggtttactctttgtgctgttgaagtccatgcattttaacaaatgtataacatcatgcatccatcattatataacatacagaatagttttactgccctaaaattcccctgtgtgccacctatttatcccttcttcttccttcctcctaaactcttggcaatcacaaattctttttactgtctctatatttttgccttttccaggatgtcatatatttggaattatatagtttgtggcttttgcagactggcttctttcactaagcaatatggattcaaggttcccctatgtctcttcatggtttgatagatcatttctttttagcactgaataatatttcattttatggctttactacagtttgtttatcatttcacctattgaaggacatcttggctgctttcgtgtttttgcaattatgggaaagattgccataaacatcaagttttcaactcttttgagtaaacgcttagaacaatattgatgaatcatatggtaacagtatgttaagttttgttagaaattgccaaactgtttgccaaagtggatgtacaaatttgtattctcaccaacaataaatttgagttcctgttggctccacattctcaccaggatttgttatatccgcattatggattttggccattctaatcagtgtacagtagtatctcattgttgttttaatttgcaatttcctgatgacatatgatgttgagcatcttttcatatgcttatttgccatctgtgtatcttctttgatggtgtgtctgtgcagatcttttgcacactttttaattgagttatttattttcttatgattgagttttcaaagtttgttgtacattttggatataacccctttatctaatacatgttttgcaaacattttctcccagtctttagtttatctttttattctcttaacatgtcatttgcagagcaggagtttttaattttaatgaggtacagtgtataatttttttatggatcaaacttttggtactgtatctaaaaagtcgtcaccaaaccaatggtcatgtagattttcttttatttatgttctagaagttttatagttttgccttttacatttaggtatataattcattttgagttaaattattgtgagttctaataattttttattgctgtttctcatttgtattctgattttaatgttaagttctcaaaggggcctttcctaatcatcctagctaaagcagtccctcccaaccaatcactgtttgatccattattctaattttcccctagcattgccattatctaaaattatattgttctttatttattttcattcttactttttatttctctataagtcctacgtgagctgagactcagtttgttttgtttactgctctacccccagggtctaagacactacttgaaaattatttagtgaataaatgaatgaacaagaaatgcatttaacaaaactcacagacacataatgatatatgttcaagtccttatctatgagtgtctttgtaagtaacaaagacagacaactaataggaatgaaaactagggtagcgaagaggcagcaacattcaaacaaaagtattactattttgtttgttttgcctgtagcatgtattaagtccaactgaatctagaatacgttgccacaagaatgttagtaatgttagctagaatcttagtaatgttgaatgatttgcatggaagtttttcaagtcccttatctattgccaatagatagactttatttttggagcaaacctatttaaacattgtgaacagtcaacagagctcaacaaattagatatagaatgaatgttccacaacagagtaaaagccatatatgacaaccccacaactaacatcgtacctatggtgaaaagttgaaagctttttctctaagaccacttctgttcaacataatactgaaaatccaagacagggcatttaggctaaagaaagaaataaaaggtatccaaacagaaaagaataaagtgaaattgtctctgtgtactgacaacatgatgttatagaaaaaatattaaataatccaacaaaaaatgttagaactaataaacaaatttggtaaagtttcaggatacaaaatcaactacaaaaaatcggtaatgtttctatacactaacaacagactgcctgaaaaaaaaattaagaaaacagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaacttttaccaaaaagataaaaagctaaaaagatttttaaaaaaagattaaaaagattaaaaaatagataaaaagataaaagctggaggcactatactactggatttcaaaatatgttacaaacctataataatccaaacagtatgatactggcataaaaacagacatattgaccagtggaataggatagagagcccagaaataaacccatacatttatggtgaattgatttttgacaaaggtgcaaagatcatacaattgggaaaggacagtcccttcaaaaaatgatattaggaatactggatattcatatacagaagaataaaaataggctcttatttcaaaccttgtataagaatcaactcaaagcaggttaaagccttaaatgtaagacctgaaactataaaactattaaaagagaacataatgggaaaatatccataacattgactggtctgggcaatgatttattggatataacctcaaaagcacaagcaccaagagaaaataaagatatcacaaataaatggaaagatatcccacaaataaattcttttgtggattgaaagaattaatagttaaaatgtccatactaccgaaagcattctatagattcaatgcaatatctatcaaaattccaatgttattcttcacagaaatagaaaaaaaatcctagaatttgtatggaactacatgggcttatatcagattgaaagcttctgcacagtagggtaaacaacagagtgaagagaaaacccatagatcaggagaaaatgtttgcaactcatatatcaaacaagagggtaatagccaaaatatacaaggaaatcaaactacttaataagtagaaaaacaaataaccccattaaaaagtgagtaaaggactcaaatggacatttctcaaaagaagagatacaaattgccaacagatacatgagaaaatgctcaacatctctaattataagagaaatgtaaattaaaaccacaatgagagattgcctcacacctgttagggcaactattatcaaaagataacaagcgttggcaagcacgtggagaaaagggaaccctcatacactgtaggtggtattgcaaattaatacagccattttggaaaacagtatgaacgttcctttattgtgagatccaggaatctcagtactgtatatatatatccaaaggaactgaaatcagtatgttgaagagttgtctgcactcccatgttgattgtagtactcttcacaatagtcacgatatggaaacaatataagtgtccatcagtgcatgaatggatttttaaaatgtaatatatttacacaatagaatactattcagccttaaaaaagtaaatttgtcatttttgacaacatgaatgcaactaagaggacattgtcttaagtgaaatatctaatggcattttagtggaaaattatgtaggaccaaccatgtcatccaaaaactcaatattttatctttcggggctgaaagaagaaccaacatgactgaaaataaataaattaacagatggcatttgaatttatgataaaagtaaacaatagagaaattatggtatggcttaatgaatataacaagaggcagcaagcatctgaagggtgtgtgtgtgtgtgtgggtgtgtatgtatgtatttatttgtgtatttatgtgtcattagatataccattagcttctagatttctgcattaatacaggccatgcatggaagagctgtataaaacgcttttccctatgctattcggcagtaattttttgaaagtcagagatggctgcatgtaaatgttactaagttctaccaatctctaaaaatcacatttaataacaatttgccagactttcatttatagaaagaaacagaattatgttagaaacacaataatcagctatttgtcttttcaatatcttctgggaaaaatttgcagagttttaaaaatttaaattatcatggtggacatttatgtccttaaggtatccatgtaatatatagatagcaaaatatctttgtttcagtttaaacatgaaaatccaaaattagcatatcataatcaagggaattgcctaaggttgtctttctgaaaagaaatgacgtttaaaaatttttgttttaaaatcttatgataaaatcaatgggactttttcataacttagagaagaaaataaaacatctagcctaatgtgacctcccaaatatagaaattgaattccattttaaatgatttcttttgatctttggacatatgcctattctttgcacgattatggctggaattggtgagcatagaattgtgtgtgcacactaatgtgtgtatgtgtgcatgtgtgtgttttgcttaaatgacattattatttattttttgatcagtgaaatgtctatcttttctgaagcatgagttttttactaaatgcaataaatttagtgtacattcaatttttcaaaactatttcaatccactctatgccaaactacaaattgtaatgccataagaattatattgcatgtattttacaactccaatctacttattggaaggagggggtggtgaaacatatgtcatgtagctgttaaaggagatctttgccaggtacttctaaagaagattttaattcaggagaaaataattgcaaagcagagaaggtctgtgagaagaatctatcttgagcacttaagctgaaaccagaagtccaaacaatgacctctgaatcatgggggtcaccttgtatcctctatttatctttaaaattgaacttatcctgaaatgtttgcttaaaggcaaatgttatttcctgatcgagatcttataatgaattaatgccagagacagaacttggattaaaggaaagagaatgtcttttgacttttaggtccgttattatcaatatgtttagtttcatagcttgtctcctattggagtcttaattcctttaaaattggaatttcatcacactcatctttgtatcccttagaacaccaggtacaagatcatgcacttaaaaatgtattgacttgaataattttccagtgcagtctacttgtctacataaatattgttagcaaattagacatgaaatggtaacattattgaacattggctgcatcttaaccatcctgttaatttcatttgcatagtctttgttcaagtattttacagttcaagctttcttttggaccataatccaaacatatttaaaaagtaaaaatgaagtcctttgtgggtattttttactttcataggagaaggtgtaatttaaacctgttggttgataaaatacaaaaagtatcttgggatctaagtttttcttcgggataccaatttgagtggtctgtcactttctgcttacaacatactgtgcttatcaaactaaactccccaaaatggaactcacgagcctctatgatatggctcctgactacatgtccaactttaccttcagtcaacctatggcttctatattctcatgagtgaacgtattagctttctactcctagaatatctcaactttgccattttaggagttttcacttgctttcccatatgcctgaaatgcatatgcttgattagtcccgtggttgtctccatagcgccctacagttcttggatttaaatatcctagatatttaaatatcttgtaaaggggtgttttctgaccatcttatctataaagtagctccccatcagaggtacttgctgtcacagcacattttttatttctttcacaggatgtgtcacaataatgatcatattcagtagctgtcttctaaaacaaagtataagttccatgagtacagtaacctttttctacctttttcccgaatatacccactgcgcagaaaacagtgcccaatagaaagtaaaagtctaggaaatgatttctgaatgaaaaaacaaatatttactgaaaaactgtgacttttgagatcttaatttaagcagtaaattaatttgaagggtaaagtataattctgatacttttttgcatttttgtcttctctaaaaccaatgactagttagtatacatgttgtaagccagccaaactgcattattatttcaacaattaagactataggacataggaaattaggaagttttccaaagtagtaatggggataaaaaaagaattttttagctttgtttttattcaaacaagaaataactatattttaaaatttttccccatcaaaggtactgaatgtaaataagtcccttatgataccaagtattttttcatatctatatccattttaataattagtttatgcaaaagttcataaatttagaggtttgttggaaagttattatttctaatctcctaataagctgaaagaaaattatgacttcaaacaatatattgaaaccttattaagagaaactggccacgtgtggtggctcatgcctgtaactccagcactttgggaggccaaggcgggtggatcacctgaggtcaggagtttgagaccagcctggccaacatggaaaaccctgtctctactaaaaatacaaaagttagctgggcatggcggtgggtgcctgtaatcccagctactcggaaggctgaggcaggagaatcacttgaacctgggaggcggagattgcagtgagccgacattgtgccactgcactccagcctgaggggcaagagtgaaactatgtctcagaaaaacataaataaattaaaaaaagagaaactgtgggaaaccccccccccaaaaaaaaagaaagaaaaaaggaagaatagcaggagtctgtttttataggaatgtcatttgagcttaacagatctagaggttaagctttgaagagttttaactatatatgtgattctcataatatctatttcattcacaggaaaatcagaataattcttataaggaaatttgtgatcttaatatacagtactataatattgacaacatttcattaaaattataagtacttattggtttcctttcaaagtgtcatatctgtgccatttctatctgtatagcttttacaattataatttatatttaccaattttcctttttaacatgatataaggtatgaaagtgttttatcacttcctaattattttattatattttgctatcatctactttgctatcatctatgttctgaaatttatttatgtctcttatatctgtatggtggaaattttttttttattatactttaagttctagggtacatgtgcacaatgtgcaggtttgttacataggtatacatgtgccatgttggtttgctgcacctattaactcatcattcacattaggtatttgtcctaatgctatccctccccctgccccccaacccacaacaggccccagtgtgtgatgttcccctgtgtccaagtgttctcattgttcaattcccacctatgagtgagaacatgcggcgtttggttttctgtgcttgtgttagtttgctgagaatgatggtttccagcttcatccatgtccctgcaaaggacatgaactcatccttttttatggctgcatagtattccatggtgtatatgtgccacattttcttaatccagtgtatcactgatggatagttgggttggttccaagtctttgctatcgtgaatagtgctgcaataaacatacgtgtgcatgtgtctttacagtagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgctgtttcctgactttttaatgatcgccattctaactggtgtgagatggtatctcactgtggttttgatttgcatttctctgatggccagtgatgatgagcattttttcatgtgtcttttggctgcataaatgtcttcttttgagaagtgtttgttcatatcctttgcacactttttgatggggttgtatgtttttttcttgtaaatttgtttaagttctttgttgattctggatattagccctttgtccgatgggtagatcgcaaaaattttctcccattctgtaggttgcctgttcactctaatggtagtttcttttgctgtgcagaagatcttagtttaatcagatcccatttgtctattttggcttttgttgccattgcttttggtattttagacatgaagcccttgcccatgcctatgtcctgaatggtattgcctaggttttcttctagggtttttatggttttaggtctaacatttaagtctttaatccatcttgaattaatttttgtgtaaggtgtaaggaggggatctagtttcagctttatacatatgactagccagttttcccaacaccatttattaaatagtgaatcctttccccatttatttcttttttttgtcaggtttgtcaaagatcagattattgtagatgtgtggtgttattcctgaggcctctgttctgttccattggtctatgtatctgttttgataccagtaccatgctgttttggttactgtacccttgtaacatagtttgaagtcaggtagtgtgatacttccagctttgttctttttgcttaggattgccttggcaatgcagacacttttttgtttccatatgaaatttaaagcagttttttccaattctgtgaagaaagtcattggtagcttgatggggattgcactgaatctgtaagttaccctgtgcagtatggccattttcacgatattgattcttcctatccatgtgcatggaatgttcttccatttgtttgtgtccccctttatttcgttgagcagtagtttgcagttctccttgaagaggcccttcacatcccttgtaagttggattcctaggtattttattctctttgtagcaattgtgaatgggagttctctcatgatttggctctctgtttgtctgttattggtgtataggaatgcttgtgatctttacacattgattttgtatcctgagactttgctgaagttgcttctcagcttaaggagattttgcgctgagacagtgagctttctaatatacaatcatgtcatctgcaaacagggacaatttgacttcctcttttcctaattgaataccctttatttctttctcctgcctgattgccctggccagaacttccaacactgtgttgaataggagtggtgagagagggcatccctatcttgtgccagttttcagagggaatgattccagtttttgcccattcagcatgatattggctgtgagtttgtcataaatagctcttactattttgagatatgttccagcaatacctagtttattgagagtttttagcatgaagggctgttgaattttgtcaaaggccttttttctgcatctattgaggtaatcatatggtttttgtcattggttctgtttatgtgatggagtatgttcaatgatttgcatatgttgaaccagccttgcatcccagggatgaagctcacttgattgtcttggataagctttttgttgtgctgctggattaagattgccagtattttattgaggatttttgcatcgatgttcatcagggatattggtctaaaattctcttttttgttgtgtctctgccagtctttggtatcagaatgatgctggccttgtaaaatgagttagggaggattccctctttttctattgattggaatagtttcagaagcaatggtaccagctcctctttgtacctctagtagaattgagctgtgaatccatctggtcctaaactttttttggttggtaggctattaattattgcctcaatttcatggcctgtgattggtgtattcagagattcaacttcttcctggtttagtgttgggagggtgtatatgtccaggaatttatctatttcttctaggttttctagtttatttgtgtagaggtgtttatagtattctctgatggtagtttgtatttctgtgggatcagtggtgatatccgctttaccattttttattgtgtctatttgattcttctctcttttcttctttattagtcttgctagcagtctatcaattttgttgatcttttcaaaaaaccagctgctagattcattaattttttgaagggttttttgtgtctctatctccttcagatctgctctgatcttagttattttttgccttctgctagcttttgaatttgtttggccttgcttctctagttctcttaattgtgaagttagggtgccaattttagatctttcctgcttttgtgggcatttagtgctataaacttccctctacacactgctttaaatgtgtcccagagattctggtacattgtgtctttgttctcattggtttcaaagaacatctttatttctgccttcatttcattatttatccaggagtcattcaggaggaggttgttcagtttccatgtagttgtgccattttgagtgagtttcttaatcctgagttctaatttgattgcactgtggtctgagagacagtttgttgtgatttctgttcttttacatttggtgaggagtgctttacttccaactatgtggtcagttttggaataagtgggatgtggtgctaagaagaatgtatattctgttgatttggggtagagagttctgtagatgtctattaggtccacttggtgcaaagctgagttcaagtcctggatatctttgttaatcttctgtctcgttgatctgtctaatattgacagtggagtgttaaggtctcccattattattgtgtgggagtctaagtctctttgtgggtctctaaggacttgctttatgcatctgggtgctcctgtattgggtgcatatatatttaggatagttagctcttcttgttgaattgatccctttaccattatgtaatggccttctttgtctcatttgatctttgttggtttaaagtctgttttatcagagactagaattgcaacccctgcttttcttttgctttccatttgcttggtagatcttcctccatccatttattttgagccaatgtgtgtctctgcccgtgagatgggtctcctgaatacagcaccctgatgggtcttggctctttatccaatttgccagtctgtctcttttaattggggcatttagcccatttacatttagggttaatattgttatgtgtgaatttgatcctgtcattatgatgtaagctggttatcttgcccattaattgatgtagtttcttgctagcattggtggtctttacaatttggcatgtttttacagtggctagttctggttgttcctttccatgtttagtgcttccttcaggagctcttttaaggcaggcctggtggtgacaaaatctctcagcatttgcttctctgtaaaggattttatttctacttcacttacgatgcttagtttggctggatatgaaattctgggttgaaaattcttttaagaatgttgaatgttgtccctcaaccctcttccagcttgtagagtttctgcagagagatctgctgttagtctgatagttaccctttgtgggtaacctgacctttctctctggctgcccttaacattttttccttcatttgaaccttggtgaatctgacaattatgtgtcttggggttgctcttcttgaggagtatctttgtggtgttctctttatttcctgaatttcaatgttggcctgccttactaggttgggggagttctcctggataatatcctgcagagtgttttccaacttggttccattctccccgtcactttcagatacactaatcaaacatagatttgttttttttcacatagtcccatatttctcggaggctttgttcatttctttttactctgttttctctaaacttctcgctttatttcattaatttgatcttcaatcactgatagcctttcttccacttgatcgaatcggctactgaagcttgtgcatgtgtcacgtagttctcatgccatggttttcagctccatcaggtcatttaatgtcttctctacattgtttattccagttagccgtttgtctgatcttttttcaaggtttttagcttccttgtgatgggttcaaacatcctcctttagctcctttagcttgttattaccgaccttctgaagcctagttccgtcaactcgtcaaagttattctctgtccagctttgttctgttgctggtgaggagctgcgataatttggagaagaggtgctctcgtttttagaattttcatcttttctcctctggtttctccccatctttgtggttttatctacctttggtctttgatgttagtgacctaccaatggggttttggtgtggatgtcctttttcttgatgttgatgctgttcctttctgtttgttagttttccttctgacagtcaggtccctcagctgcaggtctgttggagtttgctggaggtccactccagaccctgtttgcctgggtatcaccagcggaggctgaagaatagcaaatattgcagaacagcaaatattgctgccttatccttcttctggaagcttcatcccagaggggaacccacatgtatgaggtgtcaatcagcccctactgggagatgtctcccagttaggctacacaggggtcagggacccacttgaggaagcagtctgtccgttctcagagctcaaacgctgtgctggaagaaccactgctctcttcagagctgtcagacagggacgtttaagtctgcagaagtttctgctgccttttgttcaactatgccctgcccctagaggtggagtcaacagaggcagcccaccttgctgggctgtggtggggtccaccagttctagcttgcctggctgctttgtttacctactcaagcctcagcaatggcggatgcccctccccctgccaggctgctgcctcgcaggtcgcaggtcaatctcagactgctgcactagcagtgagcaaggttctgtgggcgtgggacccaccgagccaggcgcaggatgtaatcccctggtgtgctgtttgctaagacggttggaaaagcacagtatttaggcgggagtgccccatttttccaggtacagtctgtcatggcttaccttggctaggaaagggaaatctcccaacccctggcacttcccgggtgaggtgatgccccaccctgctttggctcacccttcctgggccgcacccactgtccaaccagtcccagtgagatgaaccaggtacctgacttggaaatggagaaatcacacatcttctgcatcaatcatgctgggagctgcagaccatagctgttcctatgcagccatcttagaaccggaccacatcctctttcaaggtatgaaagattattgaccttattttgtctaggtggaggaactgtatcatacagtggtatatttgagctactgtgggactgatctagtccttctataaagagactatctaaatgccttataaatcttgatatttttctaagaagcactatctttgagaaaaaacttattttctggtaaataaaatgaggaaatatgaggggcaaatttgagagccttcatctttcaattattccctttaaagctcccatttgattttggattatgccacggtgaatgcaaacaaatcccacttttcaaatggaataatttattttcttaatgtttgtgtttcaacctaaaagaattgtttttatacctacatttgaaacttcagaaaacaagattcacagaataatgaaaaactacattttaacctaaatgtggaactgtgattacagacattaccgcaagcaagtgattcaaacaccacttttcctgtgtcatcttttaaacaccactgcagattttttattttgaacatgtacttggcttctgcttctatctaagttagaggaacagtaattggatgtacccttgtgcctgaaacaataacaagcaacaacaaaaacaaacagaatatatgaaacaagcttttttttttttttttttgagtctcgctctgtcttcaggttggagtgcagtggcacgatctcagctcactgcaacctccgcctgccgggtacaaacgattctcctgcctcagcctcccaagtagctgggcctacaggcatgcaccacaatgcccagctaatttttgtatttttagtaaagactgggtttcaccatgttcgcaaggatggtctcaatctcttgaccttgtgatccgccctcctcaacctcttgagaaacaagcatttttttaaaattgcaaaacactaggcaataaagtagaaggaacccagagagatgaaaaacacagtgctacatttgcatcattttcctgctttcagagaatttctgagccacaactcgagaaaggagagcccagatggaaattgatgaactctgtaaggtaaggaaatgaaaatgagagcacagggacagcaaggcttttggaattcacagaatagagctctggagaggagaaagatacagaaggaaccccaaatatttgcataaggtactcctcaagtattcatcagagtactgatcaggacatgcatgtgaggaaactgacatttgtagtaccatccatcaatagcacaacacatattcatttcaagtatacatgaaacattgaccaagatatatactaagccataaaataagtcttagtgaattttaaaagattcaactcacacaatgtatttctctaactaaaacaggatagacttaaaattcagtcagtccccaaatatttgaaaatcaaaaaaacccatggatcaaagaagaaataaaaaagtattttgaagtgaatggcaatgaaaatacaaacataggaaaaactaaggaatgatgctaaagcagttcttaggaatttacagcactatatgctgacattactgaagaaaagatgtctcaaattgatgacaccaacgatcactttaagacactagaagacatgaaaattaactcaacatagcagaaaggaaagtataaatagcaggacagaaatgatcaaatagagatgatgtcggtaatgcaatgttggtttaatatttgaaatcagacaatgtaattcaccatgcgaactaaaaaacatgcagaaaaaaataaagaagacatagagagctatacttgttcatcaacagaagactcaaaatgattaagatgtcaattctccccagacttatctatagattaaatacaatgccagttcaaatccttgcaggtcttaactgaagaaattttcaagcttattttaaaactcgtatggaaataaaaaaatatagaatcactataacaactttgaaaaagaacatatttggagtagtaacactatctgctctcaaggtttattatgatgctacaataatcaagactattggactggcataaagaaataacttggtcaaagaaacagagtagagattacagaaatagatccacatatgggcaactgttgttcgttttttttaaatttatcgtctttctgaaaaatcttcatagaaaactatttggtttagctctcagtagcctgcccctgagctgtgaggaagcttgccttcttttgagctacctgatctttcttctgagcaagggacattttgggatggttctatctcttttaacttatttcctgggcgtcttctcatagactagattctctcatatagcagcatgagctttcttatacatctcctccatgtctagagttatgccgttctttatatattgagaggattgtttcttgtaagcatcttcatcttcctctacttagtagcacatgtaatctgcgacattctggctgataatgtgcttccagtgtacttctgcattaaattccttgctttcagaatcataaccgggaatcgtttggtactgtaagggatagacaaacctccattcacagctccctcagggcgccagaaactttattgccagtagtagttctggcaaggccttcatctccagtcacctccacttggccttcatagatcttgtccataccaaacctattgagaagcctgtggtccagcagcaggccagtacaatacgctgcagcgtaatttgtcaagccaaccttcacgccatattttggcagttcatgtgcatatgctatgcagactatcatatccccttctatacaggcataagcaatatgacaaatgatatctgttacactatcatcctgtatttgggtgtttcctatttatttttatcctgtatcaccaagcgtttctgagcatagtaatcaattttaccgtcccattgtcttctaaatttcacttggtgtctcttaaagtaggccttagtcttaacaactttaatgaaccacatcctgcagagcaaatgcccacgtctgcggcttggcagagacttctaggctcagcagcgctaggtggggaaaagagggagcaactgatttctgatgaagttgatgacagggaggaacgggaactctcacacactcctggtgggaatgtaaaatggcatgactcctacctgtttggaaaatagtttaacagttttttagaaagtttaatatatacctacctatcatatgactcagccattatactcctaagagaaacaaaaacatatgtccatacaaagacttgtacccaaatattcatagaacctttatattcaatagtcaaaaactagaaataactcaaatgaccatcatccaaattgtagtatgtccatacaataaaatgtaataaactactgataaacacagtgtggatgaatctagaaataatgatactgagttttaaaagctagtcaaaaaacagtatatatggtgtgatcccatttatatagaactcaaaaaaatgcaaagtgatctgtataactgaaagcacatcagtggcttcctgtagagaggattgcagtgggttctaatctctcattataaaggagaacaaagaaactttcagaggtgatggatatgtttactatcttgattgtgataaaggctccagaagtgtatacatgtgttaaaacattgaattgtacactttatatgtgtacattttattgcagatcaattatactttaacgctgttaaaatatgaataaagcacgttttaaaacatttagaaatccaaaatatcataaattaaacataaattataaatgatgtagattgaatcaattataataaaattacttaaaaaagtgttatcagaaaaaaagaaaatggtactctactatggtcacaataaatctaatgaggagaaatatttaataacactgataaacactagtggattttgttcctggttcaaatctgtcaattcagtatttcctaagattaatattaatttattgtataaaacatttgtgtttagtcaattgatagactgattatttcttctaaatacagaggaagctttatctgggaattgcattatttcctagtgattcttactacctattctaataggacacaatttcacagatatattcttcttgatttttgactaagattttaaagaaataccgtcttttaatttttgattaatttttttctacaatcttagaatgaaaattttggagcagaaaagaccacagaaacctttgtaatatatctcctcaatatataaaagccagaagtgagctcaatttaaatggctaacttaggatatgaggagtaattggcaacaagtgctggaaccagatttcaagtctcataatatccagtccaaaactgtgagacactatgtaggtttcttcaacttgacatattatgtatgatagcagagtggattttctaaataggtggaagaagcctttaccttcgactgacagatttgctgagaaaagacaaaaaggatcacagcaggttcagatgaaaaattgacaggagcctccacctaactctgatactgactcagcatgagatatatagatgacagcaaccaatactctaaaaaaattatatatgtaagaaaagatgcagcctagcaaacacataaaagtatataactgtgataattattaataattattaataattgcagggcccaccagtcttctgtcagtaaattgattgtacacaggtttactgcctgagtaatttgtttatcttgcctgcatcagttattttgttgaattatcatcataataacgtgtgtgaaccagtcttcttaaaagtgtaaagactttggtctcttcttgttgatttatagtttagtcatgacagcagcaacaaccaccacaaaaataatagcaaatacttatagggtgttaaatacatgccagccccatattagcactgtataacacttcacatattcccactcctttaaatacttcaggtatttctaaatacattacatatcttaacttctttaattgccacaaggcctataagtttgatgctatttttacccctaatttacagatgtggaaacagaaagatccattaagttatggagcaagaaacactctggagataatactctaaaccactgttttaaactgtagaattaactttacaaaaaataaaaaaataaaaagctttagccaaaatttagaagaaagattgtactccaaactaatgctttctgctgatattggcagaatttttgcttgctgctctaatagttttctgtttaatgagcaaattgctttaagtacacatataacactgcggcattaaggataaagatattcagccaattcctttctcatctgtgatagttctagctctgcttatttgtacaatagcactttgaatttaatctttagaaaaaacacaagaaattgacattataaacttctttaaattaccagtgaataaagggggcaataaaatcagtaatttattaaataaagcacaatggaagcattcattaagatgtcatgaaaatgctaattaataatcaaaacgtatcctattgatttgagagcttttcagttagacttccagataacatctagaaataagcactgtacattcttaagtagagatttcatgactaggtcatatccttatatagcacccctcttttggggtgtaaggaaataccctgcagtgaatatcctctgaaagagactgcgttatgagaaaaaacacaaagattatcttctaggtcactaacaagggctgattattttatgtcagtcatattgctcttcttttttcctttttgtcttgataaattgtatcagctctccaaaacccagcttatctcatccctttaatttcctttagtttgatttgtttcttccttaactttccagaacattgaggtctatacatagcatctagcaccaatttatatagtatttctccttttggttattgattctaactacttggttgagcattaaatattataatatacaccctactggtggtgcatctgtctcatgtttctctagctccacgcacctatcaaagaactacaggtaggagaccctcaggagcactctgctccttttgtccactgaaaagaaaaagtgtatattcatttggaggtctttgcgcagtactctgttgagatctacagatgcagaaagttaagagtacagctaaatattatgtaagttgaaaatgattggtgcattcattaggtaagaaagtcttttagtttttccaatctagtcaaacttcattaccaaattatcttttatccaataaactcatttttaaggttgaataatattttactctgtgtgtgtgtgtgtgtgtgtgtgtgtgtgtgtgtgcatatgtatttgtgtgtaaccacattgtctttatccattcatccactgatggacacttaggttgatttcatgtcttggctatgatgagtaggaccacaatcaacagatgtacaaatgtatctttaatatactgattttctttctttggatttatccccaaaagtgagattgttggctctattatagatctatttttatttttttgaggaacctccatactgttttccataatggctgtaccaatttactctcccaccaactgtgtacaaaggttctctttcctcatattcttgccaatatgtatcttttatctttttgataatagacaatttaacaggtgggagatgatacctcattgtggttttcaatagtatttccctgatgattagtgatgacagcaccttttcatctacctgttggccatttgtttgccttccttggaaaagtatctactcaggtctgttgctcattgtttaatcagattatttgaggttttgttttttttcaactattgagttgtaacagtttcttacatattttggatattaagcccttatcagatgtatgccttgcaaacattttttcccaatccatgagtttctatttcattctgttgattgtttcatttgctgttcagatgaaaaactaacgaaacccactgaactactaaactacttaactactaaaactgctagccgggcgtggtggctcacacctgtaatcctagcacattgggaggccgaggtgggcaaatcacaaggagttcgagaccagcctggccaacatgatgaaaccccatctctactaaaaatacaaaaaattagctagatgtggtggtgggtgcctgtaattccagctactcaggaggctgaggcaggagaatcacttgaacctgggaggcggaggttgcagtgaaccaagatcacaccactacactccagccctggcgataatgcaagactccatctcaaataataataataataaataaataataatgaaaaaactgctaaaaagcagacgcttttagtttgatgcaatcccactttcctagttttgcttttgatgcctatgctttcactgtcatagccaaaatgtcatcgtctagaccaatgttaataagctttttccctatgttttcttctagtagttttatgatttttggaaatatgtgtaggtcttattccattgagttaacttttgtacatcacttgacattatgcaaagtgaagtaagccagacacagaaagataaatactacattatttatttctatatggaaccaaaaatatttgaactcaagaagcagagagtagaatggtggttgctgggctgtggtgaacggagtaagggggagatgttggtctggggatacaaagtttcagttacgcaagatgaataggctctggagatctaacgtacaacaatgtgactatagttaacagtactgtattgtgtacttgaaatttgctaagctcttattaagtgttctcaccacacacacacaaagaatcttcagggatcccaaaaagtttatatgaatgcttatgtaatttatttctccaaaatccatgtaaaaccccaataatactataaatgactaaataaatagtgtataaaaaaataacagaggctgggcgtggtggctcacacctataatcccggcactttgtgaggctaaggtgggcatatcacttgaagccaggagttggagaccagcctggccaacctgccaaaaccctgtctctactaaaaatacaaacattagctgggtgtggtggtgcacaactataatcccatctacttgggtggctgaggcacaagaatcacttgaacccaagaggcagagtttccagtaagccaagatcacaccactgcactccagcctgggcgacagagtgagactgtgtctcaaaaataaacaaataaataaataaaataaaaaataacagtgataacttgttctgatattctctggctgcattagaatcactaaaaatgattgacctatgaaattattaatgctacccatagtaggctaatgatggatcacttccatgaatctcatcttcctcgtctcttaatttgaattgtaactgccatgaaagaccttttctaattattttaaatttactgaattagctgtgaattaagactgaaaagatatatttggagattaataaagttcttcaggaaaggtattttatttacatatttattttggtataagattccctacatcttataattacaccatcagaaacacaaacctaacttacctttcctccttgcatatttagcaaatgccataatcatgcatggcctgttactttctgaaccatttcctattgattatatccactgaaatgttgacattgaatgattgctgaactctatctgtacaagcactgaaagtatttgaaagtagaaattactcttcaaatttcatttcttttatcttttctgttataagaacttatcagtgatttccttctgtatcccattatagaaatggcatcatgaaataaaatataagctgacagttctcagatttattattgtatttgatatattgacatttttaaagagtggtgctctgtagttaaatgaatccaaagagattaaatctctttaaaaggagtcagtcctctaagagtggaattttcttgccaatgcagcttgatcagaccatagttgggggtgggctttcagaaattgcaacacttttcatctgctcatctatttgaggcagtattatttttttgagtttcaatatcttaaaatactgatttttctatcaatcattacaattgaatgcattcacattagttgatttctatgaaagtatcaatatcaatagaaaattacatcttggaaatggatttgactcatgtacttgaaaaatcagtgtgtgaggaaatttaaaagtccagttttcattaattttagcacaaagtgttttattgaaacaaaatgcttcacctatctgtattttagtatttgttacatatgtagaataggtaatgaccaagtcaggtgattttgggtatccatcaccttgagtatttatcatttctatgtgttagtaacacgtcaagtcctctctcctagctacttggaaatatacaatacatttgttgctaactataatcaccctactgtgcttttgaatattggggattatttcttctatttaactgtatacctgtgcccactaatcaaccttggtttaccgccccccccaatcccacccttccaagcctctggcatctataattctattctctgtctccatgagatcaacttttttagctcccacgtatgcatgaaaacatatagtatctgttgtgctgtgtctggcttatctcacttaatgtaacaacttccagttccatccatgttactgcaaatgccctaattttattatttttatggccaaatagtattcctttgtgtaaatatactgtatttttaaaaaatccacttatatattaatggacaattatgttgattccatatctttgctattgtgaatagtgccgcaaagacatgcaagtgcaggtaggtatccctttgatacacatatttctttttctttggataaatacccagtagtgggattgctgaatcttatggtagtattatttttgattttttgagaaatctccattctgtcttctatagtggttatactaactttcattcccaccgacagtgtatgagttcccttctcctcacatcccgatcagcatctattaaattttttttgtctttttagtaagagccattttaactgggataaagtaatatctcattgtggttttaattttcatttccctgctggttagcaatactgagtattttatcatataccacttgatcatttctttttgagaaatgtctattgtcctttgcccacttatttatttatttatttatttatttatttatttgagacgttgtctcgctctgtcacccaggctggagtgcagtggcgcgatctcagctcactgcaagctcagcctccccggttcacgccattcttctgcctcagcctctcgagcagctgggactacaggcacctgccatcacgcccggctaatattttgaatttttagtagagacggggtttcaccgtgttagccaggatggtctcgatctcctgacctcgtgatccacctgctttggcctcccaaagtgctgggattacaggcatgagccaccgttcccagccctttgcccactttttaataggatttttgttgttgttgatgagttgttttgagtttcttgtatatttcagatattagcctcttgttgcatgaatagctggcaaatattttctcccattcaacaggttgtctcttcactcaacggattgtttccttgctatgtagctttttagtttaatagtcacatttgtctatttttgttatagttctctgcgcttttggggtcttagccatgaaatgtttgtaagattgatgtcttgaagtgtattttctgtgttcttttctagtatttttacagttccaggtctaatgtttaagtttttcatggatcttgagttaatttttctatatatagagagcagtccagattcattattttacatatgtacatctaattttcccagaaccgtttattgaagaggatgtcctttaccagcatgttcttaatgcctttatcaaaaataagttggcaataaatatatggatttacttctggactcactgatccattggtctatgtgtctgctcttataacaaaaccatgctgtttgtttgggttattatagccgtctaacatattttgaagttgggtagtgtgaagtcttcagctttgttcctttggctgaggattgttttggcttttcttgctcttttttggtttgatatgaattctataattttttttaattctgtggaaagtgacattcttactttgataggaaatgcataggatctatagatgctttaagcagtatgaaaatttaacaaaattgagtttcccaatccataagcctgggatactgaactgtagttttagtttgttgttgtgtctttgtctggtttggtacctgggtaatgctagcctcatagaatgatttagggagagttctcacctcttcaatttttttgaatactttcaggagaattggtattagttctttatatgtttggtagaatttggctgtgaattcatctggtcctgggattttctttgctgggagacctttcgttactgattcaatgtcactactcacaattggtatgttcaggtttttttttactttttcctaattcagtcttggtaggtgtatgttgtgaggaattcatccatttcttctaggttttccagtattttagcatatagttgtgcataatgatctctgatgatcttttgtattttgttggtatcaattgcaatgtttccttttctgattttgtttatttgggttttttctcttcttcacagcaatattggcctgtaattttgttttgttttgttgaatgtgtttttttgaatctctatgtcattgagctctgatctgatatttactatttctttccttctgataattttggatttgacttacccttgctttcctaattccttgaggtgcatcattaggttgttgattataaatctttctactttttaaatgtaaatatttactgttataaatgtcccttttagcactgcttttgctgtctcccacaagtttgggtatttttgtatttccatttttatttatttcaagaaattttttgatttccatcttagtttcttcattggcccaatggttggttatccagaagcatgtttttaatcttcatgtatctgtatagtttccaacgttcctcttactgatttctagttttactctattgtagtctgagaatatgcttagtgtgatttctattttataaaagatttgttaagacttattttgtgtcccaaactatggtttatcctgaagaatgttccatttgctgatgagaagaatgtatattttgtaattttggataaaatgtcctgtaaatgtctgttaggtctatttggtcaaaaataaagtttaaatctactgtttctattaaaagtgcaatttaaatctactgtattaacattttccactattattgtattgaagtgtacctctctctttagatctggtaatacttgatttatgaatttgggtgatttagtgttgggtgtatatatatttagaattgttatttcctattgcttaaacaatctctttgtcattatataatggcctttgttttttctttactgtttttgacttaaaattgattttatgtgacataagcatagctactcctgctcgcttttggtttccttttgtttggaatatctttttccagcacttcactttgagtctatatatgtctttgtaggtaaagggtgtttcttgttagcagtatatatttagatcatgtttctttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatcatgtttctttatccattcaaccagtctatgtcttttaagtggagaatttaatccatttacattcaaggttattattgatatgtaaggtttacttcctaccacattgttgtttcgggttgtgttgtatattttttgttcctttctttttcttctttcatttgctattgtggttaggtagttttctgtagtggtacaatttgggttgtatctcttcttcatttgtgtgtttggtttatcagtaagttttatactttcatgtgatttcatgatagtaaatgttgtcttttcgcttccagatttaggagtcccttaagcatttcttgtagggccagtgaagggccatcagtgtttgcttgtctgggaaaaacttcatttcccctttattgatgaagaataattttgctgtgcatgatatccttgagtgggaagtttgtttttttttaaagcactttgaatatgttattccattttctcctggcctaacaggtttctgctgagccccagtgttagtctgatgggagttcctttataggtgacaatatgtttttcttgctgttttatatagttttctctttaatactgactttagatggttggactataatatgctgtggataatttttggtattgtagctgtttggggatcactgggccttctgtatctggatgtgtaaatctgttgctggacttggaaagttttgatttattgtttttttaaataggatcttaactaaactcttgttttctcttcaccctcagggacattgataattcaatttcaaaacacccatattcaagttttgagattctttcttctgcttaatcttgtttattattgaagctttcagatgtatttttatttcatttaataaatttttcattttcagtatttctgattttttttaaataactattcggaaaatttctcattcatatcctgacttgtttttctgatttctctgtattgctttaatcatttttatttatctttctgagcttctttaaactcagcattttgaattacttttctgggaattcatggatttattttgattgggatatgttgttagaaaattatatttttgggaggtgtcatatttccttgctttttgatgcttcctgtatcctcacattgatatctgtgcatctggtgtagtagttgcttcttccaactttttaaacttacttttgcagagaaagacattttcctgaagatttatatatgttgttggttgggtagagaactttggcctcaattttgagtgcatgcgatattgtagtatctgtgatttcatcagctgtaaagtgtcagtggtatctttgaattcctcggtggcttagggcttagaacacagttattagtgaagaatgtggtaaagtcttactggggacgaggatgctggatagtccagtctttgagtcccagtggtggtagtggtgggctaagcatgccttaccttgagccgtagagcaatgtatgctggctctggtgttagcacattcaggcaggccaattcttgggcccccagatggctttctcagatgccagtagtggcagcagtaggccaggcttgtgtgtgggttcttgggcctctgggcagtggtgtggtgtgcataatggcataagcagtggtagcacaactcagtggaacaccaattcatgttggtgttggtgttgtcagtggctgcaacaggctggatgggcaagtcccttgacctgcagctggctcatatgggttagtgtctgcagtggtggtattggtaggttggataatcctgacctcagaccctggcagtagtgttcaagtgccagtgatggtgagctggtctggtaatccctaggcctttggaatgtgtgcttgggtactgttcagatgaaagctggtgagcagatttgtcatcaggacccctggtagtatgttcaggcactacgtatgataggcagaggcagaatactccccaggtcactagcagaatgctcaggttgggacagcagtggctgtgttatgagtctgcttctggggaggctggggccactctcattgggagcagcctaggaaggcagctgtggagctcatggtttgcttatgcactggtcctgcagtagcagcagtggtatttctccttgggacatgtgaaagttcctggccttccatctccctcctgtggcagctctggtagcagtggccccagggcagaatgcaggcctttgaagactaagctttctgaatggtaccagctatgggcctacaaccagggaaggtggggccactctcaatgacagcaacatagacaggcagctatgggacatacagttgcctcatatcttagtcccacaacagcccacagcagcagcagtggatttgttctttgggtgtatgaaatgtctggcttcccttatctctccctggactgactgtagcagtagcaccatcagctccagggcaggatgccgtccttttggaactgagctctcagaatggtgccatattgcagctgctcaaggctgagaagactgtgaaacccagcatgagctccctctcttaagcggtgcctctgcgcaatctgtaggcagctccctatgttagtttctaggctcgtgggtgccgaggggcttgctcttggctaagattgtgtaagtccatggcaggaatgtggagccctggggatcacacattttccctttccctgtgtctgggagcttcttccagctcccagtcaatcccaactgagaaggctgcctcatttccctttcattctttgactttgttgcttccaataatttctctgttgaatattggtgttctcttatagatgactcatttgaactatgaatatctacttgccattttggtgtcactttatggagaggcatataatagctgcatctagtcaaccctcttcccttatgacagccaaaatattattaattgaaatgccaactgtacttattaaagagcctagatctgtgatgagcagtgattcatgatttgccactgcaaacttgccatctatcaaaccttaactatagttaataattgaactttgttagcagcaagtcatgaatttagtcataaggactccaaagattatctgatatttgactatgtatactcaatctttagctggctttaaataacctgctttatgtttataggtgtcttccccaaagaagagagtttatcaaacaaaacataataatgctggtgatcttaatgcctctcccaatatgtttttctgatgccactacacatctagctagatttgactctttagtatgtagccaacattaatgactgttctaatacacacttgatttttatttcacagaatacaaaattcttgatttattggaaaagaatgataatgcctgtatccctgtatgagcacttgctctagccacggtcacagtgccatctgtctagggtctggggaatttaggcccattgatcatttggagaggttgaggagtaaaataaatagtacccagctctatcatcaagaggttagtgctcaggtctaccacttcactccatttttgataccagaatctctgctctcatcaccatcttctgacaagtttgaagtctggcaaccaaggagcaaaagtgggtggggcattattcaactaatggatccatgagataacttctttatcaatgcctgctttgttatacagcgaactctctgctaacactcataccatgagaaatgattttaacaaaaccctaaacttactccacactctaatgaaacagtttttgctagctagcatttattaagcgtatttttttaatcttactcacaataaataatttataccaacaattggtactcaaggaattttgaataccctccctccctaagctctccttaattggaacagaagggatatgaaggccagggacagtggctcatgcctgtaatcctagcactttgggaggccgaggtgggtggattgctttagccaaggagtttgagaccagcctggctaacatggcgaaaccccatctctactgaaaatgcaaaaattaaccaggcgtggtggcacatgtctgtaatcccagctacttgggaggctgaggctgcagaattgcttgaacccaggaggcggaggttgcagtgagctgagatcaagccaccgaattccagcctgggccacagaacaagactgtctcaaaaaaaaagggaaaagaagggatatgagattggaccagctgctctgttatatattacatattcacaaaccattttcttagccaccttcagttaatgtatttttaatttttatctttttaaattttagattcaggggatatatgtgcatgtttgttaagtggatataatgcataatggtgaggtttgggtttctagtataccaatcacccaaagagtgaacattgtacccaataggtaatttttcaaccctcatgctcctcccatactcccccttttcagaatcctcagtttctatcatttacatctttatgtccatgtgtactcatttgttagctcccctttaaaagttagaataagtgatttatgatttttatgtttctgagttatttcacttagaataatggcccccaactttactcatgtagctacagaaaacataatttcattcttttttatggttgcatagaattccatagtgtatatatgtttaatcctatcatccattgatgtgcacttaggttgatttcatgactttgctattgtggatagtgctgcaataaacatgtgagtatgggtgtcctttggatataataacttcttttcctttgggtagatagccagtagtgagattgctgggtcaaatagtagttctatttttagttatttgacacatcttcctactgttttccgtagaggttttactaatttacactcccatagtgtacaaacattctcttttctccacatccacaccaacatctgtggttttttgactttttaataatagccactctgactggtgtgatgtgttatcttattgtggttttaatttgcatttctctgatgattagtgatgtttaccttttattacatgtttattagccacttgtatgacttcttttgagaagtgtctgttcatatcctttgcccactgataatagtttggatgtatgtcccctctaaatttcatgttgaaatgccatccccaatgttggaaatggggcatagtgggaagtggttgagtcatggagacagatccctcatgaatggcttggtgcacacctcacagtaatgagtgagttctgtctctctctgagtttacacgagattgtttaaaagaatgtggcacctccccattctctctcttgttcactctgtcaccatgtggcatgctggctccccttcactttctgccatgattgttagctcactgaggccctcaccagaagcagatgccagcactatggttcatgtatacccagcagaaccacaagccaaataaaattgttttcttaataaattacccagtctcagtttttcctttatatcaatgcaaacagactaacacatgtactttttaatggggttgtttttgttattgttgttgagttttttgagtcctttgtagattctggagattaatcttttgtcggagtcataatttgcaattattttcttcaattctgtaggttgtcagtttactctgttaattttttgttgttatgcagaagctttttggtttaagtctcatttgtatatttttgtttttgttgcacttgtttttgaggtcttagtcataaattctttgcttaggccaaatgttcagagcagtctttcttaagttttcttttaggatttttatatttatttttatattttcaggtcttacatttaagtctttaatctacctcgagttaattcttgcatgtggtgagaggtatgggtccagtttcattcttctgcatatgactagcctgttttccagtgccatttattggatgatattgtttattatcattgtttctttctttccccattgtttatttttgctgacattggaaaatataagttggtcgtacatatgtggctttatttctgggttctctattctgtttaatagatctgtgtattttatttttgtatcagaaccatgcagttttagttactatagacttacagtataatttgcagtcaggtattgtgatgcctccagctttgttctttttgcttaagattgcttgggctatttggctctttttttttttttggttttgtatgaattttaagattgttttttcaaattctgtgaaaaatgacattagtaatttgatagaaattgcattgatactgtagattgctttggaagtatgatcattttaataatgttttcagttccaaaagcatggaatgtttttctatttgtttgtgtcatctgcaatttctttaatcagtattttatagttctccttgtggagctcttttaccttcttggttagatgtatgcctatatatatatatatatatgtatgcatatatatatatatacacacacacacacacacacatacacatacacacacacacacatatacacacacacacacacatatatatatatttgcatggcaattttaaatgagattgagttcctgtcttagttctcagcttgaatgttattgttgtatagaaatgtctctgattttttgtacattgatttttgtatcctgaaactctgctcaagtcatttatcaaagttaggagtcttttggaagagtcttagggtttctaggtataatatcatgtcagcagtgaacagagataaggaggatgatgatgaaattatcagaacgtagaaactgtatttttttatgattcagctccttgctgtgccctttagactagctggcaatggtagttttattggtaagtggaacctaaaggagaaaatcaaacagaaaattcactatcttgtaatgtctcagattttatctatagtacagaaaaggaacagagtcttgtgacaagggctgcattatcctggggaagtaagcagcaacttaatacaagaaaatgggctgaagggtaaactgtcttaatgattactgctgattatattgtaagcctatttgtattttatttttccctttaattttataaagtgttcttgggaacagttttagttttccctaggctcgatttctttttcaatcttgaggtgcaagaattaatatggtccaaatttggcaaagactgctctagatttttttcttggcaaggggcatagccatggtgtgagtcaggattagaggaatgaaattctcaggtagtaactctaaatatttgtgagtgcctagtcaggggtatagtatgaacaaatttggtatttttgtctattattttagtgtaacatttaattgaacagtgaactatgaggtaaattataagccctattaacagaattgtgaatccaaactttaagaccccttgtaaagtgaagtaaaaatcttggagtatctgtgagaaaagctcagaaaatcagtcagacagagggtgtgtagtaagaaatgttatagtcaggaatgaatgtacaatgtagtctaaataaattgtagacaaatagtaaaagtccaaatataatggacaaggctagaatctaaaaacaagtgtagtatactttttttttttttttttttttttttgagacggggtcttgctgtgtcacccaggctggagtgcagtggcgcaatcttggctcacttcaacctccacctccaggttcaagcgattctcctgcctcagcctcctgaatagctgggactataggtgcatgccaccatgcccagataatttttgtatttttagtagagatggggtttcatcatgttggccaggatggtcttgatctcttgacctcatcattcgcctgcttcagcctcaaaagtgctgggattacaggcatgagccaccgtgcccagcctatacttctgtgtaccacaattgtttccagtctctcacttttattaaagaaaaaataatagtaaaaaatttattggcaaagtaagttttaatctttttatacatggcctgattatttgcataaaatacagcaaaaatggtgattggccatataggctcttttaagttggctttgctgaaactttttaataaggaatctcaggttaaactttttaaaagtctcttcagattactcaagtcaatgatttatctatgcctgtagatacctgtatgaattgggtaaatttttctctttttgaagtatcagaataacttggtgtttctgggcctattagaaagtgacatttcttatttattacggttcagtaactttgtaaagaaattgcatagacaaggtacaaggccatttttaagggacttttatcaactttataagtcaactttaattttttaaagtagtctgatcatttctgaaaatatgtcattttagtcaaagccttggcaaaataaccggtatctctaattgtttcctattataaaagagaacagatttttattgaacttatgtaaataattaaattgccataaattaagaattctcacatatagtttttaaattctggaaaaattaggtagagagaaagaaatatgtttcaaattttgcttacaaataaacaattgcttatttgtaacaatttttattcaattgttaaaagctataaatatctcaaaagaaaaagattttctcccctctggaaaacaaaatgaaaaggatcagtaatcttttaagtaaaatttaaaaattattttagtcctccattggtttagtgttttgctggatgttgggttagcaatcctcatgaacacataagctttttaatgagagtgctagaagttttttatgagtccaatgttatgatttttaaaattattagaaacctatatttgagtcttttttacaaatttttttaaagaagtaaatttgtactgtagaagaatcaaagtaaaagctaacaattgtctatagatgacaaaagtcttagattagtcacagataaaggcataattgacaaggaaatttggttatttttgtgacacacaatttaacatgattatcataattattagtgataacataactaagacatttaagaattgaaccagaaagaaataaaaatcctgaacagacaaataacatataatgcaattaaaccattaattcataatcttccaagaaaaagaaaggcccaggagcggatggattcactgctaagttttaccaaatgtacaaagagctgacacaagtcttatgaaaactattcctaaaaatagaggactaaggattccttcctaactcatttaaaaaaaattattactctagtaccaaaatcaggcaaggacacaacaacaacaaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgcagggatccaaaaataattgaacatacacaaaccaataaatgtgatttaccacataaatagatttaaaagcaaaaatcatatgataatatcaatagatgtagaaaaagcatttgataaaatccaacatcccttcatgataaaaaccctcaaaatctaggcatcaaaaaaaaaaaactacctcaaaataataagagccatatatgacaaacccacagccaacatcatattgaatggggaaaagttgaaagcatttcccctaagaaatagaacaagatggggaatatccactctcaccactcctatttaacatagtactggaagtcctaaccaaatcacccaggcaagagaaagaaagtaaaggcatccagactggaaaacagaaaatcatttcctggaatttatccatttcctctaggctttctagtttgtttccatagagatgttcatagtagtctcatgatcttttacatttctgtggtatcagttgtatgtcacctttatcatttctgattatatttattagaatcttctttatttcttggttaatctagctagaagtctatcagttttgtttattctttcaaagaaccaacttttcatttcactgatcctttgtattatgttttttatttcagtctcatttatttctcctctgatcattattatctcttcttctgctagctttgggttttatttgttcttgttttttagttccttgaggtgcaacattaggtcatcaacttgagatccttctatcttttggatgtagacattcaatactaaaaattttttcatagcactgagcttgctctctcctataggttttggtatgttgtgtgtctctttgcatttgcattgaattttttttttatttctgcctcaattttgttgtttgtttgcccaaaagttattcaggagcaagttgtttagtttccatgtacttatacagttttgatagttcctcttggtattgatttccaattttattccactatgttcccagaagatacttgatgttattttgattttttgaacttattgagacttactttataggcaaatatgtaattatttttgaagaatgttctacgcacagataataaaaatgtatattctgaagttgttgggtataataatccttaaatgtctatcaggtccacctggtctagagttcagtttaagtccaaagtttctttgttgatttctgcctcattgataatgccgtcatgtaatgactggtgatagtgctgtcaatggggtgtcaaagtcccccactatttattattgtattgctgccagtgtctttttgtagggctagtgtaatagtatttgttttgtgaatacttcagtttttttgttttggagatggagtctcactctgtcacccaggctggagtgcagtggcaccatctcagctcactacaacctctgcctcctgggttcaagcgattctcctgcctcagcctcctgagtagctggaattataggtgtgcaccaccgcacccggctaatttttttgtatttttattagagatggggttttgccatgttggccaggctggacttgaactcctgacctcaagtgatccacctgcctcagcctcccgaagtgctgggattacaggtgtgagccaccgcgcctggccaaatacttcattttatgaatataatgctctggtgcatatgaatttatgatagttaaattttcttgttgcattgaatcctttattcattatatagtgtgcttctttgtcttttattactactgttggtttaatctctcttatgtaacataagaaaagctactcctgttcacttttgtttttcttttgtatgatacagctttttctaccactttactttaagactgtgtcattacccattatgtgagtgtcttgaagacggcagatagttgggtcttttgttttttgtaattcaattagccagtctatctatcttttaagtggagaatgtatgccaactatgttcaaagttaatatttatatgtgaaattttgttcctgtcataatattgttagctagttgctttgtagtctcaattgtgtaactgctttatagaatctgtgagatttgtacgtacatgtgtttttatgatggcaaggatcatccttttgtatccatgtttaggactcctttgagcttttcttgcagggctgttctagtgttgatgaattcccttagcatttgattatctgggaaagactttatttctccttcatttatgaaattacttgtgtcaggatataaaattcatggatggcatttttttaaagaactccacaaacagtgcccttatttctttgagcttatggggtttctgtttagaaatgcatacttattctgaaggtattttcttaataggtaatgtgatgcttctttctagctgcttttaagattttttctttcacattgaccttagatagtctgaagacgatatgctttggtgatgttcaacttgtatagtatcttccaagtgtcctctgaatttcttgtgtatgataacaacactcctagcaagatccgataaattttcctaagtttgcccatcaaatatgattttctttttcttcttctccctcaggaatgcttataagttataggtttgttcactttacataatccagtatttaggttttttttcctttttaaattttggtttttaaaatttttctcttactgaattaattcaaaagagcagttttcattttttaacttttaagttcagggttacatgtgcaggtttgttacacaggtaaacttgtatcatggtggtttgttttacagattatttgatcactcaggtattaagcctagtacccattaggtatttttcctgatcttctctctcctcccaccctccaccttccagtaggccccagtgtgttttgttcccctctatatgtccatgtattctcataatgtagctcccacttataagtgagaacatgtggtatttggttttctgttcctatgttactttgctaaagataatgacctccagcttaacacatatccctgtaaaggacataatcttgttctttgttattgttgggaacaggccccccaaaatctggccataaactggccccaaaagtggccataaacaaaatctctgcagcactgtgacatgttcttgatggccataacacccacactggaaggttgtgggtttaccggaatgagggcaaggaacacctggccgcccagggcagaaaaccacttaaaggcgttcttaaaccacaaacaatagcatgagagatctgtgccttaaggacatgctcctgctgcagataactagctcaacctatccctttattttggcccatctcttcgtttcccataagggatacttttagttgatctaatatctatagaaacaatgctaatgactggcttgctgttaataaatatgtgggtaaatttctgttcagggctctcaactctgaaggctgtgagacccctgattttccacttcacacctctatatttctgtgtgtgtgtctttaattcctctagtgccactgcgttagggtctccccgaccaagctggtctcggcatgttatggctgcatagtattccatggtatatatgtaccacattttctttatccagtttatcattgatgggcatttaggttgatgccatgtctttgctgtgtgagtagtactgcaatgaacatacatgtgcatgtgtctttataacagaatgatttctgttcctttgggtatatactcagtaatgggattgcttggtcaaatggtatttctttctctaagtctttgaggaatcaccacactgtcttccacaatggctgaactgttttacactcccatccaccatgagtaagtgttcctttctctccacaacctcaccagaatctgttattatttgacttttcaatcatagccattctgactggtgtgagatggtatctcttgtggatttgatttgcatttatctaatgatcagtgatgttgaactttttttcatatgttcgttagctgcatgtatgttttcttttgaaaagtgcctgttcatatccgttgctcattttttaatggagttctttgtttcttgcctgtaaatttaagtttcttgtagactcttgttattagacctttgtcagatgcagtttgcaaaaattttctcccattctgtaggttttctgttatctttgttgataattttcttttgctgtgcagaatctctttagtttaattagatcccatttgtcaactttttcattttgttgcaattgcttttggtgtcttcatcatgaaatctttgcctgtgcctatgtccttaatggtattgcctaggctctcttccttggattttatagttttgggttttacatttaagtctttaatgtatcttgaattaatttttgtatatactataaggaagggattcagtttcaatcttctgtatatgcctcaccagttatcctagcaccatttattgaataggaaaccttttccttattgcttgtttttgtcatgttttcaaagatcagatagttgtagctgttcagtcttatttcttggttcttgattctgttccactgctctatgtgtctattcttttaccagaaccatgctgttttggttaccatagccctgaagtatagtttgaaatctggtagcatgatgcctccagctttgttctttttgctttggatttccttgtcaatttgggctcttttttggttctatctgaattttaaaatagttttttttttctagttctttgaagaatgtcattggtagtatgataggaatagcatttaatttataaattgctttgggcagtatgaccattttaatgatattgattctttctatccatgatcatggaatgtttttccatttgtttgtgtcatctctgatttcttagagcagtgttttgtagttcttcatataaagatctttcacctccctaataagctgtattcctaggcattttattcattttgtggcaattgtgaatgggagtttgttcctgatttggctctttctttgactgttgttggtgtattggaatgatagtgaattttgcacattgattgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccctggccagaacttccaatactatgttgaataggcatagtgagagagggcatccttatattgtgccaattttcaaaaggaatgcttccagcttttgctcattcagtatgatgttggctgtgggtgtgtaatagatggattttattattttgaggtatgtgtcttcaatacctcgtttattggagagtttttagcatggatggatgttgagttttattgaaagccttttctgcatctgttgagataatcaagtttttgtctttagttctgtttatgtgataaatcacagtttcttaatttgtgtgtgttgaacttgcatgcatctcagggataatgctgacttgatcttggtggacaaacttcctgatgtgctgctagattgccagtatttgtttaggatttttgtatcaatattcatcagggatattggcctgaagttttgttttttgttttgttttgtttttgttattgtatccctgacaggctttgggatcaggatgatggtggcctcatagaatgaattaggggggagtccctcccctcagttttttggagtggtttcagtaggaatggcactagctcttctttgtacatctggtagaattcaggtgtgaatccgtctagttctgggatttttttggttagtaggttatttattgttgccttgatttcagagctcattattggtctgttcagggattcagtttcttcctggctcagtctcgggaagaggtatatgtccaggaatttatccatttcttctacattttctagtttatgtgcatagaggtgttcgtaatgttctctgatgtttctttgtatttctgtggggtcaatggtaatatcccccttttttgtttctgattgtgattatttgctcttctctcttttcatctttattagtctagctagcagtctatctatctattttattaattttttccaaaaaaacagctcctggttcattgatcttttgaatggtttttcatatctcaatctccttcagttcagctctgattctggttctttcttgtcttcagctagctttaggatttgtttgcccttgtttctctagttcttgtagttgtgatgtcaggttgttaacttgagatctttctttctaactttttgatgtgggtatttagtgctataaatttccctcttaacactgccttagctgtgtcccagagattctgatatgttgtatctttgttctcattagtctcaaagaacttcttgacttctatcttaatttcattatttacccaaaagtcattcaggagcaggttattcaatttccatgtaattgtatctttttgagcaaatttcttaatcttgatttctaatttgattgtgctatggtctgagagagtggttgctatgattacagttcttttgcattttctgaggagtgttttacttccaattatgtattttacagtatgtgccatgttgcaatgaaaagaatgtatatctgttgtttctgtgtggagagttatgtagatatctatcaggtacatttgatccagtgctgagttcagttcctgaatatctttgttaattttctgtctcaattatctgtctaatatcatcaatggggtattgatgtctcccactattactgtatgggagtctatgtctcattgaaggtccctaagaatgtgctttatgaatctgggtcctcctgtgttgggtgcatatatatttaggatagttagctcttcttgttgagtttaaccctttaccattatgtaatgcccttctgtgtcctttttgatctttgttggtttaaagtctgttttgtctaaaattaggattgcaactcctccttttgtctgttttccattttcttggtaggtttttctctatccctttattttgagcctatttgggtcactgcatgtgagacggatctattgaagacagaataccattgggtcttggctctttatccagcttgccactctatgtcttttaattagggcatttagtccatttacatttaaggttagtattggtatgtgtggatttgactctcattatggtgttagatgattattttgcagatttgtttatgtggttgctttatagtgtcactggtctgtgtacttaagtgtgtatttgtagtggctggtaacaatcttttctatccatctttaatgcttcctttaggtgcttttgtagggcaggtctggtggtaacaattccctcagcatttgcttgtctgaagaggatgttatttctcctttgcttatgaagcttagtttggccagatataaaattctggtttggaaattcttttttttttaagaatgttgaatattggcccccattctcttctggcttgtagagtttcagctgagatgtccattattagtcaggggcttctctttgtaggtgatgtggactttccctccagctgcctttaacattttgtttttttattttgaccttggagcatatgaagattatatgtcttggggatgatcttcttgtggagtgtcttactgaggttctctgcgtttcctgaatttaagtgttgccctgtctagctaggttgaggaaatcctcatggatgatatcctgaaatatgttttcccaattggtttcattctccccatctctttcaggtacaccaagacattgtacatttggtctatttacataatcccatatgtctcagaggttttgttcattccttttcattctttttttctctagtcttctctacctgtcttatttaagaaagccaggcttcaagctttgagattctttactccacttggcctattctgctattaatacttttgtaattgcattatgaaattcttgtttttaagttctgtcagggtggctatgttcttctctatactggtcattttgtctgtcatctcccataatgttttatcattatttttagcttcctcgcactgggttacaatgtactcctatagctcagtgtacttcctttccattcaaattctaaattctacttctgtcatttcagccatctcagcctcagcctggctttaaaccctctctgaagaggtgatgcaatcatttggagaaaagaaggtactctgactttttgagtttttagtattcttgtgctgattctttctcatgtttgtgggcctatctaccttcaatctttgaggttgctgacctttggataggttttttttttcttttatcctatttgatgaccatgagggtttgattgtgttataaggtggagtcagctgactagcttcatttctgggagattttagggggccaacactcagctctcaacctttggactgtgtactataattctgggggacttctattgggccccaactttgttctctggtttgaaccttgaggtttggagttcactttgccgggggaaccaaagtgtggcagctgcagcaaagtgcaagtggatacaggggttcctacctccctgagagcattcaccacagtggtagaggcaaggcagcagctgggacagcaggttgtggggtgtcctgctggagactgtgctgttgcactagaggtgatgttggctggtttattttttgttggttttcaactttctcttggatctcattgagcttccttatagtctatatttctaattttttatctgtcattttcaaattttcattctattgaggatccattgccatagaagtagtgtgatcttttggaggtgtcaaagcactctttttacactgctggagttactgagctgattccttctcttctaaagaaaccgtcattttctttctttctttttttttttttgaaattgctattgtttgcaagggactttatatttattttttcctcccttgaaggtgtgactgtagtacatattttgtatgatcatttggcttctgggtgcttttagacaaccgaggctctgtatgaattcattggttatagatagcttttgtgtggtggctttctcaaattctgcttgttgtagctatacattgggcatatgagccaattcactctcttctaggaggccaggaatacagggatctcaggtagctgatgtcctccctagcactgtgtccttctgtcagccactttttgttttgttttggtttttgttttgtttttggtgaagtttggtctccagtaggtggtgccagagccagtttccctttggatattgagatgatgtgtggaagcacctgccctaatgaagctcatggagggagtttgtggtgggatgcactgaggtttccagggtggtaaagagagggctgcaccagctccccatcctgggaagtcaggaatatgatccacttccatatcatgcccctatctcagggttcatggccttcagttcagatagtcactgtcctttatctccaggccacaatgcaacttaggtctgtgagaaatgcctgtctggtggctactgatgaaatgacctttcagcagaacctcttcccccaacaccaaacagatgactctgcagttagttggtttacactgttttgcagtgatgctgccactctgtgtagaaaggcagaaattagccccgttctatgtacaagcctaagcagtgggcacaccttcactgaggacacagctatcccaaaaaatgctggaaggaggacacttacggcaacctccaacaggaaaggccttggctacctctgcagcagtgtacgggacagtgggagatccatttctggccactagggtcacctatccactagggcagaacagtgccccctttggagatcagcactgttacctgcatttcctctgttccgaggagcgctttggcagtctgcattccccctctctccctctctctagggtcagcacactcgaaggactatacctctagggatcccacagctccccagggacctgatggacctctgtagttgccaaagtcaccgtgggttttgaggttccctgggtaggttaatgacccataacagatacacaaacagtgtggtccctgccacctgagtctgagtttggtgtgagtgtgagcacacatggaggaaatggctgcctcgtgctgtgcctgctggaagttcccaaattgccaccaacaaacagcattgttctgggttgattgataggggaaccccgacagtttggctgttagtagtctgtcacacaggtgagaggagcaagagatccccctattgtaaccttttgtcaggactctaacttcctctggggtcaatctctgccagattctggctgccttccttttctgcatcccaacttctttgtatgggttctccaacaggtttcagcacactttcctcagttccacttgggtcatgattattcacctgcaaatttgatcttctttctgaggagaaatggcatccaacatctctagtcaactgtctggggaaaaaaactaatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaatgatgacaggaagaaaaccaacaaagctacctgcgaatatttcattacataattttaaacaacttaactatagataaaattgttttcagtaaacaaaatactttaaaaaaaaacaggtaagtcaaatcaaacatttactttagtgaaattgaaattattatttacctacctaagtgtcatctttaagaaaatgaaaatcaccataaatatttgtcaatgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttaggggatgcacatggtgtaataagttggaaatgtttaaaaaaagtgggttcacattatggaagacattcttgaacatccagagaaatagttgggcgaaaggtactataatgaaagctgttttaaaaacactacaagagtaactcatgcatgaggaaagaataaaaaatgaatgctgttgaagcaagaaagtagctactgcattcagcctgatgggtagtggagaaggttaaaccaatatgatactgtattaaaaaaaaaaaagaaggaattggaaaaatatgagagaattctaatgaaataattgcacggatgaatgcttctgagcccatcacatcctagtcacaattcctggtttcatttattttgtttcactgtttttcaatagcaagagaggaattaacagctaactgaggcaagcatcagcacagaggcagggagcattaggggtggagcagtcagggaacaggaagactgcagtgtcatcttgagtgacaccaaagaatatagccccataccacctatttcctccatctgttaacaacatttctcaaaaccagggctactgtcaaatttataaatactgttatttctaaatgtatttaactgatttaaatatgtttgctactgctggttcccttataatctccatttataatatttaaaaggttctgtgttggcattcagatggaagaaaaagcatgagaaatttcatcttgaatatgaggttatctaaggaaagaattcggttagcttcaggtgaatttattcttcccccctccagccccatcttttttatttatttatttatttatttatttatttatttatttatttattttgaaacaaggtcttgctctgtcactcaagctggagtgcagtggcacaataacagctccctgcaaccttgaactgccaggctcaggtgatcctcccacctcagtactctgagtgtctgggactacaggcgtgcgccatcatgcctggctaatttttaatttttttgtagagttggggtctcactatgttgtccaggctagtctcaaactcctagactcaagcaatcctttcactttggcctcccaaagtgttgggattacaagcatgagccactgcacctggcccttctttttctttttaccaaattatgcgtaagtatttccctgattggtttggggtgtttcgatttagtttaaaatagaaatatatgttttaaagtagtgcagacctctagcttttaatccagtgacagcagtaaataaaatgagatttgagaatatgctgtcattgatctgccctagcttcttttgttcatgaaggattaatagagaagaggtgatttttcagtcttctgtataacaacttctttggttcaatattacaggagccttgggtcactgtggtgaccatgttccctttgaccttttactttttgggttttttttttttttagattttctttgcaatttatgaacctcaagtgtcttaataagtaagtgcctctgtaggtagcctattgtgcagagttgcaataaaggaaaacactactagaaatgcaacacagcactaatcccattaacaaatgcagccagtgtcagagataccataagaggcaatttgactgagatgggaggacatcccacatcgtttatgggctgttgaacaagagactttcttagcctcatcagcaggttagctgcatatgaatcctcatttttatttagggacagagccccttgcttataatgctattggtcaaaaatgagcagtttttactgttgcctgcaacgttgctagcaccttatttggggctctttttataaggacccgcgatgaaagttgtagatggtaactgtgaagaaatctcccctccctatacccaccttttcaggctctgagatttgaataaaataacttttatagaaaatattttctatattaaattctataactctaatccaaatttgtagatcctcaatcttaaataaataagcgtagttttcttcaattttttatctaggatattttgtctcaagatcctatcaatgttacataatataaatcctcatattctcaccctgacccactaacttaacaagcagctgatatactgcccccatcttggccattctcacggattctataatacttctacagccacatctgctgtttccagctctccactaaatcatcaatgggcctaattttgccagaccctaggcccttagcactgtgatccaaataagttaataagaaatctctaattattggactagtagcaaaacttcatgcaatgggcttgggctgataatgcaacacaaacagtaacatccccttgttagaaacatcccaggttgccgtgcctgctgctgattcctgaatgcaaattgcaggtatgtttgggctctagaaaattagaaccagaaccccattagacaaaatcaggtatcaactcctgatttcacagttgagaaaaccacatccaagagtgttcaattttctgaccaaggtcacacagagactttgtgtcaacataaggccaagaatttaagtcttctgacttccggcctaatgttctttccacttcattttactgccactaagtccaagtcattaacattaacataaaaataatttgagcacatactccattgaaaacagactacattaaaatatcaaagatgtgaactgaaacatcagtctcccaaatggagtgagcacaaccttggatcgttctcacgttttagagagatgcctgtcagtcacttaagacccttaagattcccgaacccatgttaataaatttctagaatactttggatgctttagactacaaacatactagtaattactgctaaaaataatgtaaaaaatggaagctttattagttcacaaaacaataggccagaggtggtgaaagtccagagttagttaattcatcagtttaacaatgtcagggttctggttctctgtgattgtatcagctttcctttcctgatgccactatattcccaggcattagacacaaccatgggcaggggaaaaagtggctaatgcctgcctgtggcccttttctcagagttgagaaaaatttttccagtcaccttccccagtatattacagctcattagtcagaactgcatcacatgtccttgcctaaaccgatcgtggtctagaaaatggaattaccacaatttttttagagtaatcaacattcttgtgaatcagaaagccttcaagtatcttgacaaaatcagaattctgttggcaaaaaagaattaggatgtatgtaagggaggatggtgattgattcatataattgtgctatatttcttaattaccaggcatatggttctttttaaagatagttatgatgtaagatatcaggatcctggattcatcagcatctaacaagttactacttctggtggccaaatctggaagcgtctgttgcatgcaataacatggcacctgggaatatgcacttctgtgcccattatgactgatatgcgatacttggaagaatcattattctactcacagaaggaggaaacccagcaaatgttagagaacaagacttttaacgtaagcagtagtggaagatctgatttactcaccccagcccctttcccagatgtacttgaataaaagagtgagagtgaattcttttttttttttttttttttttttttgagacagggtctcgctctgttgcccaggctggagtgcagtggtgcgatctcagctcgctgcaacctccgcctcctggattcaagcaattctcctgcctcagcctcccgagtagctaggattgcaggtgtgcaccaccatgcctggctagttttttgtagagagatggggtctcaccatgttggccaggctggtctcgaactcctggcctcaagtgatccacccaccttgacctcccaaagtgctgggatgacaggcatgagccaccgcgcccagcccagagagtggactctttaacaatcaggctttatagtgcttcaaaatttagaccaggcctaagcaacagggtagtagggtaaggttgcaagtgggcaagcagaggtaacaacaggcaccttgtcttccaaacacacggagtagactaacttggctctagccgacagctcctgacagaggtgttgccagaacccgagctgaagtagaggcaagcctggagtgaggatctagataagttatgagcaactaaaagatgctacccttttccagctttctttcataaaaatcttactttttacgttatttcttctaaagctttctcattatgctgctagaaacccttctaaagatatattaccttaataaactagtgaaacaatgccagttttgaaaatgtgatcaggctgagaacccccttctccttctccccacttatgcttcaaagaagtggagaaaaggactgctctacctatggagtagccattctttattctttcctttcctaataaacttgcacacacacacaccacacacacacacacacacacacaagaagtgtagaaaagatctgaaaggtcaggttgtgtttagattctgaagggtttcctagtgctaggccaaattatttgtagtctatataatgcactaagagacgcagagaggaggtatgtacagagtagggaaagaatgaaaccagggtttcagagacattaatgtggttgggctgtgtgggagagaagagcagaagagaagagactagggcagaataaaataaagaagtgataaaatcccaaaccagggaaataactgaggcagaaagatccactggaaaaaaaaaaaaaaaactataataggaattaatgaaggactatctatggtaatctaggtgaaagtcatggtagaagttgactctagtggccaaggctgggtgacagagacaatgacagaaatgaagattatttttttaaaggagcatcagtggttttgttttcctgaccacaatattttcttgaagaaaaagatggcattcttctcttcctcacatctcatatttgtaaccccagaatatctcatacaatgcctggaacacaatatatgctcattaatattattgaagaaataggagcttgatttgtcatttagttgctgtcaatatgtctctgatactgtgatactgcagtggtaaattaacaatgaaaactaattttgtcaagcatttttcaggatatgcttttcaaatagctgccttcatctatagcatagagcatttctctactgcctcacatcttaaaatgttactctagcaccatctctagtgcgacaaaattacacacaggatacaagctcaggtgaaatcgttctgtcaatttcagtaagcttatacttattttctagactcctctgtgttctagcccctaccaaacagtccagcttcatctcttgctacttcaccttatcgctaaccctaaattcttctatctagccacagtgactcttctgatttctcaatgccatgctgttttctttgggtccttagttataggtagccacctttgcctggaaatgtttactccacttttacctttatgtggcacagtcctgctctttttaagcttttagctcagttacttccttccagaacttcttgtactcctacatatggggtaagggcctcccttgctcccatgatactctagcctttcttcacatagcatgtaccatactatttaattgcctgtttgtctacattcctcctgtatgaaccatattcttgtaagccccaagcatatatcctggttgtattagtccattttcatactgctataaagaactgcacaagactgtaatttacaaaagaggtttaattgactctcagttcagcatggctgggaaggcctcaggaaacttacttacaatcatggcagaaggtgaaggggaagcaagacaccttcttcacagtgcagtaggaaggagaagggctgtgcaaagggggcagggcgccttataaaaccatcagatctcttgagaactcactcattatcaggagaacagcatgggggaaactgcacccatgattcaattacctccacctggtctctcccttgacacatgaagattatgtggatgacaattcaagatgagatttgggtggggaggcaaagcctaaccatatcacttgtacttagcagttgctcaataaacattgtgaaataagtattgtgaagtaaacactacgaaattaattaatgaagaaaataaatgtaaagtatgttggttggcaaagttagaagtatttgttaaaaagtccattaatgatcttgtagaatcacgtaaacatgttgatatattagtataaatatattgcctacagattggcatacagtacagtgaaagtactacagtaagctgtacttggtctattttatgctccctttttcttcccaggaaaaaagagaagaataagataatggctatcagagaaagaataattggaacaccttagtcttaaataggtttgtttgacaagagtatgattaaaataatttcacatatagagtttaataaagcaatgacaaaagaaggaaaaatatcttcatatagccaaagagaacaaggaatttgcaaaattcatgaatagacatgaatagatgagaataaatgatgattggatatttaactattttggccactgaagatattagtaggcatttgcatagaaggcaaagcaaacattctttgctgatgttaatattcaggtttacaaatcactgtggtaagcacagttctgcccaggaacacaaagtgtgcgttcaacctacacagttgaaggcagtggctctggttctgccctatttactaggccacaattgctctattccccaaattgttctaatttacttaaagttactatatagtcaaaagggaatttcttgaattgtaacatttaattattttagacccgagatttttattttagtgtacagaaatactagtttagattccaataagtctgggacataatttcctttgtttactagactataatttgtgcttattagactggtatattattgaaatcaaataaacactgtaaatgaactctgtattttgtaaataataaaatattgataagaaaattcaaaacagtttcaaagtcattaataggtatattgcccaaataactccacttgtccttaaggttaaacctgtgttttgttgagaaagcctgctatacccccaatctgaattagctgctttgttttgtgcttctacaatactttgtacatacattattgttttagtcttccttattaatagataacttttaagtttcaaaagttacacctgcatttctgaaacaaatgaaaacatagttgtatgaaaagagataattttgtggattttcctccacatgtttctctgtcttggacatatttctatccatgctgttagcacactgacttaaaattgtttgttttagatccccctcttccattgaatctcacctcacccctggctgcaagttagaatcaccaaggacatttttcaagacactcaaatataccaacatttcctccctaaattctgatttcaatggtctgaatgaggtgaaaaccaggtgttacatttttaaaaccaccccaggtgttcttgctacttggtttatctctgtattccccatgttttattcttcctcttcttgaagtctcataagaaaatggtacctatagttgttaaataaattgattgtttttaaagagataaaattgccttaattggactagagaataccaaatctatttctaatttgcatacagaaatgcctcaccttaggcaaaaaaaaaaaaggcatcagaaaaattgaaagcaaaatgtattgccaaaaaataaattacattttcttatagaatttatataaagttggggtatattttagatggaaacatttggctctaacaagttaaattataagttttgaatatttcaagtataattaaattatggttcaaaattaacctgcacactcatctaccaccagaaaaatactagccattatttataaaaatcaaaattactcagtgatagttacttctccagggaagaaggtgagtcggtaataagctatgcccccataaccttacaatcacgctgggaagcagcagccagtagccaaactgcatcctggtggcactgactgatccttctgggaaccaagcccatgaccctagttttgtttcaaactcaaacacagaggatccctgcaaatccggttactcactgatgtgagaattcattttttcaaataaactgaaagctatggagtcttttttgggcactctagtccattacttttagctctttcatctaaaggaatttattctgcactttgttgcttattctctactgctgtttcttgattatttgctgaaaggtacctatcctgttgaggatggctgttgatattgcgtatttagtatttgtcctacggtttttatcctaatataaaaagcctgttctttcttctgtgctctccccgtctctctacctccgctgagcttcagattgcttttaaagggtgacctggcacacttctgtgtgcatgcactggtattacaaaacacaccttcccatttacttgtgagattaaatatatatatatatttatttatttatttatttatttaaagggattatgcttatatttaagaaaagaatttatgtctatataaaggaatatccatatcaagtattaggtcatatttatctcaagatgggaaataggacatattttaactacatgggtgagtagagaaataagtagtttaaactgctgttgtttgacttcccaagctggccacccctaagtgtattaaatcaaggatttttctcagcctagaaagttaaatagcaggtgtagtacttaatgaactgcagcgagttggacttattggtgtggcaaatagattgcgatatttctttccaattaaagttcttttgcaaagatcaatgaagcacattttcacaaattgaattacactaaactaataaacaaaattctcccattcccactgatggcaaattattgtttccttaacatttaaaatcccatcacaccattaattataaaatgcaagggctaggaaagatcaaatatttatttgctcatgtgtttctattttacttccaattttataagaaaggtaagaaacattatatgtaaagaaagctgcataagaataattttccaaacttgaatttttttggtctttgatccataagcactttttatttactaaataacatgcatgtcctaatgattaaaaggtctgatctttagtaaattagaaaagaatctgctatagagtaacctttaattaatgaatgcatggaacacatttacatcagaaacaatgggcttgatagaaaaatgaaaatagcttaggactttgcctctagaatcagtgagctgcttcagaaaaattaaaatattagtttagcaaccttaaatgtcattactttactcaaataatgcataaatgttatgatattcattttctaggacctcctcacccttcacctccccttgatatttcttttcaagtatactttggaagaaagtttatacttttatgtagttttcattttaaagtttttagtatttcaatattgatgcaggataacgaaaatggagtaacctcagaagcaaagaataaagctttaataggaacttctgttttcaaaccacaaaaggcaatatttggtgaagatgcacatgcaagatttcctctctaagaatatcctaggacttaagaagactttcccacaccgtggtctactacttcaaaattttcccagttgctcatgagaggatctgtattttgtgaacattcctagcatgatgaagagcctatcaaatagtattcccaagcctagtggcattttggtgacttgccaacccacgtctgtgtagcatctccaaagagatccagcataaagggaaaaaaaatagaaagaaaaatgtaaagaaaagtttctgatattccatcccaccccctcctttctcctcctctactaactccatgtttctctttagtggctcatctatgcagacgacttttggatttttatgggtcatttgatttaatttaaacagaaaatatgctgtgggtgtttgtcaaatttattttgcaaataaacaaacatacacacaggcatgctcaaaggcatgtcatttgtgacatacagttgcacacagaatgtcaaatgcatgtcataaatgaccatctgctaccattttatgcaggaaatgacattttaataccaaaaatagtagaaaacccataatatcagaaaaaatatttctttaaatgaaataagtttagcttcccaaacttacttatttttctcatttcttcatacaatggtgatgtttgtcataaatcaacataagcccacaatccagcttttgagaactacaataccaaatgccgtggctcaaccctttgtactaactagaaaggatctgaattatttctcaaagcataatatgcctactacttaccagggatcttgttaaatggacgtgctggtttggtaggtctaggagttgcctgagactccttatttaacaagctaccagatggcactgaggatgctcatctgtggaccaaacttttagtatcaaggaacaaaactgttttcttcccagtgttaatagctagcctgtcagccaaggcattattctttttagaacttttaagtatgtgtgttgggggttagtgggttggttattataatgagaagccttaaaaacccaaataatttaatctgtaaaaatgatgtaatggggcatcatttggagggataatatcttcttaatctagtaacctaaaccagaccaaacttaatttgtttacaaattatcttgggtcaaatcatgccacattaagtatcattattcttattctagttggcaatatcctcaccaacatttgtttctgattaaagcttctttaaattatttccagactattccttattattgattagctttttttttttacatgtattccagttacagatgaagcatagtattcgtatgacatccaatactttttcactggttagcatactgagataaaaagcagaaaaggaaatagagatattgattttaaaggaaaagtaacttccatttttgtagtattttatgatttccaaagggttaaccacaattaaactgccctccatgagcataggaatcatgcctgtttctccaaaactagccctagcacacaagaccagtgcctggccaataatataataggtatagtggattgaatagccccttccatcctataatgtgtcaatgtcattttatctgtatatagtggattgaatagcccctcccatcctataatgtgtcagtgtcattttatctgtaaaaagcatctttttagatgtagttaaggatcttgagatgggatcatcctggattacccaggtgggctctaagtctaataaaaagtaaccttatatgagacagaaaaggagacaaaacagaacagaagaggaggcaatgtggaagttgaagcagatactggagtgatgcagccaaagccaaggaaggctgcagccactagaggatggacgaggctaggaatagaatctcccctagagcctctgaagggagcatggccctgctgacaccttgattttggacttctaaccttcagaactgggagagaagcaatttgtgttgttttaagccatcaagtttgtgaaaatgtatcatggcagccacaggtaactaataacagtaaaaaagccaatattcatggaatgactgaacagctgaagtaggacagatatgagaaatcataataagaagagagaaattcagagtggcagagtaagttgcctaagtttgctcagccccagcatgatagaggtatttgtcaaatatctttttttaaaaagtcacagtacttccggccgggcgcggtggctcacgcctgtaatcctagcactttgggaggccgaggcaggcggatcacgagatcaggagatcgaggccatcctggctaacacggtgaaaccctgtctctactaaaaatacaaaaaattacccgggcgtggtggcgggcgcctgtggtcccagctacttgggaggctgaggcaggagaatggtgtgaacccaggaggcagagcttgcagtgagccgagattgcaccactgcgctccagcctgggcgacagagtgagactaagtctcaaaaaaaaaaaaaaaaaaaaaaaaagtcactagtattctgtatactagtgttggtctactaaaacttataaaatctgactagtttttaaactcttacaagccatccacagaagacaaaatgttagataaaataagattgtgaatatctttctctagagtaaaattaagcatttttataaatacctttcagcatccagtttttaagaagtttaagaattataaaatgttcacattataatcaaactggaccatgtttgtgagacatcagtgctcctgatcgtttaaacaatgagttagtccaattgcatgataaaaagaggaagtagttaagaataaaggtgaggcaggaaatttttgtcagaagacagacaaggatttgaatcatggctctaccatccaggtgcagtgagactttggccaagttacttaacctctctgtgcctcagtttcccaggaataaaaattataattcttttgggacatgtaaagattaaatgagaccacatttcaaggctcagactctggcatattgtggccattactatctagcaacaagcacacagtagaatttgatcagcatttgttgagtgtatttattcaaacctgcagttggactataataaactaagataatttaactgccttttggttgctcgagtcatctcagggcaatagtatactttttaagtgcaattcaaactattaacttagctacatgaagtcatataatgtgcagattctagatatcaaattttttttttttttgcatcctctcttgggtcatgagactttcaaaggactaccattaagagatcctgcatttgagaataagaagaaaaactttggtatagattcttttttattcaaatgcccattattctgaaattgatttactcttcctgatggaaaagtataaaatttgttggcctgcaggggaatttgcaaaaggcctatctggttaataagtcacttatctaattgatactagagtatcagcagggtgggttatgaaatcatgaaacaaatgatctgacagtcaattaattctgtttcatctttgtgtatgttcctagaggctctatgataggatccagtttataaataaaaaataaagagatgctttttgtctaggttaaacttgatttcattctgaacttatattgtacagttgttcatgagcatgagttaattgacaatgtttagcagtctttttttttttttccttttttgagatggagtctcactctgtcgcctaggctggaatgcagtggtgcgatcttggctcactgcaacctctgcctcctgggttcaagtgattcccctgcctcagtctcccaagtagctggggctacaggcacctgccaccatgcccagctaatcttttgtgtatgtattttttatagagatggggtttcgctctgttggccaggtcggtctcgaacttctgacctcaagtgatccacccgcctcggcctcccaaagtgttgggattacaggcgtgagccaccatgcccaacgtgtttagcagtctttgagaaaattttggttgaaggacattgtgttggatccaagtatactttggacacctgagctcccgcaatttccttgcatgagctactgaaagatagaaattacacacttgggcagtgcaattggattgaaatggatttaaatctcgtatctcaaattctatctatctttaaatctattattttataaaattatatagttcaaaatgcacatgagaaaaaagtgtctattaatctgacaattttcaatttatcttttgatgatgttattaaaactatccaaatctacttttggttgacatattctcttctaacttcttcatgaaagcttcaattcatgtacatgtgataataataataaaagttaacattcattgactacttattaggttctaggcacgggggaaggcactttatgtatcatttatttagtgtatgtggtttttttaaagcttggagtgactgttcaggaaactagcctaaatttttcattatatacataagaaaactgaggcacagagaagctaagttacttgattagccgaggatacaaagatggttagaatgtaactttgtagcatcatatctttgtgacaaaaagaacaatagccaatctgtgacgcaaaaacaaaggcggtttctcattccattctgtgcaaggcagagctgctcagagaacaaagctgtctttgaagctggggatggctccatctcaaatcagctctgtggggtgcagagtatgacaagatgcagccaacacagcagaaaatcaagttcaaaacactcaagttatttacaatcctttggtgccaaaccttaaagaaagaattcttattatgttttatgtatgtttctaacttgtcttcattagcttccctttgatatttttggcaaatcagtttaaccttcaaaagtcttcatttattctacttgattaaatcaaacaaatgaatagataacatagaatcaaatagcagtattgtctgttctgagaaagcaacagcacaaagaggtaaagaaaatgcaaattgaagctagatgattgtatacattactttattgaatgtcttaaatctgctcagatttggatggtggggaaagaaatacaaatgtttctagaatctacagttgaatatttgaactgctgggcatggaaggtttaaaaacaaaagctagttagaaaaaaagattgaaaaggtaagtttcagactctggcatttttgtcttttttaagttagtttctgttgaagccctaccttcaggattttcttcccaagtactttccctagagtatataaatcaatgcaacagtaccctgtaatagtatcttaacctggagaaatatcacaagactataaaaaaatgcttttagcaaaggtgtcaactttgcccctatatcatcgatgaaatgtcagcttgaaagtctaggtatgttggaaccattagagagaaaaagaagggaagacagattaaagaggccagaaagtaggcaatttaaaatgaaaagtttaggctgggtgcggtggctcatgcttgtaatccctgcactttggggggccatggcaggtggatcacctgaggtcaggagttcaagaccaacctggccaacatgatgaaaccctatctctaccaaaaatagaaaaaaaaaaaaaaagtagctgggtttggtggcgggtgcctgtaattccagctactttggaggctgaggcaggagaatagcttgaacccgggaggtggaggtggcagtgagccgagatcacgccattgcactccagcctgggtgacaagagtgaaactctgtctcaaaaaaaaaaaaaggaaaagaaataaagaaaattgtatggcacggcacaaacacagctagaacttttagctccataggaatagaattgaagaagttgaagataaattaggaaatggaaatgttgcaggaaaatgaaagggcactgttttacttcaggttccccaagaaatactctgagatgaagatctgcatccaggagtcttattagaaagtgctcttgggaacacctgtaagagaatgagagaaacagaattgtacagaaggagaagttacaatgcagtggcaacagaagctcagttgatcctacggaacatctggagctgggatggctcttcatatttgtctcaaatcaaagaaagggtttgaaactttgacccctacatcaacaagtcattctctgctagctggccttaggaaagggacaaactcttgagcaaggtaacttctttcagctgagggctattcctgacgatagacccaggtgggggccaaaaggagccaacactttctcagctgggagaatgaatgttgtggtgccaaatgagggatcaagtggggtatcacagcatccattagggctcaaccctgtgcttctcagatctccttacttcatgcagtcaattcatatcatctgggagcagcacctcaaagaaagattttggttagtctttgtcctgaagaaacttacaggagaaagtttcttttagacagactgtagccccatgtagcagttgttcctgaggttactcattgattctcttcttaactttcattctgtatttccatcaccctgggctatcatctatgtaggtctggtgaagtgacccaaatcctaattcctggggctccggcaactggtctctatgcccttttcaggctacagtagcattgcttgttcatttactgtcaaaattgggcagagggagaaccatggaatggcaaagtggatcacctgggtcccaaacatactttttgctgtttgcttctatagcaaacataggtaggtaggtagatgcctagctcttcctgatcatcaaggtcagttactccagccagggtaatgactcctctgcttttcttctgggccgttggcatgatgagcctgaagtgaccaggtggcaatcacagcttaaagtttaatggaactcttactgtgtacccagttgaagtgttttcccctgagaatacatccacattacttaaagttacagagacagaaaggaaaaattctgcaatcgggcccttgggaagtacgtaaagctacttctacttctatcatttggtctctggatttatatattcctatccactgggaacaaagcaccatataatagtcattggtttagagtgtagattgaatgctggagaatggtaccccgtccaagcaaaatattctctctaatctggcctcctcaaaaggccatcccagagctttctcaggtagacagccttggcatcatcttgagcacatttctacatctgcttttctgtgaagaaggtctctaggtctgagattatcttaggtgttatgctatgccatttgaataaacactctgtaagccttctgataatggagctggctaaagctttgtgtgcagaaaatgcagacccatacctggaaaatgtatctatttcagataagaagaaaggctacttctgccaggatagaaagtgtctaataaaacaattttgggatgggcacagtggctcatgcctttaatcccagcactttgggaggctgaggtgggcagatcactcgaggtcaggagttcaagatcagcatggccaacatggtgaaatcccacctctgctaaaaatacaaaaattaactgggcatggtggcatgctcctgtgagcccagctagttgggaggctgaagcacaagaatcacttgaacctgggaggtggaggttgcagtgagccaagatcacaccactgcactccagcctggtcaacagagtgagactctgcctcacaaaaaaacaaacaaaaaaaccattttgtcacaatgttgctttgtggaattctttgaagaatttttctgtatcagtgacccaacgttggtttcttttaatggtatgttgtgctgttttgtccacacacagctctgttcctggcaccacagctactggggtggctgatggaagatactggctgttgtcaaacggctaagtcaatctgtctattgacttgttggtacctctttgatggtagatgctctcttgaagacattagcatgtaatttacaacacagtggttccatatccattacatgaggctatgttcctctgttctatcagaggtaccacatctgatacctcagaagcattagggaaaatattttttggtgttttcagtgctacaccataatgaatcaatatctgtctcatttttgaagtgatcagattagttagttaaatggggatattatggagactaccacgctccatctttttatctttttaagggtgactctaatctccaaaaatcaccccctcctcacatttgatttttcccattatatagttcagaggctaaggaactaatataggggttctgtcacctaccaggtagctgaaaatgatcactagatacgtccatggccacatgtaacctggaatggggataggagttccttaattaccttgcctttatatgcccatttgcctcaattttaacaaagaaagttatgatgtgatgctttagtctcgagatatcaatgtcagcaattctcaaatggtttaaatatttcttttttcccattatcggaggaaatggctgtaggacccttttaagagaggaccaagtgaatgactactgtataccccttccatgatgttgcaaaatctttctacaagggaatcatgcctttccttttaaaatatcatagatctgagaattgactcaagtctggttagttagaaaagagatcttggctttttattggtgcttctgagttcagcttctcgattatatatgcttgatttccttggattacatagattgagcaatactctagttggctatctatcttgcacctagcaaagctatgttttaatcactttctccttaatgttctgcatgtcatgccaccctggctacccactctaatctttccactcgttaacttaattgtgcccaccttgcatctgacagtctaatatcatcacccactttctactttggaattcgatcatcctccttgcttactgaaaactcagttctgtaactatctatcttactgtcagtgctggcctagaaaggacagctgccactaccttcccagtgtcattggtgtccctctcaccggaacatttctcaacactttgatgaatggaataccctgtgggctcttccagagaacataatcaggagatagatttcctgtgcttaggtaacataccactctgccatccccacactgagacttggaggtcagactgggtattggagctccagagaaggtggaatcctcagtctttagaaaattggctacaccaaattcagggctttgaatgggaagaaaaaatgagacccaaagaattgagatggaaacaactgagtcaaagcacttataaattctaaatctccagatttcaccatgtactgcggcagtggcatttgtgagtatttattgtaggttattgctttttactcagtcttccaagaataatcctagtagtatattattccattcttccagggctattgccaggttgttaatcctttattacaggagagtgctcccatataggtaatctctcccatatccaatatgtcccatgccccttgacccagcaccctcagaaagcagccatttatataatcctgtagggctgagggatacatgtcagttacatcatctatctccttcggcatgcagttcctcttctaacagattcagcacttctctaggttgatcacgctctgatttaactctggtattggccaggttgccaggaggggagctatagatagatcctgaggggggcacatattgccttgcaagactcagttctttgaatcatctgcgaataaggggagtactaaatttaagaaaagcatgctccagttttgataacccagaaggctcagaggaatctggggatttaggatttttaattattttcacccagatgtcccatctgaattctttggatcccaattttccttcccattcaaggttctgaatttggcatagcaaattttctgaagactgagaattccatcttctctgcaattctgccacccagctttatcctcagtttgtactgccctccagttggtggagttgaaaatatcataggttgtcaaggagatcctctgattagttaccctcagccttttattatctccaatgtatccctggaatccagcaatagccatgaggtttcagagtccttctaatggctatttctcaaagaactgagatatgccctgcccttctttcatttccagattgcttactgtcactggaatttccattttatgtcaccactgataacattttaacaattgcaaagcttcaacatgtcaagagctctttgtacaacacagcctaccagcattaatggggtcctcattgccaactggtctatgaataatctagatccacaatctcattttaatgtttgctttctaggacctattctggtaccaaatcttttaaaattgggttccagggaaatagactttgaggcagagatttatatgtcaaagagttattagggatgctcgcaggaaaagaactgtcgggagtgagagaagcaaaaccgatgaggaagaacagtaatgaacttgcaacagaggcctcagctgatcctataggaagttttgaagctgcggtggcccttcataactgttccagatcaagaatgtgaccaggtcctgtaccctcatatgaaccagtcagtggatgcctaacaatgagcaaggaagctgtctttggccaaataaaatttccagtgatagagcctagttgtagccgtcagtagccaatactcctagcaactggagaaataagtcttccattcctgaaagaacatctctgtgacgccccgcagcatccgctacacactgaacacagaatattgaagtgaaggaactgcctaggtgaataaaaaataactatttttatttattgaaacaactatgggttgtttcaaataagctttctaaattaacatggaggaatatatatatatatagatatatatataatttcaacctttccacatttaagtaaaaactgtacatgattattttagtgacgatgctgatgtgctgacgatgctgatgtgtgtatttaagttccagctatatatttctaacagtcttctggcctatagtccagttataagcactaaacttggatttatgtagctctaccatcccgtttatggtgtcatataaatgtttttctttcctgtgttatgtttagatatcaaccatatgtctattattttattattaggattcttttttttttttttttttttttgagatggagtctcactctgtcgccaggctggagtgcagtggcacaatctcggctcactgcaacctctgcctcccaggttcaagtgattctcctgcctcagcctcccgagtagctgggcctacaggtacccaccaccacaccccctaattttttgtatttttagtagagatggggtttcaccgtgttagccaggatggtctcgatctcttgacctcgtgatccacccgccttggcctcccaaagtgctgggattatggctgtgagccaccacgcccaagcctattattaggattcactttacataaagtactcattagtagttgaacacatggatttagttatcttgttgcaatttgaattggctattggaaggaagacaatattaaaagtgtagttgaaaacatttttatggtgagcttcagggcatattatttgaagttctttggtgcctttttattttttattatttaatttggacaaagaagattctatatttattatattttcctttgaaatgggtggggtctcaaatcaccctttggagcataatccagttaaattttaaaagtatttgctaaattggagacatctggacactctggagttaaaattaaataggtataaacaaagaataattcaatgaggaagactaagtaacacaagtatagacatgtcaggccctagtgtatacctttttggagattagaaaaataggttgaagaacacaaatgaaactagcttagaaccaggataactgatgcaaattttcaaacatgtatataaatataatagccagtattacaacttaaggcatttttgaatactttggagaaggctcattaaagatgatataaatgtaggaaactacactgtacacaagactattcaatattagaaatattgagccggataaaggctgaggtgagagttacagtttgagttagatagctgtacagtttgggttacataaaggaatatcaaatgcatagaaatagagtgtttttgttgtaagcttttacttaaagaaagtaatgtaatgatatatctctacaagtaagatttaaggtaggagaaagtttttataaatattcagaaaggattaatgttagatattaattttctaacagtataaagactaagagctaggagttctctgctgttgaatgaggcttctagactacctcacttcttccaatataactgatcaaagacaagtttacagagacagaaaattgaagcaaaacagtcacttgcctgcaggtacttgacgccagtcccccatttctgaaagaacaaccttatcatactgggactccattggaacttctaagaaatcatggtgccaatcctttctgtatgaataattgctaaggttattgctgtgtccaaactaattttttctctttcgtagtaaagttctctcactggaaatgggtaaaagagactacaccatttaaagaaaaaaagagaaggtttaggaagcttgttgtaaaaatactgaagtcacaaacttattaagaaatccactccctagaatcttaaccctgacctaaccattagacacctctcacacagttttttctgtcaaatgagactcaaaaaattgactttgaagatctccacaagcatgtttcattattttcttgcagatatcagggatgtagatggctgtttctgaatcacagctgcagagcagctacatgataatggcagtcatatccatttatatttcaaattaacttaggagtaccatgaggatataatgttgtttgggccctgttaaaatcaggtctaccattctgatattctagggagagaacaataaaaccaacagacctcctatgggtattttttacaggaaagtgcatggctataggggatgatccaatgctggttcacatttggctcatgagagccaattgtgacatccaattctgcattaagggatattacgttggtaggttgattttcagccatagtgggaatatttatactttggtaatcaacaaaccctaaaactcagggcttcctttctgtcttttatcttctttttttaggcttagtgttaaatatttctacttgaaaacaagacaataaaccaggtgactaaagaattactcttaagaccttaattttttttttctagcaaagaacttggattcctgctagaaattcctgctagaaaggacatgactagtggtagagatgatgagatatttatctaaactggcggaaataacatactctttttttagaagttgaagatattatccactttaaaaattatatataggtgaaacccaaagttagctaattctatttgtaagccattcagtttagcatatccactacaaatagggaggaaacaaaatcaagtttatgcagaaaatcaatagaattcattttgaattgatagtatatctatttcctgtaacttttaagaaaaaaatatcctcagccaagtgtggtggctcacgcctgtaatcccagcactttgggaggctgaggcaggcagatgatcaggtcaggggttcaagaccagcctggccaatatggtgaaaccccgtctctcctaaaaatataaaaattagtcgggcatggtggtgcatgcctgtagtcccagctactcgggaggctgaggcaaagaatcatttgaacctgagaggttcaccctggagatcatgccactgcactccagcctgggcaacagagcaagactccgtctcaaaaaaataaaataataaaatttaaaaaaaatcctccagtggtattcctatggttgtgaaattagattgctggtccttctatcttttgtttctctctcttctgttgattctctctgggacctttattatcaacatagcttctaaataaggatgctccataatagaatgaaaaggtgagccacaattctatcagctttttctacttgtaatgggttcttaaaatggtttggtagaaatactgtaacatatttcaagaatgtctataattatctgaaatcctaactatttatgattctccagtgcctctgtcccaatgtataatattgccactacagaatagttgcgatttttgttgtttttaattatttctttggacaactttgaactaaagtagttacatcagctatgtattttgacacttgatagcatccagttcaatgttttattaacactggttagtactgtcttcatttttgatatttataaatgatatttctgccaacagaaagcatttttgatatttcataagtattcaaccacagcaatcagaagttttagggctagtaaatcaatagatacccaatcaaatgaaactgataattgcttatgctcaaagagagttagatttaagtaaggtgctatttagaggttgattgcattattaagaaattgcctgttaagtttgggttaacagctcagaggtgactgagttacctttttggtaatataaagaaggaaaactacttctccttaattacagaaaactgaaaagacaagtccacacattttttttcttcaaatatctcttgttggtctataatcaaccaggcactagattaaatgatgacagtaaggcaaaaataactgagatgactaattttaaaatgtattataaaataaagtaagtatagtacttaggctggatgggccacctgctgtttaagtcaaagcaatgttgtaatttaattttccatcactatttcatctctttttaagacagccaaaccatcctagggaatgtttgatagaaaatttgttgtaagggagcttctcaggagtagaacgtctctatttcagccaaacaaagctttctgctcagcttgtagtattagaaaaacatgcttatttgttcttacttgcacctattttatctgtcatttcctgcaaaataaacttctcaatataaatttctcacttttagaaactgacactttattattaaaataccaccttgtctttttaaaattccctcctttcaatttgggcagaacttgtgattgtgatgagatattactctcttgattcggttatgttactggacaaaaggggttttgtagatgtcatttagtttatttatgagttgacactgagttaatctaaaaggagattatccaggtgggcctgacctaatcacagcctcagccagcaccttaattgcagccacgtaagcccctaagcaaagaatccatctatgccatgatggactcctgacccacagaaactgcaagataataaatatgtgttacctgaagttgctaagtttgtggtaatttgttacacagtaatagaaaaccaatgcattctacatgcaagggagggaaggattgaagaaagaacaagaacgcaagagagtaagagacatgtgtccctcatctctcatgggtgtcttccatccagatccctgttccttaattttctttgacgatagacccacactactcattcttctgctccaacctcttactccacattcacagcatatgggaagggtacacacgtatacatcctttcttcatacatttaacataccctttcacctgccccagcgttatccatttttgcatcaggagcttttaaaagttaacacagaattcctggagggttgccaatttctttttagaataatttatgaaattttaaatgaatctgaatataacaaaatagggcagtttccaagtatatgtagaatattgcaacattcttagagggagaggaatatggatgtgagtatttgagttgtttctgctggattccagtgccctgccccagagcatgatgggccgtgggtgaactgcgcacctgctgctgctccagcaggcctgatgtatgttgcttggttcttcctcttaccacaaacttagcagcttcagataacacatatttactatcttggagtttctgttggtcaggagtccattatggcatatatggattctttgcttagggccctatatggctgtaattaaggtgctggctgaggctgtgattaggtcaggcccacctggatcctgctcactccacatccaccctctctgccccactgggttttcatctccactcagaaacagtcttctttaactggcaaccagataaaatcaacctaagtgaaggagtcacctttctccatattaatggtgcatcatcaggtatagaaagggaactaattaacataaagaaaatatcaagataataaaagaaaatttgttcctggaggacacagatcattggaaaacagagagatcttttaaaaatttaagtaatacactcagaacaatttgtgaatacactggtgtcccccaaaaaatttttttgcatagtgcctaaaagggaacaacttgaaaaagaaagaaccgtcctaggtggaaagctatgattgctaaagtaaaatatttaactagaaagagttgaaaaatacatatttggaagcctaaaaagtgaaaaagaaagacagaaaacaagggatggaaaatacaaaagacaccaaggatcaactcaagaggtttaatattcattcaacagcagttctagaaagaaaaaattaaaagagagggaggatagcaaataaatgataaaagaaaattcctcacaattgaaatacccaagcctttagattcaaagagctcactgaaaactcagcatattgaatgaataagagactcacagatagaattacccttgaactacaaattttcaaggagtctgcagagaaggaaacttgtaaatgagaacattctaaaaagcttctgagatttcaaaaaaatgacttgcaaaggaatgtgaatcagatgagagtcttgagttctcataagcatctgcagattctggatgaaaaaaaatgaatcaatgttttttaagttctgagagaaaatactttcaatctagaattctggagccagccaacttatcaaccctgaagcaatatcaggataagcacattttcagacatggcaaaaagttgatgttcaattcacttttttccttagcaatatgtttagaaatgtactccagcaaaagaacttcctcttaattaaacaggaaactagaaaacaactgactcattccaggatggcaatgaagaaatcttctagattaactttctgcagacctagagaacaagttccaaggtctaagggctctggcagggaggtctccaaggcaaaaagcaccgttaacagaagactacaagataaaactgactaaaagttctcttttttagttggggatgtaataaagaaaaaacgctacaagaaaaattagaaaaaaatgagaaactccaagaaaaaaaacaaaattgctcaaaaactcatgatctaaatctggtataaactgattttaaggaacgattttaagtaattggttatatgtttaaaaaataatttatttgactttaattccaggaacatccttctgtaaatgtcctaaagcaggggttactaaagcaggggttcccaaagcaggggttcccaaacccatgaccatggactgatactggtccttggcctgttagaaactggaccacacaacaggaggtgaaaggtgggtgagcaagtgaagcttcatctgtatttacagctactcctgtatttacagtacattcttgcactagtgcctgagttctgcctcctgtcagatcagtggcagcatagattcccacaggaagggaaccctattgtgaactgcctgtgtgagggacctaggttgtgtgctccttaggagaatccaatgcctgatgatctgtcactgtctcccatcatccccagatagaaccatctagttgcaggaaaacacgctcagggctcccactgagtctacattatggtcagttgtataattatttcattatatattgcaatgtaatagtaacagaaatagagtgcataataaatgtaatgtgcttgaatcatcccaaaaccacccccagtggaaaaattgtcttctgtgaaactggcccgtggtaccaaaaaggttgggaaccactgttctagaggttacaaaatccttagaaaagaatgcaatctatttggcctattattaaacatatttatacgttcataacatagtcataagcatatacacacttttcattatccattattagactgaacatattaataaagttgggtgtactgtttgaagccatagcattgaatgtaactctccacaaccctgacaatgaaaaggttagctggcaaaagatgagatttgggagatgatggaaaaaaggggtgaaggcaacaggcagggaattgaaggaaagtcaagtctttaaaatgtacatgttacaaaatgggaaggccaaagatactgccaaaaatgccatgttacaaaaaaaagtataataactattttatttaaaaatttagggtactaccaaacattagtggaagtagaaagaagaggatgttgtaagaaaaaagtcctcatcttatatatggaggaattaatagatacctcattaagaaagcaaatcaagaaacagagttgtacacaaatggagttgccaaactggctgtaaaactaaaagtagaaactggagaatcagatttttaaaagagaggtgttagaagacctacttttaataatagatctttctatattattttatttttaacacacatgagtaatgagggtaaagcatattattttaaactggattgtatttggtcataggaactgatagaaaaaaaattaaaattgaaagccaaagtataaaatacatggcaaaacacttcaaatcctgaaatgtttatatatgtttttacaaataaggtatatttgacaaaatgttaacataggtgttatatgtcagtaattacactattatccctagcaggttagggagctgacattaagccaactaagacaaacttagacacaatggggaaatagatttaaaaattaattaaaagctatttccatttagttagtctagtttctacccaagaatgtcttctgaattaactttcagacttcaaataaaccataactgaaataactaaatgactcccaatgcagtaaataattttactgagcataattaataaaattgaatatctggcttactgagtctggaataataaagtagaatgaacaatggaatagaaagaacccagcaatgatactaaggtgagagtacatatttagaatgcagttctgggtctcaaactcaaccatatgcgaatggacttgtgaagaacaaataggttttttgttctcttaccttaataatgatgggtgtccatttctacaatataacttttcttttttctcaaccctcatactttcactgaaagcacattcatcaagtaccatttattgaaaatgctgttctatattcaagagagagtatcagtatgtattggaaaaaggaggtatgtgtagatgttgtgcatttgaatgactattcaaaaccttactttcttgtgtagaggagataacacttaataaagtcaaagtcctttcaattgtttaactttttaaaatcagaaagtcatggctttgaagtatttgaaataaaaactggctttcctggtactacggaagcttcaacttgactctgcttttcaaacttcaaaaatcaaaagacttttatttggggtatcaaattccttgcttttataaatatgaattgcttggagaaattatcatttttactactgtaatatgaacttttgacaggttcttttgaaaattttttaaattgaatatgattgtgtgttcttcttcattagccagaagcaaggtcaatattttgaaagttcagcgtttctataattttttaaaaataatgaaaatcagggtcaaacttggaattttttaacatgatcttatctaaagtgtgacctaaatcataattcatatatggattataacatgggaatttaagatcaccaattctataaggtatgttattctctgctcctgcagctgaataacgttcgaaaccagaatcactgaaacttgttgcagtttcagactaagaccatactctggcatcatccctctccacagagaagaaaataaacacaattctgaactgtcagctccagaagctattgctcctcatctcatatggttttccttagttctagtaactgggctcttcattcatgcacatttgaccaagacctccccttgtacctcagttcaaatgaatgagtattttttttccttattctcagatatatatttattcattgacccatttatcaatttttattgcatgcctattatattccaggccacacaatatgatgggaaacaatcgttcttacctttagtaaacttaaagtccaacagaagaatgaaataggtcagtagtcttatttgactactgaacccggtatcccagatttgcttccctaacccagtcttcctaaatgcttctagggctggagtcctacccagagcccagtcactccacagttggattttgacagctttttgcaaagactttgttgaaattgacttgccatttgcctggacttgacatttggctaatatctgctgttggtccctggcctgatcacagacacagaccccatgaatatttctgatttcttggatgtgctaattcccattctgtctgtcttagtgacaaacaattcagcccgctctcatctctccctttgtctccttccccactgtctttgccttaactcagactttttttaatttcttgcctaaacaaaattttcttctaaaacaatttttctgtcttattttcctactccaacatataaactatctgctctatttaaaaagacaactattacttgcatcaaaaatgttgaaacccgaaagttctctgaattataatttataacataaatatacccctgaaaccactactcaagtctaagaatagaacattatcagcacctcaaaagccacccacaagcccactcccaatccctttctgctccctcatctccagaggtaaccactatgctgactgataacaccatacgttattattatattataataacaggccactattattgaactgtaaacaaataaaagcacatcatatatattctgtaccctggctcttatgttcaacatcacatctgagagattcatcatgttttcacatctaggaatagttcattcaggtttgttgctatgcaggataccattataagaatatactactaattattcattgtattattggctaacatttgaattattttcatattagcttattacaaataatgctgttgtgaacattcacaaacatgtaaatgcatatatgctgggttataattaggtgtgaaatttttctcatagagtacgtgtgtattcagctttaataattgatgccaaacagttatccaaagtagttgtgccaaacatagtgtatgagaatatacccacatgctttcaaaaacagttttgtcagtcttgtaaattctaacccttccagggagcgtgttgtagcattttattatagtttaaatgttcatttgtaaattctaacccttccagggagtgtgttgtagcattttattatagtttaaatgttcatttctcttatgactaatgtggctgagaactttttcaagttaattgactatcttggtattctctattatgaagaatgcctgattcaaatctcttgttcatatttgttttgggttttgtaatggttctatatcttggtgacaagttctttggcacttctattgaaagatggggtctatgtcccctcctcttttctttggcactcctattgaaaggtggggtctatgtcccctcctcttgaatctgtagaagcttgtgatttcaataatagaaaactgaggaaataacgctatgtgacctgggactaggtcataaaaggccatgcattagccacattgctcactggaaaacttgcttttgaagccctgaaccacaaggtacaaagctcaattcccgtgagactacaattttaaaggggccatgtgtaagcacttctgctaaataagcccattcttccagccattcccaacaaagcatcagacatgtcagtgaagctgttctgaactcacaacactagctcattctccaaatgaaactactgaatgatctctgtcgacatcattaaaaatggaagaatcatctatccaagccttgcctaaattccctattcataaaatcatgaatcataaaatggttattttaagccattaagtttggggtttgtcatatttcagtagacaatgttaacagaatttggtacctgaaagtaagataagtgttataataaaaccaaaagtatgtggcatcggtttggagatgaccagcagccttgaagatgctattggtaaaggctcaaaagaaaatgagtacactgttattggtggtggaagaaagcagaccctggctacgtagctgtggaaagtttggcaatactgttgcctgtggtaacataaaaagttgtcaatgtacctaataaacttaatggtctagctaaggagacatctgagcagagtgttgaagatgctgcctggcttcttctagctgcctataataaaatgagagatgagacagatgaactaaagaacaaaatattagggttttttttttagtagaatttggaaaaaacataaaggctcaaggtagtcttatatcccacaaaatatccataaaataaaatatagctgcaaggcaaagatcaaatcctgggcattaccagtaaaatattaccctggggaatccaggtagggctgaaagtttctttattaagatgttagaaggacttaaggtggcgcctcatagatcacctcagttaaacaagagtcttaagtaatgttaagggcattatttaaaactctctgctagaccatagtgcttctaaaggtattatcctgacgatattatcacagtggtgttatgagttggggaggttactctcaaaaaggtttgtgagtgaactttttgtctaatggagtagctcataaattgatatataagcaacctaaaggaattatatcagcttggactagaggggatagacagtacaaaatgaaaagaggcatttgaactctgaacttttatgtacagggagtaagctcagaaaaccattcagctgtgaacacaagctactctccatggaaaaattaggactccaaggaaagcatcaagacctcagaggacagagccaagattcatggagaatcattcttagaggggcagttctgggtcctaagcaaagaattggcaacacacacttgggaaattctaggatcactacggaccagtgactgctgtgcaccttttatctcccacttttttgagcagagtgtctactgtcactatcttatgctgtcccaccattgtatacgggttgtgtggagggcagataacttgtctgtttcacaaggtgtcacatgaagaggagtgataacctagaaactgaacctaaagcatctccttcacacatggacataattcagattatgagacaagattgtgaaccttgagccacacaggataagactttgggaagggagtttaaaagggatgagggtgtttttcacatggaagaaatgaaaatgatttgcgaccagaggttgggctctgacaattttttgacatggccataaattctttgacattccttcaatcaaatagcaagatcattgttttcttcctttatatctttgagggcttgcagctgctttggtcaatagagtatgattagaagaaattctatgtgatttccaggtctaggttaccaaagttatgaagctgcttttttatttgctgaaatgttcacttttggagtcctgagctgccacataagaagcccagttaccgtgagaacaccactctggagaagcaagtgcaagtatcccatctcagctaggcttagccttccagccatccccaacaaggtgacagaaatgtaaatgaagctgtctcagaccctccacaccagctcatctcccagcatataccaccagatgactctgttggtgccacgtggggcagaaaaatcccccaccgcaccctgtccaaattgctgaccaacaatatcatgagctataagaatatggtagtgggtataagcctctaagttttggagcagtttgttacacagtgatacataaccagaatagctgtcttttccaaattgttttgttagtgttctttatacattctggctataagaatatacggtcatctttatttttttttacttttacaattaaatttacaattcacttgatctatttgcttatcctgaataaattcaacactaattattgtaactcagtaatgtcttggtatcccactttattattattcaatattatcatggctattattgatcctttgcttttgcatggcacctacctgcagggagcagactccctgcatgtgtacattcaaggccaaatagccaagtccccagaatccttgaattcccttaccatttcctgacaaaaagaacaaataaaatgtgaaaaaagaaggaatgaaactgttaccacttgtagcaaacaagattatgtatgtaggaaaactatagattcattttgcctaaaacaatttcatataaatgcagtcatacaatatgtaatcttttgtgtaagtcttcttttattcagcataatgttttgaagattaatccatgttgttgaagtttatttcttgtcattggtgagtttattatctgaatatattatagtctgtttatccattctcctattgatggacacctgtgctatgtccaacttttgggcattttgaatagttatgaacactcttgccaaatactttctgttagcatatatcttcatttcattggtataaatgcatggaattgatatagctgggtcataaggtatgtgtaagttttagttttataagaaactaccagagcattctccaaattgttagtatcattttatgttctcaccaccaatgcacaagagttccagttattctccttcatatcaaaatgtagtgttgtcaatcttttttgttttagttattctaatgaatgtggatggtgtctcactgtgattttaatttgcatttattttatgacgaataagttattttttcatgtgctcgttgagcatttgtgtatctatctttatgaagtgtctgcaccaatattttacttacttttttgagttataggggtgctttctatagtctcagaaccattcctttctcagatatatgtgtagtgcatattttttcctaccccttggtttgcttattcatttcttagcaaagctaatgttcctctcaaaactttatgagaactgctattcttctgtatgtaatttgtcctttttttcctggctacttagaggatttttctcaataactttgaatatcagcaggttgaccataatgcaaggttttctttttatttaccctgttttggttttactggtttcttacctctgaaacttatatcttccagcaaatatagaaaaatgtcaaacatgaactcttcaagtactttttgcttcattctctctttcctctcttctcggactccagttgcaaatataatagacactttgatattgtcccacagggacatgtctccgggctctcttctctgtcttctctcttctgctcttaagccaatacagtgaatttttatttcagattgcatttttcagttctagaattttcctgtctacttaagcctagtaaacaggctttaaagaaccatcttgagtagataatatatcttttgatatgtaagagacacaggattattatctgactcctacctagagaaatctgataccaagaggctatatggagttggcaggaaaagaaaaagaagcctgagttgggagtgagctcctctcccatacagtgaagcaatggtgtgtatttccccaggtctacatgttgtccccttggaaggctcagattcatcataaaagggattctgcctaagagaatctcatggagaccatatgatcccaccatagtaataagctcctagaagcctagaagctaaagagaaggttgttgacagctagcaggagcaaaggcaataccaggtgaatggatgtgtaataggagatctctaaacaggagatctctaaaaaatttctaaaatgaatccatgaaaagaaagatatcttcctctgagcataacctaaagttgccccaaaacatcagctaaaaggcaacttggaataagaaaagaaaatagaatttgaccagatattccacctgacttcaagcatccagcctgttgcaggctaagctggacaagcagagaagcattaattggatcagagtggagattgtaatactacttgggaatgaggatgtatgatcaatacactagaatagattttattgtaatccttccgtgactagaaaacctatggggtttaatatttaatgtaagggctgaaaaaatattaatgcagaaagcaaatttgaaattactaaaagagaaagaataaggttagtatctgcatatgtgtatctgtgtgtgtgtatgtttgtatgtattcagtagcattgtaggatcacttctgtcatattatatccatatattaaagttatctatcaattatatgccttcatggtatatttatacacagataggattgtctgtgtgtctgtgtgtgtgtgtgtaaaatacttaaacattggccgggcgctgtggctcatgcctgtaatcccagcactttgggaggccgaggtgggtggatcacgaggtcaggagatcgagaccatcctggctaacacggtgaaaccccgtttctactaaaaaaatacaaaaaattagccgggcgtggtggcaggtgcctgtagtcccagatgctcaggaggctgaggcaggagaatggcgtgaacccaggaggcggagcttgcagtgagccgagatggcatcactgcactccagcctgggtgacagagcgagactccgtctcaaaacaaacaaacaaacaaaaaaaacaacaaaacttaaatattgacagtgatgcatgggaaaattgtatcaattttttttttagtttttagattttttaacttctacaatgaacgtatattctatttgacacacaaaaaaaatatactgtctttttcaatggactgtgagtctcttagtctgtttggtctgctataacaaaataccatacactgtgtagcttataaacaacagaaacttatttcctacagttctggaggctgggaagtccaagatcaaaatgccaacagatttggtgttggtgagggcacatttcctaattcataggtggtaccttcttgctgtgtcctcccatggcagaaggggcaaacaagctgccttgcacctgtgttctaaggttcctattgccattcgtgaagactttgccctcatgatcctatcacctcccaaaggtcccacctcttaataccatcacattgggcattataatttcaacatatgaatcaggagagacaccaaacagagtatagcaatgagttagtacttttcagttaacaaacaagtatctcagatattctaatcatgtcctcacagttatcatcattttcaaagttttgattttaatggtttgacacattagagagcaagtatttcagtatatttgaaggataaatcacatttaattccctttattaagtgatacacttgaaaattcccaaatactattgtaacattctccttaaggaactgcctttatttagactttcttcagtcttgaaattccattgtgatactcagcctcagagctgtaacatttgtcacacagataatgctttttgtccttgactttttttctctgtgtgtgtgtgtgtgtatgtgtgactatctcctaacatttttttttcatctcttctcttccctggatattgattacagcattgaagcatctgcctaagtttttactttttgaggctgtttgacatttaaagtatacataaaaaattctggtaaatctatgtgctttggtcattctttttttatttatatttttgctcttttactgctggctacataaactaaactatttacactccctcagtttttatgctgcctgtgagctaatcatttaactttaacatacattttattttgtcattgaacttgctttcaattattttctcctaacatttacagagagaccttacacatagttactatactgtcaccccatgttaatagctctctgctgtgggttctagacataaatgggtgtgtcagggtcctccatttctatttttcccccttacaaataaatgctttaatacattgaatgtgtaacttgctgccctttctacttgcatcttctctggttcttttaattattttatatcaccctgttacaaatgggtcataatctaaatatttatttggtctaactatcaaatgtttctttattgaataaaattcacaaaaatctgtggaaaaaatgcagtcaagaaagagggaggtaactttaccaaaaggctaaaaatcaagctgattaattcaacatttcttaagtttactactaaatatatataaaattactgaggaaaaaaaatcgacagtgatttccttttctaaattctgtgataatactatgcatagagagatcagtgtaataaatttcttaagctcaaaagataatcaaggctaaaaaaagaagtcatattttcaaacctacaatttagtttagattggtttaaattatagaatgttctggtacccagaatcaatctgcaagagatgtagcaatcttgatgaaggtctcagtaaattctttctttacttctagagggagtttaacagatcacatactgcctttacaaagtcctgtatttcataggtaacaaaatacccagtcagtcaaggatcaaatgctaatatgtggtgtttaatcacccaggagtgaaagatgccattgcataaagatatgattcctcccctagatttcaaagatatttaaacttctcctgcatctcaattctcctttaatcacaagaaaatcaccatgttatttatacggtcagtgtaacccgtaattgcaattattatcacatgaaatatatcaaagccactaatttccaacctgcttctatcacacttgtggttcaagtatggtagcatgtgttttgcagtgactgaattgtattaatgagaaatatacatctgaaaatataggctgtagaaaccaattgtcttcactgatgtcagtctcttcccattcatgctcctcaataaagatatacacaaaggataaatacttgaggggatagatatcccattttaagtgatgtgattatattacacattgcatgcctgtatcaaaacatgtaccccataaatatatatatgtaccccataaatatatatacctactatgtaccccaaaaaattaaaataaaaaaatcaaaaaaatgatatacatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagagttgtagtatagtttgaagtcaggtagcatgatgcctccagctttgttcttttggcttagaattgacttggcaatgcaggctcttttttggttccatatgaactttaaagtagttttttccaattttgtgaagaaagtcattggtagcttgatggggatggcattgaatctataaattaccttgagcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatctggctctctgtttgtctgttattggtgtataagaatgcttgtgatttttgtacattgattttgtatcctgagactttgctgaagttgcttctcagcttaaggagattttgggctgagacagtggggttttctagatatacaatcatgtcatctgcaaacagggacaatttgacttcctcttttcctaattgaataccctttatttccttctcctgcctaattgccctggccagaacttcagattaaagacttaaatgttagacctaaaaccataaaaaccctagaagaaaacctacgcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatcaagaatctacgatgaactcaaacaaatttacaagaaaaaaaaaaaacaaccccatcaaaaagtgggcgaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcgatcattaaaaagtcaggaaacaacaagtgctggagaggatgtggagaaataggaacacttgtatactgttggtgggactgtaaactagttcaaccattgtggaagtcagtgtggcgattcctcagggatctagaactagaaataccatttgacccagccatcccattactgggtatatacccaaaagactataaatcatgctgctataaaggcacatgcacacgtatgtttattgcggcactattcacaatagcaaagacttggaactaacccaaatgtccaacaacaatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattaacaatgagaacacatggacacaggaaggggaacattacactctggggactgttgtggggtggggggaggggggagggatagcattaggagatatacctaatgctaaatgacaagttaatggaaatgacgagttaatgagtgcagcacaccagcatggcacatgtatacatatgtaactaacctgcacattgtgcacatgtaacctaaaactttaagtataataataataaaatttaaaaaatgagaaaaaaataaaaagaaaaaaagaaaatgatatacattttactcctgaagtaaacatgttaaataaacacattgcttgtccttttgatcaatgtcagaaattgtggggaaaaaatgagaaaaacattttcctacataggattgcatgcaagtgatcccaattgacacaatatggaagacagtggagaaatatctaggctgcccataatttatcaatcttctctctgccctcttctctgtagtggacatttggtgtctgtcaaagaacaaaacaactatgtatacagtacttgcaaaaaattaatgttttctaaagcattttaagtttttcttttcttattttggatgtactgaaagccccaccccaaccatatttctctcttaattcatagttatatactctattttgcttcttctagcagttactctagaaatttcaacataaacatttaccgtaaagataatccatgttaactcttcagaaccatgcaagaacctataagcaatttatctcacgccacagttttctctcttggctaaacttttataaggtgatattttagttctatcttattttttaacactaaaaattatgttaaaattttaataatgattttgtattacctacatgattactatgtggttgtctcaagttttcttcttctatctcatacctttcttttgtggtcatttgtattctggaaaatgttactggcagtccattcatcccaagtaatctcagtgtttgtctctaataccctcattttgcctattgtcttcaaagtcttattaatatggatttgtagggaaccattttctttcagcagtttgaagacatccttctgtctccttctgtcttctggctcccactcttattatggagatatcacttttaatctaatagtcaccccttgaatggtccctgtcatttctttggctactttatgatctcctttgtatctttggttctctgcagtttcactatgatgtgcccaatatgaatttctttacatttattattaagattggtgctttttatcaaaagcaccaatggattattatgtcattttcttttggaataatttctctccatatcctatgatctcctactgaaatgccaatgagaaatatcttataccacttcacactattctcctttttgtcaactttaatattcccatctctttgtctctctgggctacatcctgttcaatttcttttcatgtatcttctagtgtattaagtctccctttagctatgtctaatctgctctaccccctcccccagtcttctgagtttctcatttcaattcttctctttctcctttgtggaaatgctattttgttctctctaaaatgtgactagacatttgtatagtctcttgttccttcatcattttctgatattgtcctttattttttaatatattcaatgtgcttattttagtattgataatactattatctacaatctttgtgggtctgacttgcagtccattattttttataactctccttcatgtggcttgttaccttatttattttgtaattgtatttattgtgacctctgtttcataataattctttgagaactggatttaaagagattcctctagggaaggcttattcatgcttctgcaggtatctagggatgtttggattcaagtaaaatgtcaaactattagagtcagggcttttcaggtcacataattcatgtgaatcctgggtccaaactcttaggaacgtgagtttatgattaacaattttcctggattttaaaaaacaaaatcctgtttcttgtctacccagaaccatgctggaacctgcacatattcttgatgtatctttctgaagtgcaagtttttctccaatttactcaatgttggcgtctcccagagctgcaatattcaacttcagtgggtactattcacattgtggtccatgtaaaaagcattccctggaggtgtgtagtgtcttatgcgatgctcttggtgtcaccatttggacatcccagttttaaatgagcatctctgatccgacccttgcatctacccaagcttggttttctttccccagatcacttgatccattaaagtacacggttttctaggtcaccagaaatgagcagatagatcctttgggcaaacgccacctttagtgataccttatctttagaaattttgcttattagttttccctcatgccaaactatagcccactctcccatgcatgccaattaatgaattttaaaagatttctcacataatctgtacattattgttatatgttttttactggaaggggttctctggacatttggtttatcatattatcaaaagcagaacctatggaatctaccactgaaaacagagacctaatcactcttctttctgcttctcataccacccctgtaggcagaagagtcattagccatggtttcagataataggagctctgcttgttgcagtcttctgtactctagtggctttctttgatcatggagagcctccaaggactcgaataataatgggagttgggggttgaggggcacacagttagaaagggagaacaggaggaaacttgtacttctaacttgtcaggttgatcatttgttcctatgtttggtattcttggcttccccttgtcatatacattgttatttcatattataaaataattttgcctactgcatttagaacctatgacttcctaataaggaattcattgatattaatttgctacctttttttccttctaaaaaattactgactttcttacagtttcacagagttataagaggaaagaaaggatcagttattgaaggcataatataagactctgctgtgtactatgtatgagttatttttattattcctattttatagagaataataacagcaacaatagtaatagtaataagagctaatatctattgtcaggcactgctctaagtatttgacgtgtatcaaatataatcttcacaacaacctgtgggttaagtgctatttctattcccattatatagatgagaaaataatcttagagaagttaatttttcaagtttgtataggtaatgatgataaattgggggggtttaaactcaggtctgcctgactgcagatcctatacccttactatatacaaaataggctactctcctaaaatcatattgggcatttgggaaggcagtatttttacttgacaaaacaacaacaaaacagcatttttggtgttgctaaagagttaatacaactttagagcacgagagagaatattttatcaaactgaaaaaagtttaatgctttggcttttcaaagagcatttaattctcataggcatgcctatcctgtatttcttcatcaattgcagatgaactattaactttcaaattggtcactgcagggttctatttacatctttaatagagtaaatatcaaaggaacataaagtgtaggttaaatctaagaggattttcaagagaaataagtgatgagagcaacagaatgtatctcaatgccctatatatcagtaaagaattaattaaatgtattaaggaaaatgtagtgtcaatttgctctaattgagaaaatttttgagataaattattaaaaaaacatttaaatgaagaaggtttggtctgcataatctgcaggaaacttgtctggccaccaaggacttttttgctaatgagctttgacttggttacagtccctctgagagagaagatttagtctacaattggcttactaatgagcactgtcaacatgtggattggtctcagatgctctactctaaaacaaggtggaagttatcctctcaactaaacttgttgaacagaacttggtcagcaattttccctaccaccttcagtcagctacaaatcaccacaattgtgtaatattctggacaggatataacgaataattattgtaatatgagatgaattataatttttgaagcatcaggagtttccctttaatagctctcccagccaaataactgatggattatgaattttaaagatcaacattattagatatttcctagatttaacatatattggaatattatttgagcaagaaaaacaaatattttctatatttaagcaagtctctttaactcttaaatagctatactcagtctgggtgttgacatgtcattttaaccaaagagaacaaattgaaaagcttaactttccaccaacttcacttttataaacaagttctaagataatttgaaataaattttgaaagctctaaaattttcacagaaacaaaattctatagtttaccatattgttaagcaagattgtgattgtcattttttctgagatagatgcaaatccatttatcctaaaagtttatcactatgcagttatatacttaattagtccactagggccaaaacttttcaaaatagatgaaatcactttagtataatagtgttgctacaatttaaaattatcctttgctctgtactagtgcagggaagtttaaactttccctctgaaggttctataattgaatctgctgaaataaactgacaatagacaaattagctggaggcaaggcttacaaatttattatgtgcaagcacaggggagtcccaaaatatatgagactcaaataagcgtcaatggttgaagcttaaataccctctttctggggaagaaaaaagcgaggaatgtagtcaattttagaggaagagaaaatgatttttaggggaaatgaatgggcccccaaaaatctaccacagcctgggacaaggttcatctggactctgagtgtagtgtcaactctagtcttccttcttgcacgacattcatgaatttctttcagttaacaagatatgtggagaagggattcacaactgaatatattctggaggatccagcttttaggtagatagggaaacttcagagaaagccttttcactgcatttgctattcacgatgttctctcagcttgaagtccaaaatggcatatattggggtatcattttatgacccccagtgctagttagaaatggccaataatttaatattaatcggtaatattgatcagtaaaagcactgatgtgtgctttcttgatttgcttcaatcttcttattgcgcaagtggttgggacactaaccattatttagaaatctagttatcaagtaaatgaaaattcttaggctacattctacacataaacacactcatttatgttttggcctttgtttctaagcttatctattattatagagtcacattaaatgtgaatggttagtctaaccgtgagatcactccttaacctaaccttagttctccctgcagctatctttaggaagagaaactcaaacacttcatccaggttgttttgtttaagcatataaccaattttaaagtttattttagtagagatggttggacttacaacttttgtgttgctttttaacttgtaaatttagaaggctctgaagattctggaaataaaattctacttatcagagacaacatccccacttttctttttagctcctgtccttttatgtctttttaaaacccaactccaagtagaccctttcttctgtgaagccttttaattatttacttcacctgtttccaatcattttgcacagcattcaaaaattcacctcaaattatatttcacaaagagataattgcgttatgttattcttaaattgttttattgttgatatcttatctgcagctagggtgaatgtttatcaggcaataggcctttcatctttagaactgaagatatctctgataactacttctcttctggagagaaggattatcagtcaggattgtttactgtggtaacaaacaatccccaaatttcagtaacctacaggagcaaagttttatttctcaatcacataaatgttcattgcagggacttagattctggttcatgtcatcttcagcactggatacaggttgaggaagtagctactattctggtatactgttcatttcattataaggagaaggaggaaactgataaaacatgtcacttccacacttatttggtcaaagtaagtcacagagtcattcctaagtacatcagaatgtggctgtacacttcttccacattgaggagctgaagcaatcttatggccaagcctgaattccatgtttaaggaagaggtcatacatgatactttgaatttaaaacaataatgctttctaccacagagggaaaatatagaaagataatgaacgtatatcagtataactttatctagctatttgttctaaatgggtgaattaacttgatatttcatttttcacaattctttttttcttaatgcggggaatcctgacaatctcgcatcctctccagcctcatagcctaatatcttgccaattgtttcctcctcactgtggctagttgataaagcattacataacaaatatatgtttaacaattactatttaatgagacagctgcaaaaataccttatatcagttcctcttgaaattgcaattcaccaagcatagttccaagttcattaaggaaacacaagaaaactcaacatggtacttgatattaagcatcttataattttataggaaagttaaagtacaaatagctgtaattcagggtggaatgtgatgaatgcttaacaagaaataaaaaaatgccataataacacaagataggaaccattcactcacaaatttggagccacttaactgccccaatttttgtcatttccatctctaaagttccattgattcatatttgtcttccttcaatgttcttgaactattctttaataccaggactcttaataccattttcttcttttgcactgcagggtcaggttcatcatttcttccctctctcctattactttaatctctacctttttgttattatgttttctccaacttaccacttttcccaagttttcttccccatcaataattcttctgaacatatatttcactttccttatagttctaaagcttcttgagctagaagtctcgatgtactacctgtacttctgcaattctcattcatgactccaaccactgtaatctgcccctgctatcatcctcaaaaataaaagggcttctcgatggctaaatccaaaaatttacatttctgcccttcactattgaaacctgttgaccgctccttatttctttaagcaatattttctcttagtttctgagacatctctagtctcaaagtacatatttttaaatcaatttccatacttttaaatattattttaatgttgatgtgtcctgtggacccacatttccgtttaccacatggatatcttacatgcaattaaaatgcaataggttaaaaactgaccctgtcaacctaaaaagaaactcactcagagagacaagctctccagaataaatgaatttattttggaatagcagagaatttcaattcagagtacacaagcaatggcaggtcatgggcatatgcaggggggctgaggaaagagggcatcttttaaagacaaagaaaagaagttcatgtaagctattttgaaaccaaaggttacaaagaccgaaggtaataggggttacagaagttggtgttagctaatttctaggtgagtatccttgggcaagcaacttacctggaatgctacaatcttgaaaaagttcttgctataagttttgttcacagtttatgtggaggaatgtcttttgagaagtcctgttacaaacattcaagcatgggagcttctttctcatggcctctctcaactctattttgttagaatttgacacaagtggctccgttttacaacccagacgtattctttctttagtattctctaatttgactaatgggttcaccatcccttctaatcaagaaacccaaaagatttagtggactttttaccaccttcacaccttctcatttctaaagagtcaccactatcttttcattctattacaacatgacttgtaattcttcctgctcctttcctctactctactatagtatccccagtgactagtaatgtcggacatataccagattctcaataaatatttgttgaattaattaactcattaccaccttttgatgtttcttccatgtaaaatgtccttcatttgttgtacttgtacaaatagctcaagtcacgctttctccttaaaatgttccctgactccaaaaagaggtacttactcctctgtgttcccatagtactttgttaataagtctattataggtgaaagttatttaccttttatgttatatttatgctactgtttgccttatttttcccattagacattgacattcttaaggacagtcatcagagtgctatttatttttggtatcctcaccgtctttgcaatgtttaggtgaatcagcacagggttggatattgggatggatgtgaagttactaaaagcttcaccgaagagacagcatttaaacagtgctgttttcaaagtggtttctgattaaactgaaagtaaacagcattttctaagagtgcccagaaggctaccttagctgaaatacagggacactttggaggaagaattcatggcaaataagggtggggtggtagatcagagatgattgtggggtctcctgaatgacagataaatgcattccttttttttcctttgggcagaggtgaactatatatggtttgtgagcagagaggtgtacctttctcaaatttatagctttaggaagttattcagatgtcagtatgtcatgtgaaatggtacaaagcctgcaaaggctattggaaaaatattgtgacaatccagaagggaagaaatgtgtaaatgagaagtaaaaaaagagaatggtaaggagacacattgtaaaggtaccttccaaaggaccaaggaatgtggctgctagaggataaggaagagagacgataactgagatttcaagcctgagtgacagaaggcgcgctcctgcttttaacaagagataggaaatacaagaggaagcatgagtttgtgggagaagattatgagttcaattttggatatagtgagtttgaagagcaaatatgaatctgaacgtgaatatcagcacctacttaaactcttcatatcaggattgctttcctttccctattaagtgacttgaagaactgtcagttggtcagatattcaagaccaaattctttctgctaacagcagcctttaataatgactgccattttgactgattggaagatgctatcctaatgtgatctaacagttgaagcataaagtaccactaccagtgaagtgaataacaaaattacaagacatcagaaatgtaaccctatgaattttaaatagaagagaatgcatgcttcaggattatttttatataatatgagggtagtgttaagaaccaaatggaaaaaaaatccttgtttccccaaattgattaaaattttgatttttcacagtatttccattatgatataaaggtgactgatgctcatttcctatactttagatcttttgaaatacattaattttccctgctgtgaaaaatgacattcaaaaacagggttgtagggagagatgacaactttattagtctgtcgtataaaacaagttcttcactctcttcaagatctgtttctttctacaagtgacagtctgacatattctattatcaaattctaagtagccttgataaagcaccaataaatttatccttacaactaaaaataaaaaggaattctataaatgcatacctaggaaaaaaatgttaagaggctggtcatcagaacgattctatttgccaggttttttttttttttttgagacaggagtctcgctctgtagcccaggccagagtgcagtggtatgatctcggctcactgcaacctctgcctcccaaattcaagtgattcttctgcctcagcttcccaagtagctgggactacaggtatgcatcaccactcctaactaatttttgtatttttaggagagatggagtttcaccacattagccaggctggtctcaaactctgactttgtgatcctcctgcctcagcttcccaaagtgctgagattgcaggtgtgagccactgcgtctggccttgccaggtatttttaaaggactcttacactgtgattcctgtgcatgactgatactgtgactatggtcgtagcaggtatagagcttctaccagtagacttttccactatggaggagagttttggtacgacctacttttgtaaagcattactcagactagaaatatttttaaattttcttagagaacgattactcaacgcagtgtaaagtgatggtttaaaaacatatatgtttctatatattatcatttatggattatatccatttataatccataaacgagaattccagtagataactctggggattttggaatttaatgaatgtgtatcaaattaagatctgtgcattatatcatttatgcattgaatatgtttgagttaccataaaatcaaccaaacatggtttgattgctgcctgaatgagcttctaatcattggaaaacaattggaacacagcagggaaaggtaaatacacaaagagaaagtaatggaattaaatgcccagtgcttcagctcctgccatctgctttaacttagactacatgtagtacctaaacagcttgatatagttgaaaaaaaaacacatttgttagcatgaatgctgcccccaagtaaactttcctagcctgttacatcccaaaatctgttatactcttttcagatcgaagccttaaactctgaagcccaattacacagaggtggtaaggaaggagagagctatatctactattgctcttggcctctctccaactgcacctctttggtcaccctagggaggagggttcctgtggggaattagtgggggacaggattggaaagttggcagagacaaaattcttgttgctttaaaatgccatatcaaggaattgaatttgtaatatcttaatgctttcatacagaaaaggttaagagtgatgaaaaaaatatttaaaacaaatttttaaaaaccaaacggctagactctcaagagtggaaagtttggaacctactataacaattcatgtgatcaataaacttcacatctattataacaaggcaaacgattcatagttagctgcacttgtactgactgatttcctgtaaagcatactttcattatctttcatgcatgtttgaaaccacctattctggtatgagagggaggaagagtttcataacattaaagaaactctacatcaaacttaactgaccctaattagcctaatggattaatgacattttagtacttatgatttatagtaaacacctaaaagcggaaaaggcttctatgatgtgtgattggaagtagcagttctacagggaaaagatgaaaactctctgaactcaaagaagattcttcaggaaacatagatagactacataaaataatgcctttactcccaacatactttttaaaaattctgtagacaaaatgattttgctgtttcatataaatatactcccaactctctcatgccctttttccctaccacttgtccagtgtgacacattgtcttctgattataatcatgctgtatcacccagctccactttttttccttgaagaaaattctgttgctggattgtcattctaaatgttttaattctatcaatttctatctcttcccacaataaacatcattctcacaatatatgaacatttttcccccaattctctgacctatatcttgaaggttagaataatataaacacatgataaaaagctttgaaagcttttgtgcagacatggtggttagaaaaaaatgttctccttttaaagacaaggatctcaatattgagtttttcctatcacagcttgaactttctatgaagtctacggagcctcctctttagttacataagcaaaccattaaaatgctctctatcagtcccttgtcattagcatatttttgaaatcacttttttcatcatcgcactagttatatgtttctttcctaaaatgtcacatctgttcagatatcccatgttcttctttactcacacctgcaacccacatttcattctgcttccaaccctatcttttcctgtcttttcttatcaaacttttctactataatatctcctctgatttcctagtctgtggtcaagaaaaacctctctacctctttgcttcattaatacttggtgttctctcacaataaggcccaataggtcattttcacaagtagagacttcatttttcttttctcagcataaggagaaatttatttttgttctatttcatcctacctcatgctactcatctcaggttagcataaagtagttcaccctgttttgaagcaaaatttctacccatatcaacttaatctcacctcaatcaacaacctctgggccatccttccctatttttggaaaatagtacctagtccatagttaccctctttccactattactattatcctgaacgaatgtaaaagatggtccatctactttgattagaatctaattcagtctttgattcctcgtactccaatgacagaaattcaagtcagtttagaaactaattcacataatcacaccatggacctttgtaattagctgaaacccttatacctctaagaatctaaattctgaaattcccatttctgcctatatcttaattttacaattctttatcacctctactctctttcatatccccttaatcaaaaatcttcaccagaattcctcaatacttatgttgttcaacttcgcccttttggatttgcttctcaccttccacaacagaaccccgtactttaattatttcacgtgctgttgcctggccccttagtcctattgtatatatatattctcatttacagattatatccatttataatccataaatgagaattccagtggacaactcaggagattttagaatttaatgaatatgtatctaattaagatttgtgcattacatcatttatgcattgaaaatgctgtgttcctttatcatgggcacacctcttggcaacctctcaccttgtatcaaagtactgtctcaacttaaagactgtatatgaagaaaaagaagaagtttggtctaacatggaccagaatcttcttctgcaactcactactagttttgtaatgctgcgagcttcagttttcttgtccgtaaaatgaagataacttttcttttcatattataggaggttataaaagccacatgacataaataccctggctcagggcagacacttgataatgattctccttgcttctacctccttctccacttaaagagggtctgtaacctactcacattttaactgtatctcaatattcttcctcggctctttttctcattctctacaataatttatttcaatgttttctttagacatatgcccccacacctggttcctgattctcaacatgtggcatgccctctttctttcctttttctagttaaaagactctaaatcatgaggttatgaactccctcaattttctttccacacttatttagatattttcccctgctatctcaggggaagaagtaacttcttttcaaggtcaaactgtctatcactaatattgattttatcatattttgcctctgctaagatgatattctatcaatgatttcttctctggcattaataatctctcacctctggatcatgtccccactcaactaatctgcttcatcctttaaaagaattaaaaataaaaatatacatttctacccctcacctcagtaatgaatgttgaaaactcttttttcaaaggtcaaaaatgatctggtcattggcaaatgctgacccttcatttggttcttatctctgcagtttcccacaatattgcccagaacctctcttttaactatcttcccatggtgtctataatgcttcccttccaggtttatttgccccatagtttcctgagtaaccttgtttatccatctttaccaggtcctcttctgcaattccaccacaaatctctccatattaaactgacattatgtaaataaaatggaattctacccatttttttcagtagagttgtttttagaaaaagaagtcatgacaaaattttaaagttattgctatgtgtccactcccatccatgtccttaatccagtctctaccatgtctctcattttgattgctgtgctgtgtattaaaacagcagtgctcaccataacatgtattgatcttttttcctatgtttattgaggtataatagagaaattatataaatttatggtgtacaatgtgatgtcttgatatacatacatattgttaagttattaccacaatcaaattagttaacacatttaacacctcaccaagagagtgagagagagtgtgtgtggtgagaacatttaaggtctactctcttggcaaatttcaagtatacaatacagtattgttaactatagtatgatctaacatatatgtaatgttaaaaagttgcattcatagaagcagagagcagaatggtagctaccaggggctggggtggaggaaatggagagacgtttgtcaaagagtacaagctttcaattttaagacatatttctctttgtttatggatgccattttattgaaaaatctaacgtgtttatttctcataggcatacgttagagcaaactataataacacaattctgttgaagggatgagcaaatgaagtcatacttgggccaagtctctatactatccctaaacttcttgatactttcaggtctactcgtagctgaatgttccacttccaggcttttagtccccatcctctgtgcttgctccagatcgcattagagtcctggagggattttcactttaatggaggcattgtcagtttcagagattaaggtgggctattactgggataatgcatcacatctgattggaggtctccagaatgtagactaacgttgaggacattcttcagtgaggttgctctaatatatatactcgacagggaaaatgtgttgtccctgtgtaatgacagcctactcagtgttttaagaagcatatgttggccgggcgcagtggttcacacctgtaatcccagcactttgggaggccgaggcgggcagatcacatgaagtccggagttcaagaccagcctgaccaacatggagaaatcccatctctactaaaaatacaaaattagctgggcatggtggcgcaggcctgtaatcccagctactcgggagtctgaggcaggagaatcacttgaacccgggaggcagaggttgaggtgagccaagattacaccattgcactccagcctgggccgtaagagcacaaatccttctcaaaaaaaaaaaaaaaaaatagtatatgttgctcattagtatttgcttggtttcaggaagataaattcatataagccaacaatataaattataacacataagatatgaaacaatatagattataaaattataaatatatagttatagataataatttttttttttttgagactgagtctcactcagtcgtccaggctggagtgcaatggcgtgatcttggctcactgcaacctccgcctcccgggttcaagccattctcctgcctcagcctcccaagtagctgggattacaggcacctgccaccacacctggctaatttttatatttttagtagagacgggatttcaccatgttggccaggctggtctccaactcctggcctcaagcaatctgcctgcctcagcctttcaaagtgctgggattacaggcatgagccactgcacccagccgatatgtaatatattatgaattatatatatcttatatgtagttcattgctagaccttctcctgtcttctctttgggaatatttcagtctcattgttctctcctattgggtctctcctcttttgcataaaattgatatatcaggtaacagattcatacagcaatcagatattagtgattctttacacaggagatttgatgttcaagaatcatatacaaaggtgattagggacctaaatttcatgctgtattatgtttcgtctctattatagaaattgtataaacagcctgcagtgtgttctatttcctttccatggccaaatgggacaaatagtgatttcaactttccttgaagcatcatgccagtgtaagaaacaagtctctatcatttaagctgcaaatttaaacaagatcagactttctttcctaaaacaaaaaaatcaaactgtatatagtcaaggatacaacaaaagcttgagggaaaacagaataaaacaaggaatcttcctgtttaacattatttgaaatatatctctgggaattgttttaaaccaaattttaagactccaattttttgttgagaatacaaaggtaggtgtcaaggtcagcacataaggcctttctctgtgctatttatccgcatgcctggagaggattacatggatttcagagacttagtcccaagaaatttacaattgagggcaaaagaatatgtcatttgactatgtacagtgttttataatatcatgacttcttgataaaaggattaaggaaatgggatatatgtatatattttgccaacatgtagtagaaaatcccaactcttcctctgctatcactgttcacttccccccaccccaaataaatgccatgacattctgtcacccaggctgctgtttttaagattagaaataaaacttgtattgaaatggagctattcaaatatatgtaccagcaaatggggctacctgcatttcctgatgctctgcaatgacaaagcagtattcacaagggaaggaaaaccatgatgaatattttaggtagctccaagtctctgggaaaatcagagagtataccaaagaatgtagtaaaattgtatgtttttaatatttatgaaatcctggtgaggttaaatatgcctccagactggtactttcttaatacagggaaataattgcttcagaaaaaaattgctttcagaataaactataatactgaggaatttgtttgggcaattttataatatctttaataaaatgtcactttctaacaaccaacagatacaaagataatagggcagtgctatatggcaaagcaaaaatatagaattacagttttcctttcatgatgctactgattacatgagacataactaaaaggcaatgaaactgatcacaagagccacacattgtatagttaaaccttataatgcagattatcctctcagaacaataccaaaggtagtgtatttgtgtgtgggatcaaaggtaataaattatttattaacgtgagaaatagaaatatattaaattgttaaataggctgtccatggcagggaatgttcaatttattaattatccatgtaaagaactagagagagagaaatcttagagcaaagaccccaatctatcagaacaacggctcttacttcctaatttaaaagctctttcaatgagggagatgattttgctgatgggagtgcaaactgggaaggagaggccttctttaataaagaggcagaggtggagaaggtgagcaatttacttttgctgcatacctttttttatctgcttccaatgatgaatggaaacagaagatttttcagattttactttctcatagcaacagtatcataaatcatggttatatttgaaagaatgtgaatgattccttcaactaaagatcatttagcaacaatctttgagcgcacactatgtgcacaaaactgaaccatgttccagggatatggaggcaagtaacacagacatggtttttatccctgagcttgtcagtctaatgaaagccaaagctagaaaaattagaatatagtaggatctaaggctataacagaacgtagaaagtcagtgaggagcagtggctggcaatggggttaagaaggtaggttgaggccagcttggcaaagaacctaccttgagttataggataaagagattggattttatgttatgggcaacttgtaaacactgcctttatgccaattatgttaaatgaacttccaaaagtatctgcttggcagcaatataccaggaagggaatctagaaatgactctaaaaaaatccagaatgattttcctcagatcaaattcccaagtaagcaaatttgtccaaaatctatttgccagaggttaaaattaatccttacaataaaatatatctgatgatacactgcacaggacagggaattttaggagttaccagcttatgaacatgaacctctcgatatttcatgaaaaataaaaagtatgcctgttcacattcatcctttaccagctgatacctctagctcttgttgccttacaaacttgtttttctaaaatatttggtatcataaactcttttatcaaatagaacggagtgaagcagaacagcaacaactctaaatttctcaaaaatatgcaaaatgctggagaggcagcctgcacctgcagccccaaaagcaaatgtgttgaataatcagggatcccaaacagagctgcactagagtaatttactcagctaatcattatatgaaatagaacattagatttctgcaacaaagttgcatcaaagtagatgcatacctcattcgattaactaaaacatcacaaaatcatttagctcattagatggtttttaataagcactccttcctgggagagggcactgtgtcttttatttatttcttgtgcttgacgtttctggcacatggagatgtggtctgcatgattcaatatcctcaactattcatctcagtccttagtatcttgtagaaagatcaccgtgctttcagatatttaaaatacccttaagataagcatggtatttgtttgtcagtaaaagtttgaatttgggtcttgaacatgtgtcagaacagggtatctcaccttaatcagccacagaactaattttcaggcaggtacgtgttaaagattagggaaggacagcagctttagctcacttcctttagctcacactaactgacctttccagacctcaaccaattttgaaacagaacttcaatttaaatggttttctagtgtaaataaaagtgcttgggtttccaagaaaaatatgtgaaattgttagaaaatgtggaagttgaagtgtctctaaaatgggcaatggtagtattctggaaacttattacagttgccaataaccagtttacgaagtagggcaaacatttttctcttctattttttcgttaccttggccttcaaattctcagtttattatctgagactagtatatagcttttcatgacatctcctacagcgaatagtctctcaaccagtatgagagtgcacgctagacacctgtccatgcccacctacaacacacaaatacacacacacaaacttacttatacactgcatacaagaaaaaatcgctgtgcagcaatactgttcctgaaatgtgaacgtatatggtaaagttgtggtaacttagtgaagaaaaggaagagtaaaccaggtatgctttgttgtctaacactgtatctatagatttgaggtatatagatttctagccatggagagttgggaactatatggcatcatacccactgtgcttttgtgtttgtttttttcttttttaacatatctacagttggtaatgaactaagcacagtggttacctctggaatgagagaaatggagaaggaagatttcactatgtttgtattgatttcacaagttaacatttctacaattggaaattgttttacaattgatagtgtgttggtttaattggaaggttttttttctttcttggtggcacataaaataacagtgatcttaagatctatatgcttcagattctgcaaaatactcagtttttaaagcagtagcatatgggtgatttttgctttcttatgatcttaggtgtttttaaagtttttagataaaaaagaagaaggaataaaaaataataaaaggaaaatatgtgacaaattgttgagaaacaaaatagaagccgatagtggaacaattcatggcagaattaaatattataaggtgaattaaatgtatttaacttattagtatacctgtctcgtctcaaattagaatacaagagactgtgaaatctaaatcacctttgaattgcctctgggatacagcaccttgtctgctaacaacttagtaacttagtaaacattggttaaataaatggattatgaagtaagttaacttttaaatatactgtgcaaaatcatttagaccatgttttctatttctcacattccttaagcatttcttcaaactctgcctgcttgacctaaggaaaccaaacctatggcaatctaaaaaaaaacagttcaaaataataggaccaaaatggaaattgtttggtttgacactatattttcttgataataatcttgtattgtactgacattatctttgatatctctgattaaaaagagcttattacagtcagcctaaccaagcatttagggtgagggttcttctctgtgttcacatggcactgaacattctctgacaagatctcccaacgacttgtctgtttgacctttttgaaaagggaaaaggtttcattcatctttgtaactgagatgcttagtacaatgcctagcaatgagtgttctgtaaatgttgagtaaatcacatgactgaatgacacagtttcacaatgtagtatcagttgaccctggaacaacacaggtttgaactgcctcggtgcacttatgcaaatttattataaaaatttaaaatttagcaaaacatacacatgcaggcacttacagaccatacatggtgccattcccaatggagagaaatggaaacaaatgtaaagatacagttttaaataataactacctaaagttaactctagaacaccctgtactactgtaataatttcatagccacttcctgttgctattgtggtgagctcaagtgttgtgagtttccacttaaaacaccatgtgacactaaccatctccccgtgagcagttcatctcttcggtaagttgcagatcccaataaaaagtgatgtctcccggttccagtgtatttttcattgtgctttctgcaatatcgtaaaccttaaataacaccgttggacccatacgaagtgccactagtgatgccaaaagttctcccaggaagcagagaaaagtcttaacattatgagaaaaaagttgaattgcttgatatgtaccatagatggaggcctgcagctgtggttgcctgccatttcagacagatgattcatcttgtacacagacaatgtgaatttgtggtattgataaatacagtacagtacagtgaaggtattttctctttcgtattattttcttaataacattttcttttctctagcttatggtacaactacagtatttaggacatataacatacaaaatatgtgctaatcgactgtttacgttattggtaacgcttccaaccaacagtaggctattagtagttaagttctggggtagtcaaaagttaagtgtggaattttcaactgtatggggtcagcacccctaacccctgagtattgaagggtcaaccatacttgatattagcagtgcttattggtagcagaccacaaagatctctcttaggaacgtagccatacagctatgttaagcaggtgtggcaagcacaataatggcccctcaaacatatccctatcttaatccccagaatttgagaatatgttactttatctggtgagagggatgtttgcagatggattaaattataactcttgaaagattactgtggattatccaggttggtccaatatgatcacaaatgtcctggaaagagggaggcaacagtatcagagccgagaaaggagatgtggtgacagaagcaggggtaggagtgacacagggccgtaaaccaaggaatgcaggctgcctgtaggagctggaaaaagcacagaaagggattcttctctaaaacttccagatggaacacagccctactgatacactttagacatctccagaactgtaggataataaatttgtgtcttttaagctactgaatttgtagcaatgtgtgacagcagcaattggaaactaatatatcaggcaaatcgttggagataatttggggcttcaaatggcaggaaactcaaactggtttaaataataggatagcaagaagatgcattggcttagatattaggatgtctaacatggggcagaatgagttgctccattggctcaatgatatcatcagtgatgccacttaatttctgtctctatctctgccctgtatttctgtttcactgatgttatcctgaaactggttcccttataagtttgggaaggctgccagtagcaattggagttaaatttgtccttgttcacttttatcaggaaagagcccaccttctcataattatctaccttgatagacttgcactaatcaggacccatccctggagctccccctaagggctacctgtcacagggcccatgcctgaacaaaatcagggtcctattaggaaaaggagagagggggtatatgccagacagaatatttgccatgcaccacaaagaatgtcacagaatcctgtgccaagaatgtgaagggataaataaaagtggttaaacaaattgcagggacactgtgccctcagtcacagacctaggaaacaagttccagcttttacttggcaatgtttccccttgctctataaggacagttgtataatggaaggagcagcagcagttagtaaaacctcatgactcgttctgccaggcttagactggcagttagactggactttcttccacctggggaatggcaacgtgcccagcaccttggctcatcataccaccgtctggcttacctgctgcaggtcactgaactctggagtagattgacatcagatagcctcttgtgaattatccctaaaatgatgggtttcctttgaaaactgctaactcttcatacatttctacatatactttactgcattcttctgtgattgaaatttgcttcttaatatgttttataaatatccaacatgacagttcagaggaatttcctacccaaccaactctgtagtcaaagtaacaggaagaaaaagagacagatgggaaattatttcatttaatctccaacttccaatgaattattttctctaatattacagaagaggaaatttgagaactaaggaactaagctgcaaagcctataatgtcagagctgttattagccttagggaaatatgattcccaagcccatgctcttccttttgtattccttggagtcactccaagagttggatatatgtataaagttgatctacaagaaatgtctccttctaatactctccatgtgacttaaggcttattccagaactggtcctcatgtcctacagggaggctaagaagtctgaagacatcggacattctccaaatttatgtaaattagagatagaggtgaggaaagatccctctagactagttccagaagaaagcaagagtagatcaagttgcttaatgatctccttaggcctgttctttcctttaattgtaagggaaatctaagcacagtcacattgatcatcagaattgattagggtaatttggcttgccaggtgggcatactaaccatggccctaagcacttgcagaggactaacaaacaccaaagagaattcttcctcttcattatctttctgtttctgggaatcctttgagaaacaacacacaaatcaccccaactcgtgtatatagctcaggatagcactggtctccaggaaacagctccagacttaatggacataaataagcaaggctctaaggttcatgagggcacactgcattgtatacacactgcattcttagttccagacatagtgcctgacccctggcaaatcactagtgttatatgaaggaggtaagagcaggatggtgagatggtggtgaagtgcactagatttatgtcattattcaagaaaaattacagaaaacttttccttaaacaaggtagaccaaacctatagtaatggcctttaaaacagtgcaaatttcactattgttgttcacggggtagaaactagaggcctttttacccaataagatcatacgaattttcaggttttgcaaaatgtttgttagcatttgaaaagcatttccagttactggcaatcttcaagaaaatgcctaaaacaattttcagaaatgcttctattgaactctactgaaattacattttatgtagtcctgtgtgattgcttctgccttattgttcaagaactgttaataatgagtgagagttttaatatgcagaaaatgagcaacagaatgggacccaaagttcttttattttattttttaataaaaatttaaagaccttgttagagtcagtttccaggaataatttactggcatgtatgttgtttaatttatttctaatttaaagacaaattaattaacacataaagaacttaaaacagagcatatcttcaaaatgagatggctcagaagcattcaggattcacaaaacgttttttcacggcagttgtgaatttaaatcacagaatagaaatgataagcaccacagcatgtcgggcagcagcagtatgctgaacatggacaccactgtttgcatcactgtttccagtggacattttccacgatgtgaagtcaattattgcttccacttctacattagtgtaattggtttttgctctccagaggagaatttattaaggcaatttcagtaaataagggaaagggggtccaatttgctactgaatccattgggtatggataatcacttcgattttcctccagatcctaggggaattcttggtcctgctgcatgtattaaaaccctttttcctctttgcaagggaaagcagaatgctacctttttttccccaggaaagttggtatgcttgatgaagacgattctacgaagcagtacccctgaaagtattgattagcatgattttaaagaatactcagggcttgtacagagaacagttcaaaggaatgtacaaagcatgcgccttctctaaacatttttaaatgcttagttcttacgaagaaaacacatgctaaagctaaattttctaccgtttctgcatcaaatcagatccttgatcaaatcaagaggtgcttttctttcattaaagtaactctaagtatgaaagagcaatgatacctttccatgtgggcaagttctttctgcatagagcataagacataatgagatataattcataaagatgttgcctattttcagccaacatttttcatttacagtaaaatatttttggaatgcccaggagatttcattatttgaataggaggctggaacatcacatttacagcatgtttggcaaagtttggaatataatgtagaaatcagaattatctgcaaaattgttgatgcattcttcacaaattctgatgctgagtgcagctggattctatgggtgaagctcagagactccaggtgaagagcaacatcactatctgtgccatgtccagggagacattggtgactacagtttttctggccctggagaccccaattcaaagtagtagtcaatctgttacttaatccaatccaaacaaagcaaagctaaagaaaacaaaaacactctattagatgtctctgcaaatacaccaagggctagaacaccatttaattcaggtgaggacaagcagttctgcccctattatctggagtgttgctttaaccctcagctttgctttgaaaaccaggcctcgctttgcatcctcagtgcaatattaattcagaactgacttggatttgttccttgggcaaaaggttaagtgatccataaatttatttccctgtagatttggaaaaagaaaagtaaatatcacggtgatttgttagccaagttttgcagcaacagaatcattgaatacccctccagtaaccagagtcaatgctgtgtgatgaatagaaaataattaaaatatttatggctcacccacgtgaatgatgccaatgaccagaaagatcaaatcctcacagaaatctgattaatgagaaatgagtctaacctgcttcatgtttgactaagaactaaattccatcacaaatgtgcaaagaagcataattcatccctgcataatggctttttgttaacataacttcactgtgaagaaatgcacagtatctctaaactacaacatatttgttgcaaaatagaacctacatttttcaaaacctgaccttagattttgtgggcccctatccagtgactcaacattagtgtaataagtacgtttataactcatggcagctggtgccatgtgcagcagatcttgtttctgcaggtaatagccttcagacttaagctctttcacggaggagggtgtgcttgaaaagataatagtggtggagagattcttagagatggcaccatcctctctcagcaacaatagctcagttattgagtatccatcaagtatatgacattagtctatgctcactgaaagtttccatattgaatcctagtctcctttttctaaatgaagagcattgctttcatgtccctttgtgtctccaaataattgttcaatatgcagccagacaataggctttttcttttgagagtgatggaaagatatgccaggtacagagagcatcatggagtagaaggagcttcatgagatccgcttgtttgggcttctgcctctctaagcatgactgttgctgaagcgtttcataaaggagctctgaatgtcacacaactgaggccatgcctatccccatgcctgtacctttgctcatgaagcccccaccctactttcatgcccctgcctcactctcctgtcccacaaaagacaactccattcatctgaaagctgctatcctcttaaaacatactatgcttgtccctgagaatagaggtgaaaaaacacatttcaaccttcactgaacttataatccaatagggaagataggcattatgttaagattatcacaaataattaagtgattacatattgcatggcactggaaagaggttctgatactatgaaggcatataataaggggtcctaagcatagtctaagaaatcaaaagaggcccccaaaagatttacttagactacactgggcacagtggctcacctctgcaatcctagcacttcggtaggctgtggcaggcagatcacctgaggtcaggagttcgagacaagcctggccaccatggcgaaaccccatctctactaaaaatacaaaaattagccgggcatggtggtgcacctgtagtcccagctgcttgggaggctgaggcatgccaatcgctggagctggggagacagaggttgcggtgagccaagatcgcaccactgcactccagcctgggcaacagagtgagacttcatctcaaaaaaaaagaaaaaagaaaaaaaaagacatatttagactagaagttgaaagaaatgtatttaatgaggataacaaggtgtttagaggaaagaccattccggccagacagaatctaacttgttaaggctgagaggtgggagttgggtgagggcaagtgttgtgaaaagtatatgggagagagattatgtaaaccacaggcaaaatgggaagtcatcaaaagacaagtgatgacatgatcaaatttagatttcttaaaactcattctggctattgtatacattattgttcagaaaaagataagtttctagaccagagcagaggctgttgcaacaattcatggacatggcaaacctttaaatctctgttgataaaacaactttgcccatcagcctgttatcactgacatattacttttttactccaggtgattaatatatatttaagacactggacccagaacgcttatgatagcattgttattttgaatatgagctactaaagtgtccaagaccatctcagaatatttcaatttaaaaccaaatctgttttttaatgaatatacctattaaaacacttaacataaagtacacttccccttaatcttggccactgaagatattggagttgtctgaaaggacttgctattcatgaaggcatgacaatgcctatctgcactgtttgttataatgctttttccccaatcatttttgttttataagtggaattttcctttcctacttaaatactgttggtacttattagcacccatttttccctagagatgctacagataatcctgtgaaacatgaggtgaagaaagttaaatataacagttaatatgaatgtactaccaataatacctatgtctccagtgtgacattttactcaggaaactgtgttgggtttcagagtagtgccatatttcatacaagggaggaaggtctgacaaattttcctctccacaaccagtatctctgctttcttcctccctatcccatgaataatgtataagaatttcaagcatcttggatgtcctcctggataaacaatctgtatccttcaccaagcaatgggtatgtacttacaagccagtggcagaacatgttttccaggcagcaaaactctttttcatttccctaatttctgcaataggtcatcaaacatgccatctgctgagctgttttccaaagcatatggctgctgcttcaagtggcaatgtagaagaataactaaaagaagtcatatgtaggagagagtaactaaagcacatactattgagtcactcgtctccatgtccttaattctatccctgagtcaagttgaattcctaaagtcctcatacttgaaacacattagatttctcctttccatattcactgtcaatgagatccattttaacattatattttcaccattgacaaccagagacaaccatagaaaacccatggtatgtttactatcaaatggtattgaaaatgtgcttagtcctgtcataacactaatagtcattagataggaagtgagcatgatgtgctacgcacagctttcattgttccagacaagcagcatagctagtagttcagtacacagttcagccaagacacctgggtacgggttctgaatctgtcactcaatagttgtatgctcttgagagttaacttcttagtgcctcatttgtaaaatggggtgaaagataacagtccctacctttgggattagtgtgaagattaaatgacttgatatatataaagcacctagatcacttcccagcacacggtcaacattatgtaaatcttatatatcagtatctcatttaaaccacatgcaatctctatttgatatatgaagaatctgagtcacagagggctaaataactaccaccaaggcattctgactctagagcctatgatcttaacgagttctttatataaagacttgtgagagaatatttttatttttagggttatatctttgttttattaaaactctaggccgggcacagtggcttacacctgtaatcccagcactttgggaggccgaggcaggtggatcacatgacgtcaggagttcaagaccagcctggcccacatggcgaaatcccgtctctactgaaaatacaaaaattagccgggtgtggtggcacgcacctgtagtcctagctgcttgggaggctgaggcaggagaatcacttgaacctgagaggtggaggttgcagtgagctgagattgcaccactgcactccagccttggtgacagagcgagactctttctcaaaatataataaatgaacaacaacaaaaaaactctaaacttattttttgagttggctgacaacaagcacagatccaaatctgaagttcaacaataaagtcattgtattgaatttgctggtttccatttgctttcacatggtctctttttcgggatcttgattttctattaatattccaatttggctctcacatattatctgccttttataataaccacctcataaaacgacttaaaaagacaaaagtagggctgggtgcggtggctcatgcctgcaatcctagcacttcgggaggctgaggcaggctgatcacttgagcccagaagtttgagaccagcctgggcaatagggtgaaaccccatatctacaaaaaatacaaaacttagccgggcatggtggcattcgcctgtaatcccagctacttgtctacttgggaggctgaggtggtgggatggctttagctcgggaggcagaagtggcagtgaggtgatgtcacagtgagccaagatcacaccactgtactccagcctgggcaaaagagccagatcctgtctcaagagaaaaaagaaaaaagcaaagacaaaatttatgaacattgttttttaagaaacatttttctctgtggagtcagctaaatatggaaatatggaaacaaagtttatcaaatagataaatgttgttctaacaaggaccactgaagaatgaaaatgagaacactgtataagactatgaaacaggccaggcaatgtggtacatgcctgtaatcccagtactttgggaggctgcggcagatagagcacttgagctcaataattaaagaccagcctgggcaacatggagaaaccccatccctacaaaaaataaaaaagttttagcctggcatggttgcacacatctatagtcccagctactcaggaggctgaagtgggaggatcacttgagcccaggaggccgaggctgcagtgagccaagattgtgccattgcattccagccttggcaacagagtgagacccttgtctcaaaaaaagagaaaaaaaaaaaacaactatgaaatagggagaactactttgcttttgacagttgcgtaacttttctatctcagcttctaacagtcatatacaggcacactgcactccaaacccaattaatttaacttctccaagtcaaatttcttgacacattatctttttacctggagcatttttactacttccttctacccagattgttttctgttcagtctttttcccttcaacttccttttatattttaagatttagctcaaaggtcatctcctctgtgaagtaagcattgtctgacaccttagccatttgatgtctctccctcttttgtgttcttaagatgccatatatataatattggtaaggcattctattgatttattttttattcttttaacaaatattcattgaatttctgctatctaatactctatattaaagtagaattatcatatatatgttatttccacttttaaaaatagggcgatgtttgatccatcaggaacctgaaacagagcagcatctcagtatataactgttgagggaaagaactgaccaaataagataattttatgatttatagtcacattctaatttttaaccaaaggtgatattattccaattggacttttactttccaccacattctaaataccttttggtgctttcaaaaaataaaatctacccttagaaatattcaaaagtgtggtatatgtccatcctcacgctgctaataaagacacaccagagactgggtaatttatgaaggaaagaggtttaattcactcacagttcagcatggctggggaggcctcaggaaacttacaatcatggtagaaggggaagcaaacacatccttcttcacagggcagcagaaaggagaatgagtgcccagtgaagggggaagccccttataaaacatcggctctcatgagaactaactcactgtcaggagaacaggatgggggagccaccctcatgattcagtgatcttcacctggtctctcccacagcacgtgtggattatgagaactacaattcaagatgagatttgggtggggacacagccaaaccatatcatgtggttataccataagttttacatttctctccaagtgatgaaaaaaatacctactattgctatatttttaatatatattttaatcataaaatgctaaaattatcctagtacatattttttaatgtatttgatacatttttcctgttggagagattcacatttttggaaatgctagaacaaaaagaatgcacatattccagatctactgacctggaaaaatattaacaaatatttttatattttatattttattaacaaataacaagctcacaaatagatacaggtttggtagagcctggcacataaaatagcagggtccctatttaagaaaaaaaaattattaatagaaaattgctaggtcctctccctcctaaggccttggaagggcctatacaagtgaggggccctaaagtacatggttcattaatgtcatggtatacctgcctgtgtctgttatgtattgttaaagggaagaggaaaagttaaagaatatatatgatctttacatcctcctgaaaataattaaaccactttatgttatgtatatgttttatgggcaaatgaaaactctggaataatgcagaaccaaattattaaaatcaccttcatcaagacagaattaagtcagagggtaagataaagtaggagtgtgtgtgtgcatccacgcatgtgtctgatcattttttagacacctttattttcattattacagcaataatgcactacttttaaatttcaatcccaaaataaactttactgggtggggaacaaaagcatgtgcatgtgaaagaattccaaaaaaggaattttttggatgtctttggaataagtccatatcttcccaaagttactatatgaatataccacatatattggtttctgaaattctgctatatttgatacaaaattagccactttcttttctgagaacattgcctgtattaatagactgttccccaggcctctcataaacacaagccacaagacaatcagataagaagcgagaacgtaaaagctcagtgacctaccaatggggtgccaggtaaaccatctctggtaaataaaagacgcccactgtatcaccctgaaatcacttaaatcaatcatgttttgaaatcaagagaaatatttctctatagataagacaaacataaaatgaatacaaaggcatatgtaacccacaagaataaaatataatcaagacaagtcaagccaaaaatatatctcaaaacatccatgcgggaaccagttgattgtggcagagaaaaatccaatatgtatttcaaaacaacttatcacaaaaagaaattaaggcaaattcacactaggaaaaaaatgtttttcaaaataactagttctaccaaaatttgtgcaatctaacgtgtgtgacagagttgtgccaacagtattttccagcaggagactctatggttccaaaaggcagaatttcatagcaatacagggctaatgattgcaatgtatgatggtagttctagcctcagctccaagcatgaaagcagatacctttctcttaggtgttctgacaggcagatattaaagagcagcatgtgtcagaagatgtaggaaatcaactggcctctttgacagattttaatgtagaatgtttgtactgccagggcagtgggtatgacaaatttgagagatgacagtaataggagtgtttaagtaagagaacaagcttaatagagatgccactattgacaataacttgcttatgttaaaggaagagtccttgctttcattttccactgaaaatcccaatgccaattttttgaatccatttttactaaatattacaaaaataccttttagtcatttgcaaggatagaagactaaactgccagttatattgcctcatctgtttttcaagatacctcattccatcatatcattgacattcttcagttagggcattagtctggaccgaggcagaacctatgtaaaacgttgaagtgactgtgaaatgactgcctattttttgttggagtgcacttcaaattaaccttggagcccaagctcaggaatggttattaaccaacgtttgtactgaagcccgacactatgtgtaggataccttgtaattatcttaagccaattgtccagttattctgtaccacaaataaaatgtatgaaacaatacaatttttctctccaaaaatatatacacattttgtatttcttgcatttctctagtattcaagttaattacagtttcaatattatacctccagtaatggcctccttcctaggtatttgaactcctccagaaatgttttactctaactctgtatgcatggtcagtggtagagcatttgggagggtgaagtgccagttgtgaattgatgctaaatgaatgggtatgcttttttttttaaaaaaaaaaaaaaaaaagtccttttcactcatgggctttaatacccatgtaattataatgatttcaaattctctcaaggctaaaattaaacttggcttcctggatggccaaacaattgactattcttctacaccactcagctcccactttatctcaggctcactttgagcacaaactggttaaaaacagtcataatccaaatgctgaattaaatatgactaaaagatataaactgaatgggcagtttaaatctagtatcatccaattagaaccatagtggagcattcatcccctttccacctccccacactcccaatggagtgggagaggcaggggagcacagcctgagttctaggggcaagtgtgggtcatggtgctaaagtccaactggatggaatatgtagagccaaggggaaagttactagaagcatagttccattggagagcaagatcaatgtcacagagatgatctgaaatggagctgccagtctatagaaggcttggcaaaagagacaaggccatgtacaaaattgataggcagaaacaaggagattttcatgagaaaggagtcttgaaacaagtgcagagtaaaaccaagaaatattgctaaggttgtgaagaggcagctgggtgggcaagaggattaggtatttgtgacttcagatgtgatggttcttagaagatcttaaggacagtggaggacactattactacaccagagatcacaaaatcatgacctgactgttgacaggctgtttgcatatggatttgagcagagacactgaacccaaacatactgggtatgaatcttgaccctactacttactagttttatatgatacaaggcaacttccctaagctttgtagcttcaatttcctcttctgtaaaattgggataatcattagaatgattttgagcagtaaattggttaatatatgtaaaacacttaaggaaaatgaaggtcaaagaaggaaaaataaaaatatttttgcttcatctttttcattcaaaatttcattaaacgtatttcttctgatctgatgaaataaattttaaactatattcctaaaacttagattacctaatttattgaataaaatataaatgggaaaattggcactacattttatccaccaaaatgaaaatatcacattgaagaatgggttaaatatggtcaattaaatgccaaagctttaataatagtaaagaaggaaatgggtagaaacacacaaggccaaaggaaacacagaggatacaacagagggaaagaaatgtcagtggaaaacagatcatggagcggtaactgacttaacagagtgggagaagtagggactcaaatgcctaaagaagacgacttccacataaatgagctaatttccaccactgagctccctagccattctggaattgatgtcaccagctacaaagaatttaagaatgaagtttggatctgacacattgtataaagagcattctaagcccctagatcttctctccaaccctgctcaaccaggcaactggttctatttgaaccacaattatcaagagaaaggaggtttgtccttcagaaaagttaaatcaaaaggggccctggactcaggaatacaaggcacaaaatatgaacacaacgcagagatttggaccaagagaattctgtccatctttccccttatccagttcctggaacacaggtcaccagtgagcaaaccacaagattcattgctgaagaaattgaatagaacccaaagaaaatgcctacagatactaacatttgagggtcacacattaaaaatgtcagcttgccactcagtctcagaattttttttcttctttttttgagatagggtttcactcccatcacccaggctggaatgcagtggcaggctcttggctcactacaacctctgcctcaagcaatcctcctaccttggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaagaaataatcttaaattcatcaaaatcatcaaaatgaatttgatgcatttgacctggggaagaatagtattgaaagaagttttatagttctgaagaagagtttaggagtaattagtgacaggtagatagaaaaccaacctacaaaggaaaaaaaaaaaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttaaaattgatgtattaagaaatactagtggaattcattattatccaagcagctaaaataatttaaagtaggtattgctgggaatgaaacttcgtggtggaagggtttaaggcagaagttatttttcactatagttctatagaacttgatttcttaaaccatgtcatatattttctcaacaaaagttaaaattgaagcacaaatatcttgtatgaaagcagtcatctaatctcttttcttgaaattagattaaacatattttcgtgaatctcagacagtttatagtgggtaacttatctttgttttggttgaatgttacaatagtttatgctctgctctttggctatcagcccctgaaggaaatatacaaaatttggctttgtcttgccatgtcccatctatcaccaggtagggaagttttgttcaatgatcccctgaattgagtttaatatgttattttttaatgttagactagtccactggataataaacataaaaggcaagatatttatttaagtatgtactcaatggaaattagtattttcaggtctaaaaaatttttatgaatattttcccaaaatagcaaaataattaaactaaaatataattatataaaatataattaatgaaaataaattgttatacatatcaagatcatttaagtcaaaatgtgtgtgtcatctgtgcaaaattaaacatgatcctatatctcttttgcgtttgattggaacaaaggatattttagacccccaatgctttacaacactcataatgtgaaattggaaaaacaaaacagaaaattgttatacatgagaagtaatgaaggtattaatttctagaaaaagaaacacatcaaagctttagatttgctctaaaaaatgttttgaagggtgaatattgtgctattttgaagagactcctaatttagaaagctcaaataatgtctattttttaaaatggaatctttctccagtcataggaaatgtaccaccacaactatgtaatcaatgtgaagcagatggtggagcaattatctggtgtatttgggcactaccattggccaatacacagaatatgggccaggaaatttattctgtgttttcaagctgcttttgggttgtgatggatagtgttgcttaatgaaaatctttgtattaatttagtttccattttacagtcctcatctaaataggcatctctctttgtctctgtctctttctgtctctatttctctctctgtgcctcttttttctatgtggctttttttctctctctctttctaagtcaagtaagatctatacagtgatgattttagaaatctaataatttgagctttatttttaaatatcagcatagcttgttactttttttttgaggaaatagctactccctataccagtgtacaaatctgagttatttcatttacttaaaatcatctagagggttcacaattgagagaagacactattttgctgattctgattatgtaattgagtaaaaaaactttaaaaatacattttaaagcacctactttgagcacttaggataatatcatcctaagagatattttacctttaattccaactaaaaattagctattaaactcatattggtttcaaacttttattttttactttgtctttttagatcagttttagtttcacagaaaaattgaaagtacagagatttcctatatatcccctatccccacacatgcacagcctccttgattatcaaaatcccctgccagagtggcacatgtgttacacctgatgaacctaaatgacacatcattatccttcaaaacagttcacttttggtgtggatttggacaaacgtataatgacgtatatccatcatgatactatggtatcgcagaatagtttcactggcctaaaaatcctctgtgctctgcctattcatccctacctccccacaactcctggcagccacagatctttttattatctccatagttttgccttatccaacatgtcacataataaaaatcagacagtatgtagcgttggccgattggcttctttcacttagtagtatgcatttatgtttcctccatgccttttcatggcttgttagctcatttctttttatcactgaagaatattccattgtctggatgtaccacgctttattaattcacttactgaaggacatcttggttgctttcaacttttggcaattatgaatgaagcttctataaacattcttgtacaagtttttatgtggacataagtttccacctctttgggtaaatacaaaggaacactattgtgaaataattggcaagagtatgtttacttttgtaagtaaactgctaaaccatcttccaaagtagctgtaacattttgcatcctcaccagcaaggaatgaatgttcctattgctccacattctcaccagcatttggtgttatcaatgttctggtgtatgtggtaccttactgctgttttaatttgcatttccctgatgacatatgatgttaagcctcttttcatatgcttattcaccatctgtctatcttctttggtaaggttgtttaaggtatttgacccatttttaaatatttttatggtaagttttattttagtttcaatgtgcagatttgtgatataggtaaactgcatgtgacaggggtttggtgtacaaaatagttcatcacccaggtaataagcatagtacccgataggtatttttttctgatcctcttcctcctcccaccctccaccctcaagtaggccctggtgtctatttttttttcctttttgtgtccttgtgttcttatcatttagctctcacttataagtgagaacatgcagtatttggttttctgttcctgtgttagtttgcttaagataatggcctccagctccatccatgttgctgcaaagacataatctcattctttgttatggctgcatagtattccatggtatatatgtaccaatttttctttaaccagtcttcagttgatgggatttatgttgattctgtgtctttgctattgtgaatagtgctgcaatgaacacacgtgtgcatgtgtctttatggtagagtgatgaatattcttttgggtatatacccaataatgggattgctgggttgaatagtaattctgcttcaagttcttctgcgactcatcacactgctttccacaatgttggcccatttttgaattaggttgttttcttattcttgagttttaagagttctttgtataatttggataatagtcctttatgaggtatgtcttttgcaaatattttgtaccaggctgtggcttggctttttgttgtttattttaataaagtcctccagtttgtttttttaatgattatatttagtatcttcatttatcactcactattttgctctgcagttgctaaaagtacttagacacattgtatatatacctagttttagaatactttgtgcttctctgataattcaaaattttgagttctatgtataagaaatgactacatggtaataatggtgatctgtaattaatattttttaatgttttattgtttttattttccaagcatacataaaagtgaagaaaataatctaataagccccatttgtccactacccaggtttgacaactgttaatattttgacagttttgtttcattgatcccttcttcttacatgttcatgtgttttgttcttaagattctgaattcccaaagaatatatttttaaatttaaatattgacaacagcaaaatagtatggtttctcaaaatgattccacaaaataatttttatctatttggttgtttatgttcttatatattattttaaaaatgatttctttagaaataactgaaatatttagtattcagaactttttatagatctacatcaagatcttttgaacatgtgcaaagttgccactgaaacataaaatgtatcatctttgataaatagcccttaaaaaaagcacttttctttagcttttttcctaaaaatactgggatttactaggaaagtataaaaactatactgtatgtttctaattttagagtttataaaaattttattctgtttaatataataaaatccagtgcagcttgctgtaattgttgattttggcaagatactctagtgtatgaatgccactgagatattaataatcatagtatctagttaatgcaaaaaagcttgaatttatataaattttttaattttcttttttttttttttttgagatggagtctcgctctgtcgccaggctggaatgcagtggtgcaatctcggctcactgcaacctccgcctcctggattcaagcgattctcctgcctcagcctcccaagtagctgggactacatacaggcatgcgccaccatgcccagctaatttttgtatttttagtagagacggggttttgccacgttggccaggatggtctcaatctccggacctcgtgatctgcccgcctcggcctcccaaagtgctgggattacaggcgtgagcccccgcgcccggccatatttttaaattttctaatgcagattgcttgtcttataggtgttcaaatttttctattccttcgcaactataattcccactttacccctaccttccctgcagtttatccttgggagtttttgcatttaatagcctcactgtagatcaagggaccccaaacattggcagtctatttaacaaaatacttgagctgatttattgataaaactagatgcaatttatttgcataagagtcttttaggaggcaagaggatagatagatagtcaaattaaagacaatagaaggtaaagcacagttttcaaggcctacaatgtggcttattatttctttgttttcttctctaatgcaaaaattggctctgaattgcacatctggaatgactatctgaagtagaatttttttaaatgcctagtgtcattcctcctaaaatgacagcatcttgttcttcatttgggtagttctccgtatgcactctcacttgttctggtcagcacttaatcctggcctggtgaattagtaaatcacacccttccgcctgccagccacatgatccaagctaaccaataagggaaaatttttaccccttatgagactgctaggcaatagaggtactctttccatggaatttgaatttggtaggccatgagcctgaacccagactaccaagtggacagagtctgcctcagtatggatttacactgctggaatcagaatatagagacaatgaaagaaggcatcctaataacatcattccaacctcttgatccagccattattggagtcagtttatttgaatttctgtgtgataaatatatttgttaaactttaaaaaaatttttccctttgccacattgagttgactttccttcacttgcaactgaaaataccctaatattccatttattcagacaagtcacactccatattttctaataattgtacttccaactttgccatttttatgcctcctgtatatagctaaatcatgcgtgcctcattactttaactccaagtactcatcagtgcccttgatctcaaattgtctactagctttcagcaaaagcccatttgatccaagtgggctagcagatgaagaggttaacagtgagaaagtatgatggagagaggctgaataaagaacaaactaatcacatgttgctttaaattttctatgagatataaagccaggtcatcggaatgtaatattatagaatgttagctgaaatttccataaagatgccttcacagaattattagttaatataaatttatttagcagttcatgtagcagccaaattagcttaactttctggcataactacttttgtttcccctcaggctgcaggatagaggaaattttatagacatacttggttggcatccttgttcaaatcctaactctgttatcttaatggaggtctttcatgtctctatgattcaatatctttctctgtaaaatgaaaataataatgttgcctttgcatttgattgtaaggattccataataaacagatgtgaaatatttgggaaaaagtgagataataattgtaagctagtggttctatcttttattatcaagcacttcaaattatttaaaaggaaacctccattaggtattatgcctgtggggcttactcaggtaatatatagtgacatatataaaattcagagctaatctatgatttcagagagtttaatattttttaatcatccgattatactacatactacatttaaactaattaatttagccattcccagttcatacaagaccttcgcatttgatattgcagccattcttttgctcttgtgaggagggtatccatctcaattataattcttttatcacatatttgcatatcttttttttactataactattaatggtgtagtgatgctgatttatcacttagcctcttttacctaacaatgttgccctgaagtaggaaaggatgaagttctaaaattaggatgtaattattaacaattcaccacctgaacattaactaacagaatctgacagtggctttccccacagacaaacctccacattcaagaaagaggattcctttataatgaagttagttctgacaccaatgtacattaagagaacaactcccaaaatattataactctgacttttagagtcttaaaatgtagttatggtttcagtagtaaaatctgagcaatactaagggtggttttattactttacaataagacaaaaatgattaatttcttaattaaatttttgatattaaatataagcccttggttcctttgcctatttctaaacaacaaagaagaatatatcatagtctatgatttgctatgaattatgttttgtgatggcttatcgaatcctcagaactgaactggaacttgcatttcctctgttatcagcaaaagcttttctgaaatgtttgcaaagctccagatatatggggttcctgaataaatattatcccaacactgatcagctgcataggtgaagaccaagttaggaaataggtctacaaggatttcttaatgaaagcaggtggctgttgatattttaaatagattcaataattaattagaacatttttaggactttaggtgcatttcacaagggatttctgtaatattcagaaggtagcccatgtaggaaagcacctggttcaagatcatcattcatgctctcctaataggggggaaatatttttaaaactccacacaggccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaataatataaaaatataacaactatttatgtagcatttatattgtattaggtattataaataatccagaaatgatttaaagtacacaggaggatacgcataggttatatgcaaaaactctgccattttatagaagggacttgagcatctgaagagtttggtatctgtgggttgggaaggacctggaaccaacaaccccatagatacagaggagcaacttatatttgtttaaaaccatttttggcaaacttctaaaacagactctgtgcaataaaattcacttgcttaataagtcacattccataccaagttcacataatggtagattatcctcaacttccatgtgtttgatgtccattcaatattttatgttttctaagtaaggtaaacaaatctgttgactagagctctgaagatactgaaggcttcccttccttctctgttaccatttttgtgatatgaacttctaccaagataaatttaaaatgcatttgttttatactctatgttttacactttgacatcaactaatctttgctcacaaaagaaaagttaggaccctttagcattaatatacatagtaaaaaatgctggaaaagtttttaaattgttactagcacttaggtaagttaaattcgcaagcaatatttttttctgaaatgcattgatcagcagtaaggtacaaaataaactaaatcacatttcatatctcctttctgtggtgtttttgaaattctgagtaatgaccctggttgagccattaatgcaaatcctcaaaacttaagtagtttcttgatactttccattttgaggcatcttttaaagaaacagcagatgcctctccacatgcattcaaaaaatcaataaaattaatcaataacactctccacaggtaatatatgttcagaagcatttctgcctatctatattgatttagagaattgcttcaaatctgttctgatgtgtataaaaatcatttccttattcatcaaagtttctcttccctgatatgttatttcatatatggcacacaatgatttttgtctctattcttgtatatttgtgataaatttcttatgatctgtgtatgagactcatttgaataaaatataaaatgagtattttgtttctttggagaaacctattgctcaaaatttaatcaaagaatgaataatcatgagaaattactgaagttattgtaatgagaaacgtaatgatgtatttcattcacatttttattatttataataagcttaaaaggtttgagtttgcttctatttcttataacaaagctccattcctgcagacacattcctacaatccagaatgacactattactgactatataaataatagaaaaatgcatagttttagccaattgctgactcatagtattgctagaaaatgtaacatgttcaaacctataagtgaattttgtaacctttttgctagtgtatgtgttacgtgtttagacagagtaataagaaaaatagatattctgaattttctgaacataaagaaatttaaagttttgatagatataacatttaataattctcattaaaaatgactgtatttaattaacccaaccaacttatatatccacagttaccttaactaacagtacctgataactggtggctcactggggaaactgtatttgatcaattaaagagtcccccaaggaaacacaactcttaactcttgatatattaactagtgttgtgaattattcctctaacaaaaaatcaaatatttctgtcaacattatttaataaatttcataactaacatagggtgctccattacaaaatgacatcatttggccagttaatacaccaccacagtaagtgtgcctcaaccagtatcttcttcaaacttggatttattaacaagtttcatgcctctcagtggtttttccttggaatttcagggaataggaattttcatattgacaaccgaggtccaatacctctctctaccttagaagattttactttaccaatctatcaaattaattttgtcttttcttaattcttaaattaagttgagatctttcagcaaaacaagaactgttttttttttcaggaacaattagtgtaaagaattggataaaatatattcactgtattcaaaaatattatttgggtgaggctaaggggatgtttgccaacatagaaagcataagcattggaaagaaaatataatctggtttgtttcccctatatcaaaaattaaatgacaatttttaaataacatcttaatataaaatacttacctaaagatgtggaagtgttttttctgcccactaaggcactgggtacattggatggtctccagaagctctaaaagaatagggcagccttcctgagtttgtcacttattcccaggaaactagttgtacaatcagattcttggaatcaatagatgccactagggcgaccatgaatataaaatttttaaaatatttcttttacttatgtaaaaattaatttaaatatattcctagagatgagcatagattcacactggaaactggagtggcacactcaagagagattttgatagacacatctctccatcatgttgtgttttagtaagggcagctgaatcaaagtggaagggatgacatggagccaatccaaaaaaaaaaaaaaaactcatctgggcatatcataaaagataacagcatgagccttggagtcatatagacctcaaatccggatgccatcacttacaagctgtgtggccttggagaagttgcttttctttctaaacttcatttccctcttctgtaaagcagagtatatgctagtattttctaataaaaatatgtgatatgtgatatactatgataatagtatgttgataattttaaattttctagtggacacatttttaaagaacaggtaaaattgatatatttatttatatatttatatttatatatgagatatatatttatacttattaattatatacatataaaatatatgttaaaatctataaaatgtacccaaaatggtatcatatcaacaagtaatcaatatgaaaatgagtaatagcctattttacattctttcttcgtttgaaacctggtgagcattttacaattacagcacattccaatttgtactaaccacatttcacatgctcaatagctacatgtgtgtcatagctgctataatggatattacacgtataacctaccccatagggttattgaagaataaaatgagataatgcaagtaaaggacttagaacagtgcttggcaaataatatgtactacaaatggtagtgtgaaagctgctactattatccactgatattgattatatcttccttgctctgctgggggaatggaaaaatatatggcatggcccctgttcctgagtaatcacgaagttaagaatgtaagacaaatatatagttaactagaatttttgacatcttattatcacatgaatggtatgaatgaaatgcaataagtgctcagaaaaggcagatcttgtactaggaatcccttgtaccaacttggtgaagaaaatcattttgaactaggatttaataggtaggttgatttttgttaggaagtaatggttagggaccatgaggacagctaggaaaaatattccactatagggaattacagaagaaacaatccaaaggtagggaagtgaaaaatacattcaagaaatgagggcaaattgtttgatggagagcacagagttcatgtaagagtgtacttgagttagcaaatgcagatttgtatcagagtgtagagatcttaaaagccatgctaagatacttggacattattcagtgtctgaaagaaatagtaaaaaagagcactgatttaggtgccaaagatctgatttcagccatattctgcaactgccacacgtgcattttcctaccttggccaagtcacttcagctcagctgttttatttgtaacataagatggttggatctaaaacaaaacaaaacctgagaacgtcagagatgaaaagggcctctttgttgttgttgctgctgctactgcgatcattgttctgtttatatttgtggtattttaggatgaggataacattactgaagaaatgcctcaggaattaatataggtagatttaaaagtaaaaatatgaaaatgaaaagatcattttgagaatcatttcagtggtcctagtgtctttaaaaaaaggattttaactaatattgtggacataacagttggaaatattaataaatggctgggttggattatagaaaatttgtttaaaaaaagaaagaatggctaggacttggattgaaggtggagagggaggcaaagtgagaaatgaattttattacagtttggagtctagaaaaaaaaataattagtattcataatagaaatggtagaaccagggagataatttggctggagatatgggaagggatgtaaaatgagtgtttttagttatcgggtacaatttttagtacatattatatatgcattagaatgtatgtatttagagattaatggatatatatagtgacttttgcaagaacatgagtattttagtttcagagtttcacaaagtagtagaatcaacattaaataaaacaattatgagattaacatgagcattaaagttaagaacttatgcaactagagaattcagtgatattcataaagaggccccaaagtgtgacacttatctgagtcttttttgcttattttttgttattattttagagacagggacttgcgctaccacccagaatggagtgtaacggtgggaatagctcactgcagccttgaactcctggactccagcaatcctcttgccttagcctccacagtagctaggactacagatgcatgccaccatacctggctaattttcttttaaattttttgtagagatggagtctcactatgttgtccaagctgctctcaaacttttggcctcaagtgatcctcctgccttggcctctcaaagcattgggattataggcataaacccagttggccctaaatcttaatttatgaaagaaattctaaagccagtaaatgaagcaagactttttgagtaataaagttttcaattcaaatcccaaatcaaggctgggcacagtggctcatgcctgtaatcccaacactttgggaggccaagatgagtggattacctgaggtcaggagttcaagaccagcagggccaacatggtgaagccccatctctactaaaaatacaaaaaattagctggccgtggtggcaggcatctataatcccagctactccggaggctgaggcaggagaatcacttaaacccgggaggcggaggttgcagtgagccgagattgcgccactgcactcaagcctgggcaataagagtgaaactccatctcaaaaataaataaataaagaaaatcccaattcaaccttctgtgagtctccttcttcattttctaggaggaaagaatagctacatcacagtgttgagtgaaaaacatgtgatgtaaaaaagaaagctctagacattcaatgaatgagggctaccatcaactcattccagtaaacctggatgacaaagaaatgggctcaaaccctttctatttaaaaatgtcataaaggtttttgtgctcctacttgtaacacactatgaatcttcaagcaacaagcacatattaagtactgataagtcaagttccatgatcataaaaaaaattgcaataataagcagcatgaatctcaaccttaaggagaacttggctacatgagaaggaaagtaagtattgaaaggtttaaggtaactcctggttattctaggtgtacactgtcaaaatcaaattgacttctcacacgtgtttctaaaattaatttaaaattcaataaaaattaatgaaaattgattgaaaagttttaaaaattgtagctagaaaaagtgtcaatattacacattttattagcatgagagtaagagtttccaaactatgctagtttatataaagtgatttttacatccagataaaattttaccactcaatttgtatggattaattcattctgtaaacttcttcaagggattctattgttaataatgcttaaattagtaagtatattcaaatattcaagtttttataacaaattcaattgaaactgttatgcctaagatattagtgaaactacttattaaaataaatacagcatataaaggaactatattgtattaagaaagttataaatttatttggaactaactttgaaagaccctctaatttataaaattagattgaatcatttaatagcagagcaatactttgaggttaggagaaatttaattcttgtcttcaaagccaaaaggagttggcaaattcatccaacagagtgaaatggacagcaacatatgctcctcattgagtcctattggtcaacagaaaaggtattgatttactaaacatgaaaatattctgaaagtcttggcagataaaaataagtattgattatatattttaagacatatgaaggagtcataatcactcagtgttgatatatactgagttatttgtataaaaaatagcagttacaaaattaaatcaatcttctccctagactgtttattttctttccattctgtgaaaagtatgacatccttataacttgaatgttaacaaaagaaaaaaagcaaggcattttttacataacagatgtttaaacatttatctgtattttaaaatacctttataaatcaattttgaccatttttatttttaacctattggtaaactactctgtttttaatcacaaatttatttcatgtgatttttatggaatgtgtgtattcataaattgttataattattcttgttaaaatactaagctaaataacaacttaataatctgttcagaaattacatgttacaagacaatattttgcttttaatattttaataaaagatttaaagtaaaaataaattatttaatttcacattttttaaagagacatatttacttcaatatgaacattattagttcaggtttcacgtaagttctcatgacgctatttaaaattgtatttctaccatattttcattccattgaccaagttctgatatagttaaatcttttatcctccctaaatttgtcattaagaccctgacattcagatgacaagtgatttgcagtgtggtttgtttttcattgccaatcaccaggagatttaaaaagatacccatgcacttctgtataaacactttctctataaatgctccactttgtggagatgctaccagtaatgagactatggcattttttattttctttctgagagtacctcttctctctcaaaccaattggatactaaagtactaatgtagcaattgacacaccctggtaagtaattttgaacattttctaacttagaaagaggttagcatccctgttcccagcaaaactaatttttaagtcacacattacatgccgtgtaataatccaatatactgtaaatgaagttgaacatgattataaacttatattcattttaggaattagttacgatacgtactcagtcttgcaatcttctgaaaatgaattcaggtaaacttgaaaaaccgcataataaatttgctgaccaaaatctgttcttgaaaaaacaaatttttggaacacctgaggcatggtgctgttgaattaatatgaggttccaatatcattttctgtattttatttaacaaactttcagaaattaccagagccttcataaatatttccaattattatttttagagatgtgaataatgatttaaagctaaatatttttctttttctttatggacttggttctgtttcgttttgtttggtttcacaaatagaaatcagtgtttaccccacttttcagctgttgtataaagactacaagaaaaaaagttatttgggaaagtcacaaacagcaattgcctatagagtgaggttggaagtgaaatccatatgtaatgcctctgtcagcaaagacttagtagaaaatggtttataataaatattcacatctgctgctttggacactctaatccatcctaaggatctttgctgtgtcaggttttgttctagatgaagaagcccagtagttataaaggtttgcaaataggttgtatttatcatggttagctttacttttataacttttctctgttttagaggtattcatgatgtttgggggtaaaatttgtgattaaatatttcactatagcttttatggtgatataattctagaattcttattataaaatggaccaatgctattttcacaatatatcacttacctaaaatctgtcaagaaggcatcattgataacaatgctatgctggctgtggaaagcaatggctaaaagcccaggctctggattcgaagtgctgtgattaaatgctagctccttctatacctagggtgtcattatgagcaagttacttcgcctttccaagcctctatttcttcacctacatagaggaggcattttttacataacagatatttaagcatttttaaatagtactaactatttaaaatacagataaatagtactatttaaaatattaaatagttaatactattaatactaactaatatattaaatagttaatactgttagtactatttaaaatattagttactactattagtactaactatttaaaatattaaatagttaatgctattttctttatcattagattactgtaacgatcattcagaattatccatatcaagcactaaatataaggatcatacggaattatccatatcaagcactaaatatagtatctatcacattaaaagagtttaataaattttaaatgttattactgaaacaataatatgccttctaagtatgattaaataatcccatggatagtactaatgtcatacttatttacactaagtactgagcttatgtaaacatatcctattgttttacttaactccaagtcccatgatagtttgttactggacttccttaataaaaatattaattaaaattggatccctgatttgttttcactttgaggaaatgagccactaaaaaatatatgatacaaaaattatgcaaataccctgtgctgtatttagccatcttatgtaaaaaaaatttaatttatcaaaatttgaattctaagctagagtaaaaactctcaagtcattttgaaatggaagtatttatttccacttcagcttcaaaaaaatttgttgagttcatgagtatcacaatttttaaagcaggaatgtatattgagttgtaagtaatgattagcataattattataaataagtttaaagaagaatacaaatgttttccataaattttgaaagctatgccttttaaaactttctaacatataatttatttgaaaaagaaagttgccttgcatagttgctttcaatctcatctcctcgaaatgctttattaatcacaaatataaaagaatagtaggatgtttgatgaaatctgcatataaaggaggtagaccattaggctctatgtcccaattagaaaattttataacctaattattgatgtgtcttaattttgactcaacttatttcttatacctacaggagctactgcatatttaataactgacccctaacacagaatgataattgaaaaaaatagaatgcttcattgcttataaactgtgaacacttgaaataaaactttgattcattctctctctctctcctctctgtctccctcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 2325 - DNA, 1126124 bp, Homo sapiens; identical to SEQ ID NO: 2324

SEQ ID NO: 2326 - DNA, 1126124 bp, Homo sapiens; identical to SEQ ID NO: 2324

SEQ ID NO: 2327 - DNA, 13044 bp, Homo sapiens
atcggtgacaggaccgacggcagacacacggacgttcagggccagcagcatccgcacctttatccgcactgtaggctgggctgggcagagcgcgcctggccccggggacaccactgtatcactataaaacccagaggaaacaaggaacaagtgcaagtccggggagagggaccactgtcacgcagagaggtcactgttatcaaaacgctcctggtcgtacacttcagccaccaccttgcggccagcaaaccagcggccattgagggcctggatggccttatgagtctcagaggctatggaaaactccacaaagatcttgacaatgatttctgcatcctcctcctcgccttgtttctcttggtagatgatgacgcggttcacggccccgaacttgccacactcctctgtcacctccccttccaggtcatcatcgatgtccttggggtccaccatgttgcgcagaaccatcactgtagactgtggggcagggccgaggggaagacagctgagcactgcggccccgcccccctaccctctcccccgccaccaccctgcccctctgcctacctcctgcttgcggagcagcttctgcatcaccatgtgtcgggcgctactgcccgagatgctcatgtgctcctgctcgctcagcatctctggccgctctgactcgggaaacagctcctcttcttccttctccttcttgggctccaggagacccagcgttggagggctggccaggatggggttcaccactcccaccgaggggatggtgaccgggataggaggacgggctggggtcacacctgcaggaaaaccaaccaggtccatcagtcactccctaccaccccccttcccagaaaggcacagagctggcctgccctgggctcagagggttgtgcccagaccaccagggccaggcagctgagggcagcgagccgagagatgccaggacaggagaggagaggatctggtaccacttaagactcacctgtgatgactccaggtgcctgggcagccatgacagcctggggcaaagtgcccaggggctgggccagggtcagtgctggggacaccagtccaggtgtgcccagggtacccagcaccgctgctccggccactgcttcctgcaacccaaaaggtcaccgtgctcagtccctggtctggctactcaagaccaccttgaatcagtctccaaggaatcaggggccagcccgcccaccctcaagccgacagctgtgtgggccctcacctgagctgtgatcttggcagtggctgcagcagctgccacagcagcggcaggtgggaggcctccaggcgtggctggtgtgagtaggggcatgggcggtgtgacagccttgcccacccgcaagtactggccacccaggtcaaagaggttcatggaagacacagcatcttgggacgactgggccttctcgtactctgtgggcaggagcagcagtgagcagggccagccccagcctcaggtggcccccatcccgcctcagccaccccagctcaccaatgaagccgtagcccttgtgcttgccagttgtggggtcccgggccagtgtgcaggacttgatcttgccaaaggcctcaaacacgctcttgatgtcatcgtctgagaggtcctggtgcacagaggccacgtagatgcggttgaaggcccgtgcctcctcagccaactggtctatgatgggctgggcctgccctatgttgctgggtctgcccacctggggaagaggcggtgagatggaaagaccggtcaacccaggcccggccacaaaaggcttccgtggaggggcagccctgcacgcctgcgggatcgaggccttggctccctgcctcaccttgatgttcctgccccccagcatcaccgagttcatctgctccaaggccagctgtgcagcttcggggacctcatactccacgaaggcaaagccctagacacagggacacacctgtcaggctgcgcgagcccaggggtgggggcgagcccgaagtggccggggcggaccaagcctgctgaccttgtgcttcatggtgacggagtcccaggacatgtcgatgctcttgatggggccaaagggggcaaaggcctggcggatggtgtcctcccccagctcatagtagatagagcccacgtagacgcggcacatgatggccagcgcccgctgccgctgagccgccatctgcagcaggacagaggggagagaaccgctggctcgtcaggggcggcaggaagctgggcagcccactcccctcctggcccacccacccagccctgctgtggggagggctccccacatgacagggaggtgcgggctccatccctgcagtcatagtgtgggggtcgcaggaccccgccacccaaagaaggaaggccaggcccagcggcaggacaggacgcaccccagcccgccaaggtcccaggcagactgcggcagcaaagccgacagatggtcaggaggcagggctgtgcgccctcccacccagaccacccctccagtctgggggctgggtatcccaggctgggctgggagatcctcccactgtcccagccaaggaccacgacagaagagggaaggaggaaccatccaagctggagggacccactggtttggtggccagaagagaggaggtcagaagacagggcagccactgcccagaagagaccccaggggaggagctcaggagccagatgggggctccctgaagagagaacgaggagcagctgctcatgctgggccaactcaggtgggggctcatgctgtgccttcccagtgccctgcaactcctcacaaaggagctgcctggagcctgtgcccccagccgagagagcgggcccaggcgagaccactggcctggcccccgggggcaccatgaggtagcagagaccctacgagaagcccccaggctccttagagctggtgacaggcctggccggtccagggccttggctgtgagcttggctattgcgctgagggacctccccacaccctcagggacgggttctcgcccctgtcacctcacaggaggcatgccagacaggggacttccagagccacacgcagtgggccacagggagcctgtgggccagggcaggcaaagcagacagctggagccaggccctgcccctctccacaaaaggccttgtggccagagaccagtttccctctttagacatcagctggcctaatgcaggccgaacctccccatcccgtggagaggggcctggaagcatctctccacatcaagggacttcccaaggtgagatatcttccttcaaaccaggcattccctgaaaacgagactgtgttctcctcacactgggccccctgacagacctcaggctccccactcagagcaagacccccccaaaggtggaatcacatccccctcactcagcaggctccccagacacgagaccaggcctgtccctcaggtcatggttcccccaagacagggccatgtctccttttcagtgtggggccccacccccaggcaggccaagagctctctccctgaccagacccccagcccgggctcccattcagatgcttcccagagagaacaaggcgtgtgttgccccatgggagccacacacagggatgacccctctgaacagaggctcccagagaagggtccacatcttcccctcaggatccccgagatgggacctggcctcctcctgagcctgcctctgggggaagggagggacacctccttcccacactcctctgcccaccacagccaaggccatagccatggcccctgcctcctccgccctggctgcgtggcctctgccccttgctgacagccaggcacaaggccctgcttgcccttcccttgctcgcttgggtccccccacccccaccccatccaaccatcctccctccagggtctgatggggccatgagttaggacccctctctcctcaggggcctgaccccaacccaagagccaggcagcctggagactgacggggctggaggccgtgggcacaccccgtgcgtgcaggtggcgtgggcgcagacgggcctggtgctggcagctacccgccctggccggctgccctccgcagttacctggccgattagttttaaggtgggccctcagagcagatggaggcctccccaggggcggtcccgggtgggtgcccacaccactggccccaccacgcctggcgctctgctgcgctcgtccagagctggcgggcagggccggccaggggagcaaggtccccagcacgtgggctgcactgcccccctctagccctgactaaggacatgagccccggaagaagtgagcatttctattgaccgattgcaaaggtgagagaggatctccaaagcccattgtcactgctgccatctgaaagacagtaaagacagagttcagtctgttggagccgagcagtctcccgctctcgtcaacacctcacgcagacagcggcaaggcccggagtccccgccctgccagggaggccgcctgccttcccacactgccggccgccagcacctgcccaggggggccgcagcgccccatgtgccccgccctgcagccttgcagctgggccggctggggcagaaaggaagggagggaggaagggagggagggaggagggcagtggagcacagtgaatggccaggacatctcctggtagcgtgaatgtctgagggctgggcgggggggcgtgaggctcgaggcccaggaacctgtcggcctcacaccggcctcttcccacgaaggtatcgcagcctccggccacaggcctggagcagggccccaagggaggtgcctccagactgtcccctcagtcctggggctgagcccaggtggtctggactcactgcaggggtgagggcctgagcagtcttatccaggccacgggggcagggaggcccacgccctgcatgctgccaccatcggctgtgcacagctggggcagggagcacgggagagaccagaggccacagtgtgaagaccaggaaggggaaaagggtagagctgcagccaagcagccaagaaaggggctgcggcgctttaggggctccagcgagcaacaggtgggaaaggctgggccactcgtgcctcagagaggaccccgggggtcccgagcatgagtctttgagaatcggagcactgtaacagcttgcggggacggccgcaggcccaggaggaggaagagcgtgaagaggaggagatggtggctgtggtggggagggcggtagaggctccggccggggctcacctgcaggttggtgagctgctgctgctggtgcgcgatggtctgcttcaccagcacactcttgatgctctgctccatggcgtacttcttggcctgagagaggcggcagtgaggagcactgggggcccagcccatgggagacaggcctgccccgcaccccgcccctgcccctgcccccagttgactgtcccacacctgcagtgccctgggaggtccatgctcaccttctgaagggcctcctgctgctcgggcgtcaggggaggcagccccagcttggcggctgtgctctgcccgttctccatcttgatggagtctgtgccctggtaagggagcaggggaatccatcagcagcaagctcaagttctccttcacgtggccccaggagggccacccctagcacagactgtcccctgcctggcctgtactcaggccagcccttctgacattgctgtccccagcccaggccactgtctcccccgggacccatggggtagaacacagactgaggcaggcaggtgccctggaggccctgggccaacccgagcagttgtggggcccaggccacagtggcctcctcgggaaccaccaagataaacagctggaggcagaaaaggggtccagccccttgttgtcagtctgaccccagagctgctatcacatgcccggcaggagagccagcctcagccgtcctccaaggcaggagaaaagggccacggctctctggacgttctgggactccttgctcccaggctcctccaggcttcctcacagtccctgccacagacacaggctcagcttccctggagtttcaaggggcccacccaaggagctaatacaagggcctctctcccaacagtgctccccccaccgtccccgcaggcactgtgcacacctcccagagaacacaggcctctctcgggccacacaagccctgaagagggctccagctcacttccacacactcttgcatgggctttgcctggcccactgggagaagccaggagcagaccccactggcaccctagccaggtgggcctggggaccaagaggcccttgggcagtcacagccactgcagacccaagctgatgccaaccaggattatgtttacgtccctcctgtcaaaatccatctctaagctttttgcagagggaagaacgcagctgtgtgagcagggaggcatggctagcaggcccatcagagtgtgggatgggcaaacagcatgcctgcgcctgtcctccagctcagcaagcacaaagatcactggcccaccaaccgggccctccgagacttccagacacagccttgagggacagcagagaagagagaagggtccccagcacagaagtgatgagcaaggacagagggacacaggaggcaggaagggacaggctggcccaagccccaagaaccccctcctgcctgccaagtgctgggatgctggcccaggctcaaagggcaggaagccctggagacccctccccaggcaaccagagccccaaccagtccctgaaggtcaaaggctggctgtgggtggcaccaggtgccccagtccggctcacaccaggcctgtcctaatcaccctcagcaccaggtgccccagtccggctcacactaggcctgtcttcaccaccctcagcaccaggtgccccagtccggctcacactaggcctgtcctcaccaccctcagcaccaggtgccccagtccggctcacactaggcctgtcctcaccaccctcacagctggccccaagcccattcctccttagtgggaaagagggcccaagagccagaggctgggacttgagagcaggctgtcaccatggtaatcaatgccaaccccctcagcccccagacatttttcaatctcctctttgtcttggtaaacaaaaggcccttctcccaccaaccaatggccggctgggcgccagccaagggccagggagcaccagcccccacatctcccaggatccaagctgcataccatgtcccagtcccaccccctgagtgtgcctgggggaccaagaggagggcccagccccaagaggctgccaggccaccttgctgaggccccactggaatgctctggaggcgggcgctaccatggagaagcacaaagaacccaactacccagccacaggcccagctccacctctgagaggacctgctcccaaggctgggccatcgaacagaccaagacccacctgcacccactctggagcctggggccgaaaaaagatggggagggctgagtcccaaccagacctgtgctttgacttgcgcattgcttcactgttttatttaaatgaaaacacagaggtctgaaatgaaatctgtccttctggctcctcaagcactgcgagttctgggaagcttggcccacccttcctgcaagacgctcatgcctaagaacgcgcgagctccaggccccggcgtccccgcccagccagactgtcaacaggccccgcctggtgcttggagcagggcagatgcagagggcaaaggccagctcagtgcctgggtggggagggtgcagggctggtgcggggagagggccgtggtcctgcgggcagttgtctgcccagaggcagagaagggttcccgaggttcctcccgccccgcccccagccagccctctctgggcccagggacgcacaggcaggcgggcgggcgggcgggcaggcgggcgggcctgagggagaggatgcttaaggtcagtacctgtggaggtttccatttgtctcccgctgccaccactgccgccgccgccgccggctcggacccccctccttgctggccattgacctgctgcaggcaggaaggagatgttgtaacgacaggcacaccaccccaccgcccaggcctgctctcctcccgagctaagggctgagctcctcacggataagcaagggaggccaggcagggaggcattcccgacatgaccccccagcccaaactgccctctcttcacacccatcagcacgcccagggacccagtcagaagcagagcggagcatgggctgggccagggctgccagcgagtcccagcggggatggggaggagggtagagagagctgtgctcctgccccaggcaaaagaaagccatcctctcctgccggcaggctggacggccaaaggaaccggctgggtgtcccccatgccctcctgaggcagcagcggtgccttcctggcaacctgtacacaccttggccagcccacaactcagccccagctccagtgccttccacaggctctggcccagcccaggtcccagttctctcctgaagacacttttaagcagcatggtgggcaggggtctggatgcgcaggcctcccttccctggcaacagaaccatccagagctgtctcgcaggaggacggccaagaggttagccctctgcactcagtaagacccacacctaagggggcacaggaaggaggagcagctccacaatggtcttgagggatggcagggcaaagacaggccacgggcaggaaacgggtaacgctgtgggggtcgggagatgatggaagggccttgagacctactctaccttctcagaggctgcacaacgagaagcaaggcagcatgcagtcaccccactcccagctcaaggatgagacccacaatatctaagaacagaagagatcagcgtgcccacccttggagccatgtgcgcaaagccagaggctgggctgacccaccagagtgtcccaggtccttcagcctccagaggaggagcagcaccaccagcccagctgcactggggaaggccaacccagcccgtgcctggagctgctcccaatgctgtcggcatgggtgtgctctagctgcccaactcagccccacgctgcctaaacactgcaccccggagagagtgaaaggaaacaaggggcccctcccactgcatgcacagccagagcagaggctgcctcttttttttttttgagacagggtctggctctgttgcccaggctagagtgcggtggtgcaactacggcttactgcaacctccgcctcctgggactccaggcatgcgccgccacacctggctaatttttgtatttttggtagagatgggggtctccgtgttgcccaagctggtctcaaacaatccacctatctcagcctccaaagtgctggtactacaggcgtggaccactgtgcccagccaaggctgcctctcattgcccacagcaagagatcacttcacgaccagtctccagatacccgtgaacagggtgaactgaggggcacttttgtaacttcctgctcccccaaatcactgcactaaccaacaagtaagccacaacagtgttgacagtgggatgtggctcggaaaaacattttcttgggaaaagccggcccactggtgcattctacacaggacaccccatgccattcctggcagatggaagttcccagctgcatggagcttagggttctgtgctaaccagacgctgggagaacttggaggaaaccggtgtttacaatcgcagctagtcacgtactgccatctttaggcaattaaaatggcgtctttatggtcaggatgcccccagcaccaggcagcagtgcttggagggatgggaagcccctctgaggggcggcacagcagaggggctctggggtgccaactctgggactgcctttcctcagcccagagcaaagaagagtatttccatcagaaaacaagaaaagcaatgtaggggctgggcgtggtggctcacacctgtaactccagcactttgggagaccgatgtagcacttaagaccagcctggacaacacagcaagacgctgtctctatgaaaaaaaagatttttttaaaaagtaatgtggccagacgcagtggctcacgcctgtaatcccagcactttgggaggccgaggcaggtggattgcttgaggtcaggagttggagaccagcctggccaacatggtgaaaccccatctctactaaaaatacaaaaattagccgggcatggtggcaagcacctgtaatcccagctacttgggaggctgaggtgctaccatgaattgcctgaacccaggaggcagaggttgcagtgagccgggatcaccccactgcactctagcctgggcgataaagcaaaactccgtctcacacacaaaaagaaaaaaaaaataatgtggagcgaatgactgaaggtcccaaggtctcaaggcttcaggctcctcagctgggaatggggacggcctgtctcctagggctactgtgaagattcagtgaaatcccaacacgcccccaaccccacaacctgcagtccctgcacatggaaagcagcaaagcaagccacaggttccagcactcatcagtattaacaacatccagtgtcagatacccagggcagagctggctgcaggacactgccttctatctgtcagttcccttcacacaatgaacactgcttactgcgtgcccaggctccacagtgagcgctgcagaggccgcagacacgagacaagagagaaagacgtctctctcaggagcctggtgtcagctgccagcaaagaatgccaaaatcaaagatgacttctgtggtttaccagcactacgaagaaagcacaggataagaaaggagtggctatgagctatgccaggccatggcagccgggggcctctctatgaggtgacattgcaggctggggcctacagaagaaaggaactggaaccccaagggtgatgaccccaaatgagagctggtctggctgtcagtgaagagaacggagccatgcgtcaaagtgaaaagatgcatccagaagacctacccttgctgcaaagaggcagccggcctcattctgcagccaccaggcagaaggcatgcccatgggaggggaggcccttctgcatcttctggcttccttccccaccaggccactgtcagccaagttcagctgctccattcaacctcccatgagagctgaagcagcatgagacaggggacaggctctcatcactgtgcccaaccaggacggtgggaacagataacccttctagaagcctttccatcccaatgattaaaagaggaatgggttagaccacaggctacagctcactcctggagccggatgcaagcctgaaacctgacgataaaaaaacacgtattaaacccaacagaatttggatggcaacaaacaccccaacagacaacccgttcgtggggtcagttatggcccacgtccaactcaacaatgacaccacctatctggcaccacgccacagcagacctgagcccccatttaaccctcatgagcacagggcgctgttctgcgggtgctaggggagtcaggcatccactctcctcctccaccttcccatgtccagtccttgtctctgagcctcctcctccttcaccatcaactctctgactgctgcctgaagacagtcaccaggtcctcaacccttacatcctttctctctggagtgcccctcaaaggtcacttactcctgtggcttcaagagaaaggacatagtagaaagagtggagttagccagtcctgtgaatcacacactgggctgccctcgcaagctgggtatcttgtgtaaatgcctctctccccctagtaactggtttctgcctcagtgggacatgggaccagcccgcccgctgggggcctggcaatggcagtctaaggacactccctggtcctgccagtccagccttcagccatttgcccaagctgtcttctcaaacagaccttatcccatcccgctgggtgtgggctgggggaagggtgacaagtaatacaggggtaaactgcggctgagaaaggtccaaaaggggattaggtcctataagctaagtggtgagaaggaaagaccagacttcatcgtgcatgtgttgtgtgcatgggtgttctccctctacgttaataacgcctgccctgcccggggaagtgggcactgagcagagcagggggcgactcactcctctggatgcccacgcagctccctagggcgcccagcaaatggcaccctgggtgggaactggcttctggtgcgcactagacctccaactgcctgtctggttccccactgcgtccccagatcctcccgcagagctggggacaatgcgatttctcaaaacacgtaggatgagagcgcacgtccttcctttccacgtggagacaagagaatggagataaccagatccctctccagcaccggagaacgaattcacagctgcaggcgtagtgagccaaggccgccccatgctctgagctgcaggcccctttctacaggtcccgtccccttctgatcccatcaacccgaaggcccacgcgtcacccccagaaccccgcttccgtcgtgaccacggcgcacacccccgtcggcaaagggaggacgacgacccccgcttgccggacctagcggacaggaacgcaaccccgccaggctcgcccgcaagggccacacgccgcgcccaggcccccgccccgccccgccggaagctggggtccgcaggccggaagctgaggccgcgagccggccgccggcgcgcgcccgccccgcccccgcctcacgcgacccggggacacgagggagtccgcgcgggacctgggaagaccgccgcattcttgggaggccctccgcgcccaggctgggtcgacgacccggccccgcaagccgagggccgcccgcgctcatgggggggctcacttacgagagctatggtcgccgtcgccatcttgcgtccgtcgcggcctccgcgcgcgcctcccactcttgctccttccgctgtctcgcgcgatctgggtgccggtgcacgga

SEQ ID NO: 2328 - DNA, 12767 bp, Homo sapiens
atcggtgacaggaccgacggcagacacacggacgttcagggccagcagcatccgcacctttatccgcactgtaggctgggctgggcagagcgcgcctggccccggggacaccactgtatcactataaaacccagaggaaacaaggaacaagtgcaagtccggggagagggaccactgtcacgcagagaggtcactgttatcaaaacgctcctggtcgtacacttcagccaccaccttgcggccagcaaaccagcggccattgagggcctggatggccttatgagtctcagaggctatggaaaactccacaaagatcttgacaatgatttctgcatcctcctcctcgccttgtttctcttggtagatgatgacgcggttcacggccccgaacttgccacactcctctgtcacctccccttccaggtcatcatcgatgtccttggggtccaccatgttgcgcagaaccatcactgtagactgtggggcagggccgaggggaagacagctgagcactgcggccccgcccccctaccctctcccccgccaccaccctgcccctctgcctacctcctgcttgcggagcagcttctgcatcaccatgtgtcgggcgctactgcccgagatgctcatgtgctcctgctcgctcagcatctctggccgctctgactcgggaaacagctcctcttcttccttctccttcttgggctccaggagacccagcgttggagggctggccaggatggggttcaccactcccaccgaggggatggtgaccgggataggaggacgggctggggtcacacctgcaggaaaaccaaccaggtccatcagtcactccctaccaccccccttcccagaaaggcacagagctggcctgccctgggctcagagggttgtgcccagaccaccagggccaggcagctgagggcagcgagccgagagatgccaggacaggagaggagaggatctggtaccacttaagactcacctgtgatgactccaggtgcctgggcagccatgacagcctggggcaaagtgcccaggggctgggccagggtcagtgctggggacaccagtccaggtgtgcccagggtacccagcaccgctgctccggccactgcttcctgcaacccaaaaggtcaccgtgctcagtccctggtctggctactcaagaccaccttgaatcagtctccaaggaatcaggggccagcccgcccaccctcaagccgacagctgtgtgggccctcacctgagctgtgatcttggcagtggctgcagcagctgccacagcagcggcaggtgggaggcctccaggcgtggctggtgtgagtaggggcatgggcggtgtgacagccttgcccacccgcaagtactggccacccaggtcaaagaggttcatggaagacacagcatcttgggacgactgggccttctcgtactctgtgggcaggagcagcagtgagcagggccagccccagcctcaggtggcccccatcccgcctcagccaccccagctcaccaatgaagccgtagcccttgtgcttgccagttgtggggtcccgggccagtgtgcaggacttgatcttgccaaaggcctcaaacacgctcttgatgtcatcgtctgagaggtcctggtgcacagaggccacgtagatgcggttgaaggcccgtgcctcctcagccaactggtctatgatgggctgggcctgccctatgttgctgggtctgcccacctggggaagaggcggtgagatggaaagaccggtcaacccaggcccggccacaaaaggcttccgtggaggggcagccctgcacgcctgcgggatcgaggccttggctccctgcctcaccttgatgttcctgccccccagcatcaccgagttcatctgctccaaggccagctgtgcagcttcggggacctcatactccacgaaggcaaagccctagacacagggacacacctgtcaggctgcgcgagcccaggggtgggggcgagcccgaagtggccggggcggaccaagcctgctgaccttgtgcttcatggtgacggagtcccaggacatgtcgatgctcttgatggggccaaagggggcaaaggcctggcggatggtgtcctcccccagctcatagtagatagagcccacgtagacgcggcacatgatggccagcgcccgctgccgctgagccgccatctgcagcaggacagaggggagagaaccgctggctcgtcaggggcggcaggaagctgggcagcccactcccctcctggcccacccacccagccctgctgtggggagggctccccacatgacagggaggtgcgggctccatccctgcagtcatagtgtgggggtcgcaggaccccgccacccaaagaaggaaggccaggcccagcggcaggacaggacgcaccccagcccgccaaggtcccaggcagactgcggcagcaaagccgacagatggtcaggaggcagggctgtgcgccctcccacccagaccacccctccagtctgggggctgggtatcccaggctgggctgggagatcctcccactgtcccagccaaggaccacgacagaagagggaaggaggaaccatccaagctggagggacccactggtttggtggccagaagagaggaggtcagaagacagggcagccactgcccagaagagaccccaggggaggagctcaggagccagatgggggctccctgaagagagaacgaggagcagctgctcatgctgggccaactcaggtgggggctcatgctgtgccttcccagtgccctgcaactcctcacaaaggagctgcctggagcctgtgcccccagccgagagagcgggcccaggcgagaccactggcctggcccccgggggcaccatgaggtagcagagaccctacgagaagcccccaggctccttagagctggtgacaggcctggccggtccagggccttggctgtgagcttggctattgcgctgagggacctccccacaccctcagggacgggttctcgcccctgtcacctcacaggaggcatgccagacaggggacttccagagccacacgcagtgggccacagggagcctgtgggccagggcaggcaaagcagacagctggagccaggccctgcccctctccacaaaaggccttgtggccagagaccagtttccctctttagacatcagctggcctaatgcaggccgaacctccccatcccgtggagaggggcctggaagcatctctccacatcaagggacttcccaaggtgagatatcttccttcaaaccaggcattccctgaaaacgagactgtgttctcctcacactgggccccctgacagacctcaggctccccactcagagcaagacccccccaaaggtggaatcacatccccctcactcagcaggctccccagacacgagaccaggcctgtccctcaggtcatggttcccccaagacagggccatgtctccttttcagtgtggggccccacccccaggcaggccaagagctctctccctgaccagacccccagcccgggctcccattcagatgcttcccagagagaacaaggcgtgtgttgccccatgggagccacacacagggatgacccctctgaacagaggctcccagagaagggtccacatcttcccctcaggatccccgagatgggacctggcctcctcctgagcctgcctctgggggaagggagggacacctccttcccacactcctctgcccaccacagccaaggccatagccatggcccctgcctcctccgccctggctgcgtggcctctgccccttgctgacagccaggcacaaggccctgcttgcccttcccttgctcgcttgggtccccccacccccaccccatccaaccatcctccctccagggtctgatggggccatgagttaggacccctctctcctcaggggcctgaccccaacccaagagccaggcagcctggagactgacggggctggaggccgtgggcacaccccgtgcgtgcaggtggcgtgggcgcagacgggcctggtgctggcagctacccgccctggccggctgccctccgcagttacctggccgattagttttaaggtgggccctcagagcagatggaggcctccccaggggcggtcccgggtgggtgcccacaccactggccccaccacgcctggcgctctgctgcgctcgtccagagctggcgggcagggccggccaggggagcaaggtccccagcacgtgggctgcactgcccccctctagccctgactaaggacatgagccccggaagaagtgagcatttctattgaccgattgcaaaggtgagagaggatctccaaagcccattgtcactgctgccatctgaaagacagtaaagacagagttcagtctgttggagccgagcagtctcccgctctcgtcaacacctcacgcagacagcggcaaggcccggagtccccgccctgccagggaggccgcctgccttcccacactgccggccgccagcacctgcccaggggggccgcagcgccccatgtgccccgccctgcagccttgcagctgggccggctggggcagaaaggaagggagggaggaagggagggagggaggagggcagtggagcacagtgaatggccaggacatctcctggtagcgtgaatgtctgagggctgggcgggggggcgtgaggctcgaggcccaggaacctgtcggcctcacaccggcctcttcccacgaaggtatcgcagcctccggccacaggcctggagcagggccccaagggaggtgcctccagactgtcccctcagtcctggggctgagcccaggtggtctggactcactgcaggggtgagggcctgagcagtcttatccaggccacgggggcagggaggcccacgccctgcatgctgccaccatcggctgtgcacagctggggcagggagcacgggagagaccagaggccacagtgtgaagaccaggaaggggaaaagggtagagctgcagccaagcagccaagaaaggggctgcggcgctttaggggctccagcgagcaacaggtgggaaaggctgggccactcgtgcctcagagaggaccccgggggtcccgagcatgagtctttgagaatcggagcactgtaacagcttgcggggacggccgcaggcccaggaggaggaagagcgtgaagaggaggagatggtggctgtggtggggagggcggtagaggctccggccggggctcacctgcaggttggtgagctgctgctgctggtgcgcgatggtctgcttcaccagcacactcttgatgctctgctccatggcgtacttcttggcctgagagaggcggcagtgaggagcactgggggcccagcccatgggagacaggcctgccccgcaccccgcccctgcccctgcccccagttgactgtcccacacctgcagtgccctgggaggtccatgctcaccttctgaagggcctcctgctgctcgggcgtcaggggaggcagccccagcttggcggctgtgctctgcccgttctccatcttgatggagtctgtgccctggtaagggagcaggggaatccatcagcagcaagctcaagttctccttcacgtggccccaggagggccacccctagcacagactgtcccctgcctggcctgtactcaggccagcccttctgacattgctgtccccagcccaggccactgtctcccccgggacccatggggtagaacacagactgaggcaggcaggtgccctggaggccctgggccaacccgagcagttgtggggcccaggccacagtggcctcctcgggaaccaccaagataaacagctggaggcagaaaaggggtccagccccttgttgtcagtctgaccccagagctgctatcacatgcccggcaggagagccagcctcagccgtcctccaaggcaggagaaaagggccacggctctctggacgttctgggactccttgctcccaggctcctccaggcttcctcacagtccctgccacagacacaggctcagcttccctggagtttcaaggggcccacccaaggagctaatacaagggcctctctcccaacagtgctccccccaccgtccccgcaggcactgtgcacacctcccagagaacacaggcctctctcgggccacacaagccctgaagagggctccagctcacttccacacactcttgcatgggctttgcctggcccactgggagaagccaggagcagaccccactggcaccctagccaggtgggcctggggaccaagaggcccttgggcagtcacagccactgcagacccaagctgatgccaaccaggattatgtttacgtccctcctgtcaaaatccatctctaagctttttgcagagggaagaacgcagctgtgtgagcagggaggcatggctagcaggcccatcagagtgtgggatgggcaaacagcatgcctgcgcctgtcctccagctcagcaagcacaaagatcactggcccaccaaccgggccctccgagacttccagacacagccttgagggacagcagagaagagagaagggtccccagcacagaagtgatgagcaaggacagagggacacaggaggcaggaagggacaggctggcccaagccccaagaaccccctcctgcctgccaagtgctgggatgctggcccaggctcaaagggcaggaagccctggagacccctccccaggcaaccagagccccaaccagtccctgaaggtcaaaggctggctgtgggtggcaccaggtgccccagtccggctcacaccaggcctgtcctaatcaccctcagcaccaggtgccccagtccggctcacactaggcctgtcttcaccaccctcagcaccaggtgccccagtccggctcacactaggcctgtcctcaccaccctcagcaccaggtgccccagtccggctcacactaggcctgtcctcaccaccctcacagctggccccaagcccattcctccttagtgggaaagagggcccaagagccagaggctgggacttgagagcaggctgtcaccatggtaatcaatgccaaccccctcagcccccagacatttttcaatctcctctttgtcttggtaaacaaaaggcccttctcccaccaaccaatggccggctgggcgccagccaagggccagggagcaccagcccccacatctcccaggatccaagctgcataccatgtcccagtcccaccccctgagtgtgcctgggggaccaagaggagggcccagccccaagaggctgccaggccaccttgctgaggccccactggaatgctctggaggcgggcgctaccatggagaagcacaaagaacccaactacccagccacaggcccagctccacctctgagaggacctgctcccaaggctgggccatcgaacagaccaagacccacctgcacccactctggagcctggggccgaaaaaagatggggagggctgagtcccaaccagacctgtgctttgacttgcgcattgcttcactgttttatttaaatgaaaacacagaggtctgaaatgaaatctgtccttctggctcctcaagcactgcgagttctgggaagcttggcccacccttcctgcaagacgctcatgcctaagaacgcgcgagctccaggccccggcgtccccgcccagccagactgtcaacaggccccgcctggtgcttggagcagggcagatgcagagggcaaaggccagctcagtgcctgggtggggagggtgcagggctggtgcggggagagggccgtggtcctgcgggcagttgtctgcccagaggcagagaagggttcccgaggttcctcccgccccgcccccagccagccctctctgggcccagggacgcacaggcaggcgggcgggcgggcgggcaggcgggcgggcctgagggagaggatgcttaaggtcagtacctgtggaggtttccatttgtctcccgctgccaccactgccgccgccgccgccggctcggacccccctccttgctggccattgacctgctgcaggcaggaaggagatgttgtaacgacaggcacaccaccccaccgcccaggcctgctctcctcccgagctaagggctgagctcctcacggataagcaagggaggccaggcagggaggcattcccgacatgaccccccagcccaaactgccctctcttcacacccatcagcacgcccagggacccagtcagaagcagagcggagcatgggctgggccagggctgccagcgagtcccagcggggatggggaggagggtagagagagctgtgctcctgccccaggcaaaagaaagccatcctctcctgccggcaggctggacggccaaaggaaccggctgggtgtcccccatgccctcctgaggcagcagcggtgccttcctggcaacctgtacacaccttggccagcccacaactcagccccagctccagtgccttccacaggctctggcccagcccaggtcccagttctctcctgaagacacttttaagcagcatggtgggcaggggtctggatgcgcaggcctcccttccctggcaacagaaccatccagagctgtctcgcaggaggacggccaagaggttagccctctgcactcagtaagacccacacctaagggggcacaggaaggaggagcagctccacaatggtcttgagggatggcagggcaaagacaggccacgggcaggaaacgggtaacgctgtgggggtcgggagatgatggaagggccttgagacctactctaccttctcagaggctgcacaacgagaagcaaggcagcatgcagtcaccccactcccagctcaaggatgagacccacaatatctaagaacagaagagatcagcgtgcccacccttggagccatgtgcgcaaagccagaggctgggctgacccaccagagtgtcccaggtccttcagcctccagaggaggagcagcaccaccagcccagctgcactggggaaggccaacccagcccgtgcctggagctgctcccaatgctgtcggcatgggtgtgctctagctgcccaactcagccccacgctgcctaaacactgcaccccggagagagtgaaaggaaacaaggggcccctcccactgcatgcacagccagagcagaggctgcctcttttttttttttgagacagggtctggctctgttgcccaggctagagtgcggtggtgcaactacggcttactgcaacctccgcctcctgggactccaggcatgcgccgccacacctggctaatttttgtatttttggtagagatgggggtctccgtgttgcccaagctggtctcaaacaatccacctatctcagcctccaaagtgctggtactacaggcgtggaccactgtgcccagccaaggctgcctctcattgcccacagcaagagatcacttcacgaccagtctccagatacccgtgaacagggtgaactgaggggcacttttgtaacttcctgctcccccaaatcactgcactaaccaacaagtaagccacaacagtgttgacagtgggatgtggctcggaaaaacattttcttgggaaaagccggcccactggtgcattctacacaggacaccccatgccattcctggcagatggaagttcccagctgcatggagcttagggttctgtgctaaccagacgctgggagaacttggaggaaaccggtgtttacaatcgcagctagtcacgtactgccatctttaggcaattaaaatggcgtctttatggtcaggatgcccccagcaccaggcagcagtgcttggagggatgggaagcccctctgaggggcggcacagcagaggggctctggggtgccaactctgggactgcctttcctcagcccagagcaaagaagagtatttccatcagaaaacaagaaaagcaatgtaggggctgggcgtggtggctcacacctgtaactccagcactttgggagaccgatgtagcacttaagaccagcctggacaacacagcaagacgctgtctctatgaaaaaaaagatttttttaaaaagtaatgtggccagacgcagtggctcacgcctgtaatcccagcactttgggaggccgaggcaggtggattgcttgaggtcaggagttggagaccagcctggccaacatggtgaaaccccatctctactaaaaatacaaaaattagccgggcatggtggcaagcacctgtaatcccagctacttgggaggctgaggtgctaccatgaattgcctgaacccaggaggcagaggttgcagtgagccgggatcaccccactgcactctagcctgggcgataaagcaaaactccgtctcacacacaaaaagaaaaaaaaaataatgtggagcgaatgactgaaggtcccaaggtctcaaggcttcaggctcctcagctgggaatggggacggcctgtctcctagggctactgtgaagattcagtgaaatcccaacacgcccccaaccccacaacctgcagtccctgcacatggaaagcagcaaagcaagccacaggttccagcactcatcagtattaacaacatccagtgtcagatacccagggcagagctggctgcaggacactgccttctatctgtcagttcccttcacacaatgaacactgcttactgcgtgcccaggctccacagtgagcgctgcagaggccgcagacacgagacaagagagaaagacgtctctctcaggagcctggtgtcagctgccagcaaagaatgccaaaatcaaagatgacttctgtggtttaccagcactacgaagaaagcacaggataagaaaggagtggctatgagctatgccaggccatggcagccgggggcctctctatgaggtgacattgcaggctggggcctacagaagaaaggaactggaaccccaagggtgatgaccccaaatgagagctggtctggctgtcagtgaagagaacggagccatgcgtcaaagtgaaaagatgcatccagaagacctacccttgctgcaaagaggcagccggcctcattctgcagccaccaggcagaaggcatgcccatgggaggggaggcccttctgcatcttctggcttccttccccaccaggccactgtcagccaagttcagctgctccattcaacctcccatgagagctgaagcagcatgagacaggggacaggctctcatcactgtgcccaaccaggacggtgggaacagataacccttctagaagcctttccatcccaatgattaaaagaggaatgggttagaccacaggctacagctcactcctggagccggatgcaagcctgaaacctgacgataaaaaaacacgtattaaacccaacagaatttggatggcaacaaacaccccaacagacaacccgttcgtggggtcagttatggcccacgtccaactcaacaatgacaccacctatctggcaccacgccacagcagacctgagcccccatttaaccctcatgagcacagggcgctgttctgcgggtgctaggggagtcaggcatccactctcctcctccaccttcccatgtccagtccttgtctctgagcctcctcctccttcaccatcaactctctgactgctgcctgaagacagtcaccaggtcctcaacccttacatcctttctctctggagtgcccctcaaaggtcacttactcctgtggcttcaagagaaaggacatagtagaaagagtggagttagccagtcctgtgaatcacacactgggctgccctcgcaagctgggtatcttgtgtaaatgcctctctccccctagtaactggtttctgcctcagtgggacatgggaccagcccgcccgctgggggcctggcaatggcagtctaaggacactccctggtcctgccagtccagccttcagccatttgcccaagctgtcttctcaaacagaccttatcccatcccgctgggtgtgggctgggggaagggtgacaagtaatacaggggtaaactgcggctgagaaaggtccaaaaggggattaggtcctataagctaagtggtgagaaggaaagaccagacttcatcgtgcatgtgttgtgtgcatgggtgttctccctctacgttaataacgcctgccctgcccggggaagtgggcactgagcagagcagggggcgactcactcctctggatgcccacgcagctccctagggcgcccagcaaatggcaccctgggtgggaactggcttctggtgcgcactagacctccaactgcctgtctggttccccactgcgtccccagatcctcccgcagagctggggacaatgcgatttctcaaaacacgtaggatgagagcgcacgtccttcctttccacgtggagacaagagaatggagataaccagatccctctccagcaccggagaacgaattcacagctgcaggcgtagtgagccaaggccgccccatgctctgagctgcaggcccctttctacaggtcccgtccccttctgatcccatcaacccgaaggcccacgcgtcacccccagaaccccgcttccgtcgtgaccacggcgcacacccccgtcggcaaagggaggacgacgacccccgcttgccggacctagcggacaggaacgcaaccccgccaggctcgcccgcaagggccacacgccgcgcccaggcccccgccccgccccgccggaagctggggtccgcaggccggaagctgaggccgcgagccggccgc

SEQ ID NO: 2329 - DNA, 13044 bp, Homo sapiens; identical to SEQ ID NO: 2327

SEQ ID NO: 2330 - DNA, 12767 bp, Homo sapiens; identical to SEQ ID NO: 2328

SEQ ID NO: 2331 - DNA, 13044 bp, Homo sapiens; identical to SEQ ID NO: 2327

SEQ ID NO: 2332 - DNA, 13044 bp, Homo sapiens; identical to SEQ ID NO: 2327

SEQ ID NO: 2333 - DNA, 13044 bp, Homo sapiens; identical to SEQ ID NO: 2327

SEQ ID NO: 2334 - DNA, 13044 bp, Homo sapiens; identical to SEQ ID NO: 2327

SEQ ID NO: 2335 - DNA, 326560 bp, Homo sapiens
cttcacacagaaaccaaccacatttttactgcatctgctccacgctggattccaacatgctggcccggagcgtggctggctggaagcaactccaacaggtttttcccttccccgtcatgtacattatttatttttgatcctactcactgtcccaagtccagaggcagttacaaaaaacactcttgatgcaaaccgtgagtggctacaacacacggatgggggtgggcgcgattcccacaacagggagtggaatccgggaagatgatatataggggcaagacgcccccttacttgctaagagtatatggagctcaaaacccacaattgctttgttttgtttctcagttcctggagtatgttgaaactacttgctcttaacattagttcgtatttttcatcagatatctgacctgatttaaaacatgtttgtttgcatacatctttttgtagtgcaccttatagttattcctactgatataggatgaagattataaatatctgcataaaaagagaaaccatgtgactctatatgaagacaaccatcacattccacagcacatcattggttcattttcgaattgtcaagcagtatttgaaatgagagagagagagaatataactgaacacaagcaccacgacaaaacaatcataacaacagaaccaaacccaacttctctattattaatcatgttaaaattttagctttgtttctaacacttttctttacttgttattttaagctccagtagcaggatcagatttctgctgcctctaggcaaatgagttatgatctgatctcgagttccaagggaaatgctcaaagttttatttttccccagttgaataaacagtaccatgtatattatctctcgtgttagaatagtgttgtcttcacataagactcaaataatggtattagtcattcatttccctgaacacagacaccctcatgcgtgctgacaggtttataaggatgcggtggcagccgcgggttctgggagctgctagacggccgagtttgatttcttgcagtcctgagcgatggagcccgggggtgcctggttattgtccgctttctctctcagatgcttggcttgtctgaaagattaatacattaacaagagctgaaggcctggggttgcacatcttcagacatgtttattagcagatggcacagaggattcaaaggtcaccacaaaagtgacattttaaagtgaaacaacaatatttatgttcagatagtctactgatgagatcatgtggaaatgtttttgattaaattagcttataaatggttgacaatctatagacaacttaaaatgccatgtctgtttaccaaatgttttcttctcacgctctcaccttctaaatattaacaaccaaatgctgttttttcttattaaaaattttttggaatgctcatttaactgtaagatcagtgtatctggtttttacttcctgggttgactatttttattttcttttaaacctaaaaatgttatctcctgcatgtgttctgagatcctacctgctattattactgcttggaaagaggttgaattctactatataaatataacccctttccattttttttttttttttagtataaattgagtctctggagagaccccaaattcagtctctttggtgagaccttctgttcacatctcattaaagcaaagctatgagctggatttcagaaataattacgacagctgcatcttttgcccgtgtagcccttgggagccacactttgtggcaatgtgtgctggtgtttcatagaaaacaacacggaaaaccgaatgcagccgaggggaggggcgcctcctctcaacttctttttcttttctctccgctttgcccacaacttagcaggaatgtgagtgaaaactttcaccgctgaaaatggcttagccagacaatgctctacagtatgaagtgaaaaacaatgttttgtaagttttacaagtctctacagtcaggacaatgcacaaatatttccaacaaagcaatgaaatgcaaaatcagtgaccaattagtaggttaaaactttcacagaaatattacaggagatgtatatggccatatatactggttttcatttctttacatttaattgtattattaataattgtgtaagatgtagatactattgtcgactttttaaaacattattatctatgtcttatcttttgtacagttacaattaaaagtgtaagaatactgacaggggatttactcacttttcaagagaacctttttcgatattcattgctccatcgattggatccagtccttgttcagaaaattgtttcaaggcacttaaggctgcctaaaaatgaaaacaaacagagagagccattcactgactctagtgtaatgaacaagtaactgaaagaaagctgagatagaaagactcattttcattagtctacataatttttttttgcattgtttaacaaaagtacactagaaagtctgcatgatcaggcagcagtgtatatacataaccggaactagaagggctttaagtctcctgccttatcccttctccacagttttgcaaaattgtgatgttttatctgcaaacatggcaacacctcatataagcttaaaatacttccatggtgacattgcataatttctcacgttactgaaactacacattctcttctctcaggtgtgacatccaaattttccaccttgagtattctttccaaagtaagcataaaggtattgttcaaattgatagacacttagccccagtcaaggtacagaatgtcagcagaggaatggacagtaggtcctcatgcagactgaggggatggatggtaagatgggatcctgagaggatgaggaaagagagaaagtttgggctggtcatgttctggggaggcaggcctgccgggcagagcctcccgaggtgttgataggctcggggtgcgtgggaagccgcagggtgtgaacaggctggtggagccttgctgtatagctgggaggcaccaaaaatgccatgctgataagatctacataacttgttgacactcttgtgcatgttccaaactgttatttctttgagtaagaatttgggtcttcctcccctcccccaagcccgacactgctgagtgagattggaagggctctgctgagtctgagatgggcatgagcaggcagggctgttttcatcctggggcatcccgctgggtcacacttggggcatctgtgtcttctcagctgcctttgaaaacgagctagctcttggcggtttcccaaacttttatctgccaagagctcctttagggtagctgactaagtgcatgatttcctttaagtttctttattcagaatatattttggaggtgtgattcttttttagttaatagtcttgtgaggtttacagaaaacttgggcaggtagtacacagagttcccatattcttccctcccctaaatacggtttccccaatcattaacatcttgcattggtatggtacatttgttatagctgatgaacaaatattgatagcttatcattaactgaagtccatggtttacataagggttcactctgtgtggtacattctgtgggtttcaacaaatgcctaatggcatttatccaccattagagtatcatataaaatagttccacagccctacaaatcctctgtgccccacctattcacctccccccacccccaccagccccctggcaaccaccaatctttttaccatcgctacagttttgccatatagcagttgggatcatacaatatgtcaccttttcagattggctttttcacttagcaatgtatatttgaagctcctctatgtctttttttttttttttttttgactgagtcttactctgtcgcccaggctggagtgcagtggcacgatctgggctcactgcaacctctgcctcctgggttcaagtgattctactgcctcagcctcccaagtagctgggactgcaggcctgcaccaccacacccagctaatttttgtatttttagtagagacggggtttcaccatgttggccaggctggtctcgaactcctgacctcgggtgatccacccaccttggcctcccaaactgctgggattacaggtgtgagccactgcacccggcccctctttttgtgaacgatatggcttttcataaatgagcttcgtagctcctttttattgctgaataatgtcccatcgcatggatgcaccacagtttgtccgttcacttattgaaggacatcttgattgtttccagtttttggcaactatgaataaaactgctataaacatccatatgtggaatttaatgtgtaatattcataatacttttttctttcttctctcttgcttttctattgttgctttttaatcacaaatcctatatccaagcaaaagtcggcatgcgtcctttctttttctttagattactccttcctttcaaatctttaaatcaggcttcctagatcagaggtgctaatgtgagtgcccatgcagatctgcagccctggcccgggcatcccgaagcagggaggatgtggtgctcaagtctcagttatcatcataatctctttggacctggagtgctgcagggagaaggtcagtgatgccaccccatagctcctgatcctggcccatgctcatgctggacaacagccaggtgggttttgatgggaggtaggcgctaacttcagtggggtgggagctgtgtggccatctccctggatactgttataggtcgaattgtgctcttcccccaaattcatatgttgaagtcctaacccccagtatctcagaatggggccttatagaatgtggccttatttaaaaataggattagtacagatgtaattagttaagatgaggtcatactggagtagggtaggtccctgatccaatataactggtatccttataaaaagaggaaactggaacacagacccacacagggagaacgccacgtgaagatggtggtaggggctggagtgatgccgcagcagccaaggaacaccaaagattgccagcaaagcactcgaagtgaggagaggggcctgggacagattctccctcacagccttcagaaggaaccagccctgccagcaccttgatcttgaacttctagcctccagaactgtgagacaatacactcctgttgatgaagccactcagttggtagtactttactacagcagctccagcaaactgtacagggacctcatagcttctctttaaggatagcaaaatctctctctctctctctcttctctctctctccctgtattattttttgttataaaaatagttttttgttacagaaaagtcagaatatatagacaagcaaaaagaatgtaaaaagtatccacaatcctgctcaccattcacatcttggcgcacgtctttccatatcacttgttttttttctctctttttttttgagatggagtcttactctgtcacccaggctggagtgcagtggtgtgatcttgactcactgcaacctccacttcctgggttcaagcaattcttgcacctcagcctcctgagtagttgggattacaggcatgagccaccacacccagctaatgtttgtacttttagtagagacagggttgcaccatgttggccaggctggtcttgaactcctagcctcaagtgatccacctgccccagcctcccaaagtattgggattacaggcatgcgcctctgcccccagcctccatatcacttagtatcctctccccatgtctacaaactgtagcctggatcatgtcttaacactgtaggtaacctgcttttttttttttcaatgataaataataattgtacacattcatggggtgggtaacaatgttgcaatacacataatgcatagtgatcagatcaaggtaattagtacatcaatcatctcaaacatttatcatttctttttgttgggttcatacaatattctccttctagctgcttgaaactatagaacatattactgttaactatagtctttctacagtggtatagagcaatagaacttattcctcatatctagctataattttgtatcctttaataaatttctccctatccctctcttccccctacccttcccaacctctaatatcctctgttctactttttacttctgtaagatcaacctttttagcttccacacatgagcaagaacaagtggtgtttaactttctgtgccctgctcatttcacttcacattcgcccagtttcatccacatggccataaatgacaggatttcattctttttttacggccgagtagtattccattgtatacatataccatggttttttgtccgttcatctgttgtgtgctcttttcattgaatgtgtgcagtatcaacagaaacatttcggtagcatcatttctcatgactgcacagtatcctatcgatatcctgtgtgataccaacactgcatcaaatttcctattggttcaatctttatgcatcatctcaatactttccttatgataaattcctaaaattgcatttctgagccaaagatgatgtccatttttaaagatttttttttttttttttttgagacagagttttgctcttgttgcccaggctggagtgcaatggcgtgaactcggcccaccacaacctctgcctcccgggttcaagcgattctcctgcctcagcctcccgagtagctgggattacaggcatgcaccaccacgccagattacttttgtgtttttagtagagatggggtttctccatgttggtcaggctggtctcgaactcccgacctcaggtgacccgcctgcctcagcctcccaaagtgctaggattacatgcgtgagccactgtgcccagccttaaagatgttaatatgagctctctatccacccttggagaggttgtgccggcagcagcagtgggaggagggtgttactctaggtgcttctggaattacctctcagaaccattttgtgggtcagagaagcaaaccagttttgtcatcttttggccccaccttattttaatgtgttcatcctggttgttgaccttcttcactagacttggctttgtctgaagttttgctgttttcaaaaattaaactcaccctcaaaagactgaggtttggacagttctccccaccctccctgcaagaaaggaattcacagaggaatttgactctcagggagctttgattcagtgactctgaggtccttttaagtcctgaagtgctaaggcggctatgctgagggcagtgcatgtgcccacagcctgtgtccatcaaccggggcccactgtcccacctcacacatgcgcgtggggcgctaaaggccaggctcactcacttgtaggctccaaggaccaatccatgccagacctttttccagatattcccattttcacggagtgggctcatgaacttcaagttctttgtatattcaacagttttaacaaaagaccagttacttttcttctgagccattaaaatgtgaattattggcataaattctgaaatttatgaatttcttccaaagtggacaattacatttgaaattttattattttttgtaacataatgataaattatttaacattttctgtgatgacaacacctgaaatatactctcagagcaatatcaaaatgtgcagtactcaactgttagctatattcaccacactgtgcagtagatgtccaaaaaaatcaaacttatcctttttatctgactgagactttgtaccctttgactatcattttcccattccacctacccccagcctctgtacccaccactgtactctctgcttctgggagttcaattgttttatatctcacatataaatgagaacatgtgggatttgtctatgtttggcatatttcacttagcataatgttctccaattctatccatgttgttgcaaatgacataatttcttcctttttaaaagctgaacatattccattgtgtctatataccacattttctttttccattcatccattaatggacatttaggttgatcccacatctttgctattgtgaatactgttgcaataaacatgagggtgcagatatctcttgacacacaaatttcaaactttttaggtaaatacccagatgtgacagtgctggatcccaaaagcaccatcacagagggctactgagagccaggaaatggaactgtgcaatgtgatactgctgaatggggttcctacgagctctagggcttctcggtcctgttttattcctagcaagggcaaaacaacaactaaaaacaatttttaaaaatcttttaaaaaatcgtttttaggctacttatagcctgttttcactaggtacactgggaatacttggttcttagtgtggcctgaacaccagaaccaaatgacctgcttcacccagtccaggacccatggcacctgctctcttccatctgaagagaactgcatatatgagacgaaggccaggtctcagggagcagcttcagcgttttagctcttgcaaaatctcctggacgattttatcaacatgccaggcaggtcccccgtgcactgtcaaaatgatcgtcatccctccaagaatgtcctagagtctggaatggcggcgtgctctctcacttgatgccacgaatggattttcagaattcttgcgtggctgctctcctccacaggtatgcttaaaagcttccaaggggcagtcccttatctacctgatcagataactcaacccacatctcactgataaccctgaatacaatagcttataagtatgagagggatttcttttcaatttataagaggcagtggtgaccgatttatcttaacctatgtaaacagtaatagctaccattcgatgagcatcactccgccattgtcatgggactggccctttacctgccatgacctgagttgttatcacagccttgtgagatagttcctacccataaggaaacagaggctcagagaattcagtaacctacttaaggtcacacagctaataagtggcagagcagagatttgaaaccaatctatattcttgctcaggtctttttttttttttttttttttttttttttttttttttgaggcaaagtctcactctgttgctcacgctggagtgcagtggtgtgatcatggctcgctgcagcctagacctcccaagctcgagtgattctcccacctcagcctctcaagcagctgggactacaggcaggcaccaccatacctggctaaatttttttttttatttctagtagggacaaagtcctgctatgtcaccaggctggtctcaaactcccaagctcaagcaaccctcccgccttggcctttcaaagtgctgggatcacaggcgtggctcatgtctctttatttcctccaaatttaaagccgctcacgttccagatacctgatttcagcagagtttcttttaatattaatatttcaaaatcactcattacctcttccacactcattctattgtttctcacaaataattacttgaggtaagctcataaaattatctccattttctagaaaaggggttgattgttttgtggggagcacacagtgtcccgtcagcagtccgcttccagccctgggttgacttccgaggcttcgctcagcacttccgtaacacttgcaattttggctaaaactaaattactaattattttgtcacttgggttttgttacccagtggccagagacaagactactggattctccatttcttcacattctgagtatcttgttccctcctccatttctctgaaaattctttttcatttcttactttcctgtggtttctagcaggagggagaagccccagggttttgctgggcttgtggcatgtaggatgctgcagtgagaagaggcactgggattgcaaaggtgaagcgaataaaaatcaagggtgaagggtttaactgtgatgtacagatagcaacaagctcaacatgttcaggaaaacagagtgggcagggcctgccgaccaggtacccctctcacaggtacggacagaaccctcagagcggctgcctccctgctcaccatgagctcaaggaatcagggctctcctctcacacttcatcaccccctattttcccagaaacaacactttacagattaaagaacgctatggaaagagatgagtttgcttctctttctacaggatcatgccaatacctgtaagagccacactacctttagcaagacccaagtatatactgaagctggcaagcagagtgagcttttgctatcagattgatgatttcaaagaacatataatgtagtggctttgtgaacaaacactgaaatttaacagtccacaaaaatgttttactacatacctccaaacctgttcagaagatggtaaaatcaacaatatcctcatgtttaaactactctaacagaataaattgttaacttgctagaggccagttgctttaaaaattcaaagcattataaatatgctacataatattaaaagacactttggaatgagagaaaaagcaaataaccttcattttggaagacatacttgaagcctgattaagaagcaagctctaaactttgtatttactgagtgggtaaattgataacaaggtgtttaaatcctaccatctgcagttcactttcaacatggacaatttgctgtgtagtaagtgtaaactaatcttggggagttgtgggaagaaggcaaatctgggttccttaatgaggaacatcctgaatgatgcttaaatccaagctgtgtaacttcccacacgccgcagattagagaatttcaaagatacactaacataagcatccagaacgctccataagtctttggccataaacaaatggacaactaaatgatttcatttcccagctcagaagatgttttcctagcaaatcaaaacaaacacatttagcatctacttgtattttaccacagcctactaactggaatcttaaactcagctttatgacaattaatatgttccaggattttaaaaaaagaaataaaaggtacatctaaagcaataaatgtagcttcctttgaaggagaaaaattaaagaagcattttagagaagtggatgacatttcctttccttattcctgtcttttcaggtcaacacatattcatttgcatgtgactgtgtgtgcgtatctgtatgtgtgtccgtcccttagaggaaagcatctgcatagatacaagaaatatttttgtcccccaaagattttacaactgttttgtgagtaaagccccacaggttttagaacaggtgtctctaccatttcatgtatcgcttgttttgtacgtagttatagcaatggagaaacatgatgccaataagatacttttcatgcctatttgttggccttggtttgcgcacgcacgcctgtgtgtgtgtgtgtgctcacagaatggaggtgagtccagtcatgtctgtaatttctaactttcctgttgtcaattagcaatttgcaaatagtgttgaaaccagccctgcttctttcttcaggactaaacagtttgtaacgacaatgtagcagcattcggccattctctgagagataatggcagtcttcattagcaacatgtgggtattaacttatccccttgtgacacgtagttctttgtggagtctttgagcattgatgtccaatggatctttttattttgtctttttccatttcagtctttccccactgacgtcatattctggttcccagaaatagacaagtagttcccattaaagtcgatggtaacaaaatatgtctaaatgtggccttcattttttaagtgttcaaagtttggtttgttttgccttttctccctgaaaagcttgttcatgttgaactcctcctgggagctgatctaactgctagattcacctcaaaatgaacacagtagtcatatatgcagttaattaaatccgtctcctttcacaaggaaatgagaggttttgaatgtaaatgtcttcatctgcagttgagtattctcctaatttctcatcccagcaatctctgatactgaatctatattaaatcataaaaataactgaaaaaccagaaggttcttcaataagcttgaaagtttattgtccaaagtatgtcaatattaatatttctaagttatccttttctttctttgaaaggtctgtaattaaatactgtgtctctttttatataaaataagagaaaccaaaaagacatttgtatatttctaaacttaaaactttacgataggctcttcagtctattacatttcagatgaatcaatgatatgactttttgttaaataaaaaaaggattatattgagcttgagttaacccacttgctgccctgttttctaataatttcattatagcctgcactttttattcatgcttccacgatcctatcagttcaggtaatttccataaaattggtactttctaaaacggcttacccttggaacaaaggagcatctgcctgctaaggtggtggttactcataaaaaaaatagaggagtaggtggtcggagagacacatagattttagacagttgcctaagatgaagaacaggtgttttcactctagaatttggggaattcatttaaaatcgagcacttaaatcacagacctagccactgcctttatttctgcagtcaagctcttagaaggatgatggtgtagctgctagccttgacaacaacgcagagtggaactgacagcaggagtaactgcacagaatgtgttctgtgcttagaacaaatgttgagtgcagagtcctcgctactaggccttcctctaaccaggctgttttcctaatattattccttttcaaattcctgggttttgtcatttatttatttatttattttttgagatggagtcttgctctgttgccaggctggagtgcaatggtgcaatctcggctcactggaacctccgcctcccgggttcaagcgattctcctgcctcagcctcccaagtagctgggactacaggcacccgccacgacacccagctaattttttgtatttttagtagagatggggtttcaccatgttggccaggatggtctcgatctcctgacctcatgatccgcccacctcggcctcccaaagcgctgggattaaaggtgtgagccatcacgccccgcctttttttttttttttttgacagagtctggctctgttgcccaggctagagtgcagtggcacaatatcagctcactgcaatctacgcttcccgggttcaagcgattcttgtgcctcagcctcccgagtagctgggattagaggcgtgcatcactatgcctgagaaatttttgtgtttttagcagagacatggtttcgccatgttggccaggctggtctcgaactcctgggctctcaagcgatccatctgccccagccgcccaaagtgttgggattacaggcgtgagccaccgtgcctggcctatttaattatttttgattcaacacaaagtcccctttgtcacggggcttactgaaacagagctgcgggcacatccacctgctgctgaggcacgagtccacacggcacgctcactctgtgtggcgggcagaatcgtagcgccccagatgcccacgtcctaatcctcagagcctgtgaacacattacttcccatggcaaaagggactctgtgcatgagatgaaggtatgaatggtgacgtgggaaggttagccttgggttctcccggggtccactgcaatgacacaagtgcttaaagtcagagaacatttcctggctgtggtcagagagaaagatgtggctagggacaaagggtccaagaaaggcaatgttgctggttttgaagatggaggaagagggctttcagcttctagaggccactcacattccttgactcaacacaaggaatgtgagtggccggcctctagacgctgaaaaaggaaaggaggtggattctcccctagagcctccaaaaaggcagtgctgactcctgattttagcccagtgagacacctgtctgacttctggcctacagaattccaagatcacacatttgtgttgttttaagccactaggtctgtggcaattcgttaaggtagcaagagaaaatgaatacactctccctgtcacctgaacaaggaagggagagggcttggcatgtggagtctgttagacttggattaaaactccagctctactgcagaccagctgtgtgtccttatgcaagtcattttatctctctgagcctctttttcatcatttgtaagctgaaggctacgtgactgcaccggattatctgagaggtgaatgccttgaccatagtggtgtttaataaatgagggctttcattacacatctttctctcttttgctctctcttgagtccaacatccagtcatgaaattctttacactccctttctcactccatattaatttaagttcaatttcctttgtatttttgttcattccttcagcccattgctctctcacttgtcttcctaagagaatcctatcattaagccactctctcaatcaaaagccattaataactcccgcccctagaatcacattccatatctttgccccagcattcaaggcccccattggctggccccattctacctcacaacctcattgagtgccagtccatttcccagagtgtgaaccccaacccaggagaccagtccctagcctcaggaacacctggcagatgtcagcgttatccacacgctccctggccagctggtatggagatgccccccctggaccttctgccctgctgaggttggtctgcccactgtctccacaccttcgcccctgcagtcttttctgcttctccaggtggatgtccctaatttcccacctgcctccctctgggttcctaacagtgcctgccatttgcctctctaaactgtgagtcacctttgatatgtttgcgtcttgtctcccaggtagctggtaaacccttggctggtggggccccttccctctttgaaatctccacagtgtgtccacagaacatcctcaaaaaatattcctcagctgatgacccatccacttccatctgaagttcccccaggaagacaggtgctcgcagacaggggtcttattctgttctgtctgttctcagagccagcatcttgccctggttggctttcctctcagcaggtagcactccatatttctctccgcctctaacacacccctcaaccccacccttgggctctgcggccaaaatgcaaagggataaaaagtcctaggaagcaggactgggttgtatctatcttgtccgagagaaatgttcctgccccataatttacctccaaggaatatggataatagttactgtctttttgagatgtcagtcatctgagatctcaatcttctctcatcttcgaggtctgaaacaagtgttttgccctcttcaggccagtctggggtctgcaaaggagatgcctgggaaaccttatctgggaggactccacaattggggttttgcctaaaaccttggtggtggcacatcctgaaccagagggacctgagggaagcacctctcgcccgagaggagcctgggtctgtagggcaatcatggctgagttctgcctccacccctcacccctcaccacttggaaggtctgtttgagatttcttggtcctttgatattcgactccaacaaaaatgtgaagcattcctgctgaacatgggcacagacagctctacttaggaatttcattttggtttgagtaagcaattgataaaaccttacattacggttatttcatcatttttgctgcacttagcatattcctggattgcatgtgggagggctggggagagggggtgatggtcaaacaagataagctttgaagttctgtttaattctgaatattggttttattgaaatagaggccccagcataaaagatggtaaaggcagtttctctcagtgggtgagggatgcagtgagcctgacgtttttcttgggacatttggtggccatcctagtggtgggaggacagcaaagacggagctagaacagacctttgctccgtcccaaatttctctccttaacctcctcttatacctgattttacacgtatatttatctatttatatttttcagcttttaaaaataaaagttctaaacctttgcaaaagtacaaaggataataatacactgaagctccctcatccatcacccagatgaattatcagtattttgccaattttttatttatttatttatttatttatttatttattttgagacagagtcttactctgtcacccaggctggagtgcagtggcgcgatctcggctcactgcaacctccacctcctgggttcaagcaattctccctcctcagcctcccaagtaactgagattacaggcatgcaccaccacacccagctgatttttgtattttcagtagagacgggttttcaccatgttggccgggctggtctcaaactcctgacctcaggtgatctgcccgcctcaacctcccaaagtgctgggattacaggtgtcaggcaccgtgcctggtctattttgccaatcttgtttcaggtgtctcactccatgtttttcctgtaatattccaaatcaaatatcaggtaaagatacatgccattaacacacctaacaatattaactctaaatcctttatatcatctaaattcctatgcgaacatttccttgatagtctcaacaatgtcctttaaagtcagtttttgaatctacatcctgacagttcacacactgtatttgattgattgatcctttaagatctaggagttctgttgtgggcaggataagggcccccaaagatgcccatgtcctaatccatgtcacctgtggtatgttactttacctggcaaggcaactttgcagatatcatcaggttaagtacctggagatgggacaagtagccaggattatacaggtgggcccaatctaatcacacaagtgcttaaaattaaagaacctttcccagctgaggacagagatagagacatgatgatcggagaagggtgtgagggatgggtcattactggctctgtacttggaggaaggggccatgaacccaggaatgcagtggccactagaatctggaaaggcaaggaaacggcttctcccctagagcctccagaaaggaactcagccgtggggacacctcaatagctccagcgagtccatgggagacttctgacctatagaactgcaagatcacacattgctgttggtttaaaccaccatgtttgtggcaatttgtcaccacagtcatggaaaaatgaatatacatctttttaagggggactgaaagtcacactgaggtgtaaggttggtgatgggcccagggaaaggtaagggtctggctgagatgcctggggaggggaggctgggcctgagaagagcggcccaggtgccaggggaccttcggttgcctctgcccactcctcacgggccagtcaggcaagaagagaagagctcgccctcctgctgcagtggcctcttcgcagcaggatcaggccacctcccacctacacccttcagcagcctcccctgcccttggaaggcaatcacgcaccatgcccccgttactcctccgctctgtgctgggctcctttctgtccctctgctgggacaagctccctcctgcctcagggattcccgctggctagtccctctggccatcccttctccactggctgctcatcagctccaggtctcagctccagggaggcctccactgaccactctgtctagagtgtgccccccaacaaatcacaggactgtgcttatttccctcatagcacttgtctcagtctgtcattatttctgaaggaaggggctggcctgtctgactcactactggggtatggccatgcattcaacaaacactcatggagaaccaggcaccacgctgggcgctaacagacagtcatcacctttccatggcatgtgtcccagcagggagacaggcaggacagcgacggcagtggaaccagacagctgtgaggaaaggacatacagcaatgacaccaagaggtggtgctcaagtcaccctggaggaaatggaggtgtcccagagaggcagcatttggggtgagccacagggagctggggcgcaaagccactcagattggctgcagccaccagggcgagtgggaatccaggacaccgtgagtgtcccaggcagtttcaaagctgtggtgcagtaaagggcaatgccttattctggggaaggctgggccaagcccagggagtggaagctgcaggcaaacggattcgggctcaaaacaggaaggaatcttgtgtccagcgagggcaagctagatgctaagactgggtgacgcctactaccttgggccaaatgtcagatgggaggcaggtggctgtgtaggcctctcatctttcaggctccctgatactcagggttaggcccgctaacggggacaaggccacataggtaaacagcaccagcaaatttgcaacgtgagaagggctatcagagaggtggcgttcagaactacctaatgtgtggggagcttgatttgctggtaaaagctgtcttccttcccgctgttaggaggacacatttggacctgaccttcaccactggtcatgtgagaaagcctctatacctggttcctcaacgtctccgtttagaagactgcatcagcaaaaccatcctaccatgggaattaactgatggatgtgtctggacttcccagggggttctccatggacagtattgtgctggtaaatatttaacaactgactcttcgtggggagaaaatcactaagtgtagcatctgttaacacctccaccctggctgatgcgcagttgggaagacatgtgcacagctggcaccgtgagctggcaggagctgctccagcacccgcattgcatgcaaaagtcaagcactatctccagctccctgaatcctgtgtgaaggcaggacagcaagctggttaagaggctaagatttgactgggcatggtggctcatgcctgtaatcccagcactttgggaggccgaggcgggcagatcacttgaggtgaggagttcgagaccagcctggccaacatggtgaaaccccatctctactgaaaaatacaaaaattagcctcacatgggggtgcacgcctgtaatcccagctactcaagagcctgaggcaggagaattgcttgaacccgggaggtagaggccgcagtgacaggggtgggaaagaggctgagattcgcagctgaacaaacttgggctcaatgagcagctccaactcttaccggtcatatgaccttgagcaagtacaaatctcaattagtaaataggaaagcatcttctgctgatgaagcattcattctgttctaaggacttgccatctcctaactcacttaatcttcacagtaaccacaacaggttggtttgactctcattcgcagttaaagacgaggagacggagacctagaggaagtcatttgtacaaggccatatggcttgctcctgatagatctggaatttggactcaggcagcctggttctggagctgaattctgaactacctatatcatcccacctcagtccagtgagagaacgtgtcacctgagtgctcaagatacatcaagagcccgaccatgtcctggagcctcttaagagcgaagctcagggtgcaggacctgagagggtgttaatcagccgcttccatttttttcttaatatgggaagaccagattttgcttggcttctggaaaccgctgccatcttgcttttcctcctacttcagctcttggtctcctgtgcagctggcttttccttcttcctgacttttcaagcccatccttggacctcttatcttctccatcaaaattctctccctggatgatttcactgaggccgatggcttaaatcccttagaaatactgatagctccaaatccctatctttagcctggcctcctgccctagaattcacttgtctaagtgcctagtggatttctccacttagatgtctcataagcatttcaaacctgcccaaaacgaaacttgattaccatccccaaaccactcttccctaagaaaatggtgtccccgttccaccagttgctcaggcaaaaaccctagcaatcagcctcacttgctttcattctctctcatctcccacatcaaacccattagcaaattctgttggttcttttttgaaatgtactcggaggctacttctcaccacatgctctgctatggttctagcccaagccactgtcagtctctcccagagacacaagctgtaccttcctaactcgcacccctgtgtgcatccctgtgtgcatccctgctcacccaaagccaaccctttgcatataaccagagtgatttttttgaaatgtaaataagaaccggtcaccaccctattcaaatcctccaggggcttctcatttctcttagaacaaaacccagactcctgactacagccccaaagccctacatgatcctgccccatttacagctccaggctcattacctacctcgtgctcccagcccacggatcatcgcctaccacatgctcccagcccccggatctccagcacatcagcctcttggctcttcttagaactccctgaattcactcctgtctcaaggactttcctgtgcttttccttagacaggagacacccctcccagttcacatggctcactcgcttcatccaggtctcttctccagtgtcccctccttgtgacccctggatctaaaggagttgaaccaccccactcctacccttatattctcatagctcctcacgctgcctcacttttagcaagatttcattaaaattttattgctgtctaaaattctattatatatttaaccatttacttgtttagtatctgtgtcttccattagcaagtaagttctggccaggcgtggtggctcacacctgtaatcccagcactttgggaggctgaggcaggcagatcacctgaggtcaggagtttgagaccagcctggtcaacgtggtgaaaccctgtctctactaaaaatacaaaaatttgccgggtgtggtggcatgcacctgtaatctcagctactcgggaggctgaggcaggagaatcgcttgaacctgggaggtggaggctgcagtgagccaaaagaaagaaagaaagtaagttccatgaaggcagaaattttctgctttattcattgctgaatactcaacatctagaattgtagaccctccatagacacttattggctgaatgactgaaagaatgaatgagtggttagaaacagtacccatgtggaagaatatatagccacctcttacacacagtttcattaattctcagaagttttctatggcaattagggagcagattatttcgcccgtttattgaaacccagaactaacgattgatgtttaaagactaatccgtctggagtaagtagctgctgaatgttggccgttcaaatgaagtaagttaagtattatgtgtctctaatgtattttaaacttgttttatgtcaattatattatcacaactttggaagaaactttattaggacaaactttaatatttttttctagaaagtattttttttaaactaacacaaatgcaaagtcactgtaaagttcaagaagtaaacgatatcttcttttagttacagctgaaaggaaagcacatcactaataataccaaacttggtttggcaatttttagaaaccccatttaggccaggcgcagtggctcacacctgtaatcccagcactttgggaggccgaggtgggcggatcacgaggtcaggagatcgagatcatcctggcgaacatggtgaaaccccttctctactaaaaatacaaaaaattagctgggtgtggtggcgggtgcctgtagtctcagctactcgggaggctgaggcaggagaatggtgtgaacttggaaggtggagcttgcagtgaggcgagattgcaccactgcgctccagcctgggcgacagagcgagactccgtctcaaaaaaaaaaaaaaaaaaaaaattaaaaagtaatgtttaaagtctatacttaaaataaccatttcaaagaaaaagctagtatcctgatttctgcaaaatatcctcattaagacaatttaaccatacgaagagatttactctgtgtttgaataatatggtcacaagtggtctcccttacctacctccacccctaaatgagaagaaatttagtatactcatggggatatgagttaggcctgccaaatacttttggaaaaaattctgctaaattgtttctagaaactgctagtactgttaagagggttgacacattctaatatagccaaacacagttttttctaattgcttggctgcaaatgaacttgtaaggttaaaagtataagaatttattccatgatcagtgatggaatcctaatccatcttaagttgcgtgcatgacaactggcatttcctaatatgtattacgagacagagaattttttaaaatttttgcctgagggtacattccctttcaaaagcagaagattttcttcttttgctttctcaagatatcacgctaaacttcattcttgatggttcatcgattaaggaagcaagatagaaaggagaatccatgatagatttataaatttggggcaaaatgtaacacaaagcattccaatacgcaacttcaaatcaaaacctcaacttgggcaagggatgttatatcaaccaacagcattctttagaaatgcctgacattcaattggatagaattatatattgaaatagattgtaggcatattgcgaatgtttttcctctagcatctggtagtatcaaagcccaggaggaaaaaaaagggtgactgtgccagaattaaaaagctgcctctttggataaatatgtggaaaggttatgaattaatttatcaaaaggctagaagaatttgctggaagtcggagggagaagcggtttctaaaagcaataagctatttggaatttggcagcatgcaacttagtgctttgtatagctagtattattagccaaataagggtaaaatgacatttcaaaggaggaaaacgaatgaatgaatacatgcatagaaagcaacaaggcaatatcctaatttgtaaatgtaagtagtagtcatagtgtctgagatgtaatgtgggatgagccccaagggaaatcaggcaccttctcaatgaagcctttttagacttcaaagaaagtagtggctgggtgcagcgtatcacactgtaatctcaatgttttgggaggccaagacaggaggactgcttgaggccaggagtttgagaccaggctgggcaacatagtaagtctctgcctttaaaaaataaaaattagctgggtgtggtggcatatgcctgtagtcctagctacttgggaggctaacgtgggaggattgtttgagcccaggagtttgaggctgcagtgagctgagattgctccactgtactccagcctaggtgacagagtgacaccctgtctcttaaaaaaaaaaaaaagtagtgacttgtgatttgtgatctggataccagttaaagttagctaactgctaaacaaacactccagaacctcagtgattatggaaagcccaagtaggtgttcctgggcagtagaccctggtcagtcagggacccagactccttccatgttgtgactctgctctcctctaggctagcattatcgtcctctccttttagccagtggaagagaaaataaaatggaaggtagtgcataggaggatattatgaatgaagagtgacagctgggtgctgcggctcacgtctgtaattccagcactttggaaggccgaggcgggcagatcacttgaggtcgggagttcgagaccagcctgaccaacatggagaaaccccgtctctattaaaaatacaaaattagccaggcatggtggtgcacacctgtaatcccagatactctggaggtggaggcaggagaatcgcttgaatccaggaggtggaggttgcagtgagccgagatcgcatcattgcactccagcctaagcaacaacaagagcaaaactccatcaaaaaaaaaaaaaaaaaagaatgaagagcgaaagccctcatattccattgaccagaacccagtgacatgaccacacctaactccatgagaggctgaggagtgtagctgtgagctgagaattctgaggaagcaggtgtgagtaattagtttctactgcaaatggtaccatgacattgtactcacttgctgaggaatctctgttctatccccccatggtaaattgtaagttcctagaacaggatagagttaggtcttatgtatctcagtatctttaacactaacactggcatggagttgatgctccatttgtagtcagtggatgtggctgtctggctcacaaagcccagcacagtgacctggtgatgttaagactggtgttctgtgttttaatattgccaagaaatacttgcatttttctcccctcctcaagatggcttccctgtgaagacacttccagaggacacagggaccacatgctaacagtaggcaaggggcacatactttgttaactctcattgtgtcttcaagctaggagaagccttcagaggaaggcatcctcgcactcttcacctctagaaggagcgcctagatggggaggctgtgttcctggaagacaaagaatagggcggagggtttctagtgaaacccaacctcatgaataaaaagagagccaaactcgaaccagacgtccttatcagccaagaaagaagtcagaatttacaagtgagtgagcaggactatagaactttagacaaatccagaatcttattctgtctccattttatttcacttaaaacaggaacagcccccacatgaatattcagggaccagagaggaaggggtttctgcagggttgcactccactttgcagtcaggctaggagaggatgaatcctaaggaagagatggcggcagcagtcccttattcatttttttatacgaaagtacaaagcaaaacaaaaacaaaaacaaaatcacaaaacacaaaacaaagcccccaaaacaaaattacaaaacaaaaaaagtgcaaaattacaaaacaaaaaacaaaattttaagctttattttttaaaacacaattaccatcaaggaaaaatggatacattggacctcatcaaattacaacttatgctctgtgaaagactctataagagaaggaaaatgacaagctacaacagggaggaaatattcgcagaccacatatctgacagagggccagtatctggaatgcatgaagaactctcaaaactcaacagtggaaacaaacaatccaattagagaatgggcaaaggacatgaagagacatttcaccaaagaggatttacggatggcaaacatgaaaagatgctcaatatcactggctactaagaccatattatacacctgttaaaacagctgacataaaaagtagtgacaccaccatacgctagagaagattcgggggaactagatcctcagccacttctgatgggaatgtaaactggctcagccactctggaaaaatagcgtggcagtttcataaaaaactaaacattcacttaccatacaacctagctatcatactcctgggcatttatcccaaagaaatgaaaatttatatccataaaaaaacctgtacacaaaactagaaacaaccaaaatatccctaagcatgtggtgggttacaaattgtggtgcatccataccatggaatactactcagccatcaaaaggaacaaactattgatataacttggatggacctcagggacatgaagctgagtgaacaaaagtccatctcaaagagtcatgttattatgattccatttatgtaacatttttataatgataaaagcatagagatggagaacagattcatggttgccagggctggggatggtggggaagtaggtgtgaggggagaatagacagcacgagggagagcctcatggtgacagaatagctttgtatctcgatcgctgagtggttgcacaaatcttacacacgtgataaaatggaacagagctgcaacataaggtgtgttctactaatatggatctccaggttttggtactgtcctacaggtcagtgagatgtaaccactggaagagactgtgtgcagagtacgtgggacctctctgtactatttctactacattctgtgaatgtttaattatatctaaatgcaaggtaaaacaagaacaaaattaaaactgtgcttttggaaaaacagtattttacatttttaatttaatttaatttaattttttttaaagactgggtctcactgtgttgcccaggctagtctcgaactccttgcctcaagtgatcctcctgtcttggcctcccaaagtgctgagattacagacgtgagccattgtgcctatttttaattttaaaattaataactctcattgtaaagtgtttaagactatttaaatgttaaaggaaagtcccccatactgtctcacccttcaatcaactccaatctcatgtcacagaataactactatgaacagtcaagtgtggtgtgcatcttatttgttatattcttttctgtttgtttgtgtttttgagacacagtcttgctctgtcacccaggctggagtgcagtggcaagatctcggctcactgcaacctccgcgtcccgggttcaagcaattcttctgcctcagcctcccaagtagctgggactacacagaggcatgtgctgccacgtccggctaatttttgtattttcagtagagacagggtttcaccgtattggccaggctggtctcgaactcctgacctcgtgatctgcccgcctcggcctcccaaagtgctgggattacaggcatgagccaccgcaaccagccaattattatattcttatatacacatatatggacttttggttttttcctcaaatggaatcactatgctaactcttctgcaacttttttttcccacataataataatacatcttggacatcttttcaagacaccataaacagctcgatctcattctttttaatagctgcatggcattgcatcatatggctgtgccataattgatttaatcagtcccataataataaatatttagattgtgtccagttcttaccaaaaatgctgcaatggatattcctctacaaacattttgtgcaaatactacatctataagacaaatatatgattttgatagataatgtcaaattgctttcttaaaaatttgtaacaagttgtgggtaaaagcagctttaaagagaacaggagggcagctgcatccccaagggcctggaagggaagggacccgaaggaacctcgctgaccacgaggtggaacccctggaagaaccagggcgcctcccacctgtactggtggggacaccaggcttatggaaagttagcagtcgttttccttttcctcccccctctgggtggctaggggacacttcatctttatcaggaaatgaagtgagattatctaacatgagaggatctatcttaccaccctctggaaagcgacagcagggctagtctttcctctcaagacacaccgggacattcccatgagtgcacacactggctacggcatccatcgatgggatttttagccaacatcttccaacttcacttcctcgtttccaccaccgacccattcccaaaacaattctagtttgactttacactggactaacccgggtgcaaagtgactggaccctcccaaggaggaccctaggcaaaatcctaaaatgggcctgccataaactgatcctctccctcccagctgcaggtacccatgagtgttaaactagagaaggcaaatgttggcataatcatattggcttacaggaattcatgggtcagggaccattttgggaaggaaggatataagattttaacgtttgctaaaaggagatacaagtcttttttttttggagtctcgctctgtcccaggctaaagtgcagtggtgcgatcttggctcactgcaactgctgcctcccaggtgcaagcaattatctgcctcagcctcccgagtagctgggactacaggcgcacgccgccacgcccggctaattttttgtattttagtagagacggggtttcaccctgttgtccaggctgttctagaactcctgagttcaggcaatcagcccgcctcggcctcccaaagtgctaggattacaggcattagccaccacgcccggctaggagacacaagtcttaaaaggactgagcgacactgatgtgttcctgagctcacagttgctcagaaactggggtctcagtgaggtcatgggactcatccacgtcacggggctggaagatgacccacctggccttgaaccctggttatctgtttcccaaatcagagttggtggacagagcaacgacaatccagctggagcgatggttcagggtatgtgttcacccagccctttcgggacgtcgcgtgcctgcactgtgggaacgcaagtggacagccggtccctgccgtgggcgctaggggccagtgctcagcgcgggaatattcccaccgccacgtgcgcgcggacagcgggtactctgaggaggggcctgcagcccggctggggctgggaagacttcctggacgaggggcagcccgggttttcctcaaggatgagctggagtcggcccccggcgcaggagcaaggtgccgggagagggccgagctgggtgagaggcctgggccagccaacagcggccttcgagcagggaccgcgcagctccgtgtccccgcagtgggagggcggcgggcaggggccgggcgagttaggccgcaagcatctgctggggccgtcgcagcaccatcccacagaccgccactgaatcaacagcagccagttctccctgggctctggaggccggaagtccaagagcaggcatcaggatgggtccctccttggcctgcaggtggcggccttctggctgcgtcctcccagggccttccttctgggcagcacacctggctgctctgtgtcctgatcccctcttctgaggacaccaggcagattggattggggccaactcttatgatcttatcgccactttacctctttcaaagattttatctgcaaatacagccacattctgaggtactgggggttagggcttcaacggatgaattacagaggtgggggcacaatccagtccgtaacaaggcttttgtgtcatttccaggggcacagattctcccaggcaccaactggaaccagggcagcagcgagctcagatttgtttttggaaggcctgtctgccctggggctgggtgggcagtgggaccaccggcaagaggcctgcaggacagattaagctccctcttgactaagctcctacaccagcccacccctttcttgttacaaccacttttgctgcttggctctctggactcctgaggcccaggagggcttagggtgggggtgaggcggggagacacctctcctggcagccccctcactactcctgcctctggcaggaggagctctgcagggtcactatctggacccagcccgttgggcaccttctgcagactcagaagggagcagcacttccccaccagggctacagggagggccagataccttccaagaggcagtcctggacaaaggcagcaggatatgccgggctggcagaggcaagggatcagtggacaaccaaatggccttcaaaccaacagaggatgggtaaatttggatgcatggatttgggggctttatgaatttagacattttaaaatatgtattaataagtaacagaaacttacttctttaggcacaatattagaaatattggaagtatattagaagttattaaaccaactggagatctttttagccaatgttttaaacacatttatgactagagcaaaaacttactttcaaaatattgtgatagttgtatgtcgacataacttaggaaaattgcacacatttttatcttatgtagtttaaaactattcttctgtgaagaggtgcataagtttcacccgattgccaaagagtccatggctcaaaaaaggttaagaatccctgtttaaccaaagccacggatgagatgaggtggagtccaaggagaggaaactaaagactcattttaccctctagtaataagacgtttgggggctaggacttcagaaaagttcaactgctctggagcaactggaaagttcagggcttcaaaatataatacaggtaaagaaaagcaaagtattggtattcttctgatgacaaatgttctttgattttcatcatccttctgaacacaagtcacaagtttgaaaacctgtataatgctgatcatctcaagtaccctctgccttcaatcttgggtgtgtttatttgaaacctaacaatgtgtgcaaaaccaggagaaggctggggagtgagggattttgccaaagtcacacaagtgtgtgtgctgtttttgctccaagctgattagatgcttctattgttatgtatcaagacatctcagggtgtggttgccctaaaggagacagtgaggcaagaaggtgacggcatttgtagttaccagccaccctcctgctcttttaggatgtttgtgtatacacaccctaatgccagcacatgaggatgtggagaccaggcccaggaggaatccatcctcacaaacactgaagaacccagttatccgtgtgctgatccacacgctgccggcaaagcctgtagctggcaggcatcatgccacatttctctcccaaagcaaccctataaacgtaatccttgaacagggccttctcatttccagcagctctttcataattttgtgctttctactttttgaaatgttgtcttggctcatcccacttgaacctacagccgtcagcttctttaataggggtgtctataaagaactgccctaaaatatgcttttccagtgcacttaatgtctttccaattacatccagatgtgaaaagctgaaggaacagttctcaggactggacaagatgacataaatcttgcagctgacagagatcccactgagctcagttggggaaactcacagagaacttgtttggggccagaaaagcggctgggtataaagacagatgtgtacactcggattcaaaaaaatatgttaagagagagaaagcgttcctctaacacagtgcctacaaatacggctgaggcatgaagcaggctgggctacccaccccccgcaactagatcaaaggaggtgattgaaaaggctttggagagagcagaccaactcagcgatgcttcctggtctccttaattgctcttctcagggtgaggaaggtgggcactcctgacagaccttgctggaggagaacaagggctgtttgtgcagctgaggacttggcttttatttttttaatgattaggttttgtacactttccagaatgttccttttaaaaatagtatattcttccttctcttctccagatgctaggaagtgcaggttcaacccaaaccgtgtctatttcaaagggacacaaaaacccagagctggagttaaaggagcttggcggcatgctgcccaaggactgaaggctttggttttcttttaccttcccaagtaattttgtttttgaaggttggaaaacaaattccacagaaggatcagcttctgcaggatacagcctggagcaaggcagagcaaggagctgggtgcagggctgagccaggaccagggcagacacggtctctcagacaggtgccgccctagacagacagctcctgatgcatccaggggctcgctttctagtatttcaggttcccaggggaggaactgagggttttcttttttctctcaagaggctccctccaattatccactgcctcttctctaactcttctctctctctctccctatcatgacacccggctctgtgacagaggacagaggggcttcgctgcacacttgctctgaggaggctcaaagggcccatttgcagcacctggtcagggccactcttgcaaacctcgcctgggcccagcccacccagtgctggagaagccctgtcctccttggctgagaccttttgcttttcctgccatgcatcccacggaaggcctgatgatggtgcatttcattgacaattttatgaccctggccatttccccctgtaacaatatctttaaaatggctccttgtcttcaggtgggtgagagcagggctgtgctcttccctctccttcctgtcactaaacgtctgtgccttaagcaataacactgaagtagtagaatgtgagttctggatcacagaactgcacacataactttgaccacttttgtttccatcctgagataaaagccaaaacgtattttttaaatttatgttttacatcttttagttgggcattgcttttctgagtgaattctaagtattgtaaagatgtcttcaaagacagacaacctcgactctaaagaaattaatgcaaattacagtgtatctcagtgacatgctaatttatagcaccgtaaaggtacagttcaaagctccaacgagccagaagaaagtcggtggattgatggtttgcagtaagaaaggtttagaaacaataaaatgtaactaggattttagtttggaaatgaactaggggtccatttgttccacgttactgagtttttaatttagatctgctgttaaaacctaatgcattttgtatttgtggctagtaaatgactctgactcggtgtcttcaaggagacattgaaaaagaacaggaacaattctcaaagataagacttgcagctgcaggtttcttaacaaaaaatataatctctagatctcacctctaaaatgtgattacaaagcagaaaagtaaaatgaaacaaagaaacaaacaaaagaaacacctgtgatttttaaaaaagaggttggcaattattgtaaaagggaaaatgcatttctgtagaagcaaaattcacttgtagtagcatataaaatatcatgctgtatattcatgaactggcaattattaatcccaaacacgtgaatttgagtaagaatgtaaaagctatcatttgatgttacaaacaatgactatgtaagcatatcttcccatttctttgctcagtaatcctatcatttacactctacatggacactgaatgtgcaaatagattcagcaaacacactctagattctaagagctgtctgggaaaaatcaaggggcaccttgttacctacccaaaccaaactggtgaaaattggcacgagtgcttaggtgctttgaggcctgagtagctaaaccagtttgaaaatagatacctctttttagagcacagaaggagaaaaaaaatttttaagaggcaattaatttcttaggataagtagatttttgttttaatttttataccaacaagaaattaaactctggtagtacaaataacatcttttttttaaaaaaaaaagatacaaagctactgatcaggcatgtatctgttttgttttaagaaagcaaattcccgggtgtgggtcagtgtagccctctctctgtgaggatgacagttttctgaagtgacgacttgctccagcagccactccactccagagggctgagcttcaagctgccacttggatgcatgtctgtgtagccagaaaacaaatgtacacttttactaaatgttgtgttccttttactcaagatcacctaattctaaatatattttttacaaaaaaaaattcagaatattagactatttaaaaattagttatccttaatgaatataaaggttaataaaattatttctcaatagagcaagctgtaaaaaaggaattccgttccccaatctagcagtcacaaattctgcactttaggctgttagtttttaaaatgccacacattcataaagttgtgttttgctacacatgccaaaatattacacagtagctgtgatatgacaccaaccggacaaatttaaaatttgtggaaccctgaagaattacatttcttcttggattatcttattgctgatttcatttgcagctgtaacctaatttttacaatgttaagtgggcctaccttcaactcacatagttacttttgcttcttgataatatgatcataaaaccgaatttgaaagacttccttttgtgatctgtgtatctgtatggagggatgttttctcaatccctgaatcagaggtggcaacagacaagggtagtgaagattaggactcaatagaatggggtcctaggtcactctgtcccaacaggacatgccaatcatttatccatccactctcttcttcaacacagaaatagcaatcacagaccatgatgacatcttccatttgaatggcattttacattttcttatttttaaagagagaagaataagagtattaggcaaggaaaagactaacgatggcattctttcaagccgtgattaatatgcatggtctgtagatgtatattaacacacacagatcatggatttaaatgactttatagtaaagccacagtaggactgtgcctccccacaagacaatggtgcccagtgagagctgcagcctatgcagatctgggaagctgtggctgtggagaggtcgagtggtcctcccaccactaggagagaggtagtttaggcaggaccttggagtccaagccagctcatgcttagagataggattcagcttcaactggagatggaaacatttagccagttcatcctactcagtgtttgcggcatgaccctagaattctaccatgtgcaaccctaccaaaaacatgccttggtgcaggcagaagggccatctggatcccatctcctcatacaaaggtgcaggtcacaaagcctcctgcccgctctgcttgggctggctctgagactcacagctatctatctagagactcacagctatctgatggtaaggaagtttacacttgcaaaggctcaggaaggagaggttgtgagattgatttggggaatttagcaacttggtctctggtcaaactactactctctcaggggctgtgcggtcagggcgaaggttttgggagccaggagtacaggttgggagtcaaaggccatcatgtttaggaggctcactgttgctgcagcagacactgacaccagacctcccttgacctagagagaatgtgggacttgtccccattgggctctggggcagcctcagctcagggcagtccagagcagcccaaaccaggagtgcgaggtatgttcacaacctccagagacaggcccaggggtgctctgtgcctctgctgaggttattccctatccttaaaaggccctaacctcttatcttcctctgaaaaaccaccgtcatttcctcccctaaagtgctctccaaatttcgtgtctgtcctttgcacttccagaatgctttgcccatatatctgttatagttttttttatttttttatcacactgataatatgtgagactacaacgtgtctctgtacaccacctggccgtggtcaaggggggtgatgtacatatctctctagccccaacacataacctaaaacatagtggatgttcagtacatatgagatggatggacggacggatggatgagaagctgaggtttaatgtctgagtgtgtcatccaaatcaaagttcactggctgtttttagagtttaagaagatggattaaatgtctagacccatgtcagaaaggatccatgtactggtacaaatgaatgacgatgggacatgctctccagtgggcagactcaggctcagcagtgagacaaatacccttaaaatcttcagatctgtgaacagcacgtgtttctatcttgttgtcatggagcattgttcagttaaaaaccgaaagtcaaacggaataaataaatgtgccgcaggagattaggcacaaaagggcaatcgaaaatatacagtgtggtctatttaaaacaggtcccagttggtgatatagaagactttaaatagggcctctttaaaacaggtgaacctaaattaatccagtgtaagaactggaacctctcatcttccattacatggagaaagaataactgaaatctgcccagagttatcaatcattcattcagtcaggtatcttttgaacacctcctaagtgtacaatatagtccctgctttgctgaggatgtaaagaaattggaaatgtggacatgaaagaggaagagtttgctaagtgggagggggagggagcaggtgctcctcatggcaggaagggagggggcagaacagtcctggtgtggaggcaggaacgagcatggggcccatattcggaggtcttggggagtttctattgcattccgtcttaccagataattattctcttcctaccgttcctatgtgggttactggagctgataacattctctatgtttacagccactgatattttctctatgatgacatatgtttcaagtatagaaaaatgtatatgcaaacacatttgggcatctatttaaacaaggaaacagtacaggggctgctagattcaaattccaggagttgtacagaacattttattgagtagggaatcacacgcagtgtaccgagtaacaacatttaccaaatgaaaccaaggtctcttaatgttcccaaatctttgattctctaatacaataaatatattgctactcaaacattcttttagccctgacatctttaacttgcattgggaattctttgaagttgagttttcctcaggacatattatatccataaattagatttttttcataatcctctctggccttttctagctcatcaagggcactgaaagggatagaaacgatgactgtgcagtcagatatctgttttcaaatggaaaatggcgagaatactaaagagatctaccccagcttagaaacacacagaaagaaatttcaacaaccaaaaaccacctcccttcagatgttactatctacatgacaatcaacaatccaatacactgcaggttggtgtccaagcccaggcccttggaggctgcagccctcccaaggaccccattaggataagggccaacaaggctgcccccaggggctgtgtggcctccacactcttacactcttacatgcatagttgaatcttcatctcgaatgaaccgcttaggcttaggcaccctctcatatttccattggtgatgctgtcacaagggaatttcattttatactttccagcctaagagatttggtacaaaaaagatatgccgccaaaataaaaagatgggggaggaaaagaacatctcccacgtccctatgacgccaaggctttgctcagaatttatttaagtctgggtttaaataccattcttggctttttctttggtgtaatatttgtatttgcctgactctcctctccattgaagtatccctattttagctgtttttattcacataatttccatcaggataggcatgatatgcaaagtacttaacaggtagggagtgcatgggcaccaactgagcagaactaattgccaccctgggctggggcagagcctgagatactcccttgttgcactgggtgtgatcccttgagtagctgggtcttgtggaggtgaatggggtctcaggagagggacctaggcacggggttggaggagggcactgaggacttaaggccatagctacttaccaatagcagataattggcaacatggaagtatttcaatattttaacaacctatatggacatactaaggcacactaacaccaacctgctgaatatcactcccattaaaatctacccttaaatttcattcctaaatttgacttttaaaatttccttcccaggaacctcacaggaagaactacttcattaaaattctcagctttacttccataaaataaaattggtcctaggattgacttggaattttggttttcaccattatgattttcctcattagacaattcagcttcatgataatggatttgaatctcatggtttccactttgatccctgttcagtattattctaagaaatccaggaatcgtactcttattccttctttcatttaatgtacaaacacctttttactttatcagttctttgggcttaatcctgtctagtaagtttacagaaacaagaaagaaagagaaaaaagcctgcagtttcagtaacagttgccagacattctctcccaatacttgtgaagcaaggctcaaggagaaagctaaaaaactgagaacaacaacaaaaatcacccaaaagtagctacagtgtagaagcttcttttaaaaaaaaattcactaacttgaatattttctctaactgcaaaaaatgttggtttattctgaacccattcaaagatatgagaaagttacctcttgttacatgaatctgatccttgtcaggtatattctcaaaagaggaaatcagcattttatccagatatatttggaaccaaagtggtataaaccaagctctgaatacagaaagaacaggaagaagttgatgctggtcagtgggtgggtggcactggagaagggcagtaacacttgacattaattatacattgccccatccgatcctagtcagggtatttgccaagaagttcttacattcctgtggccagggaacagggccacactagagtttcgtggaaaacaacagtgcattataaaacatttaaatcattccaactccctacaatgactaaatgatttgacaaaattattttatcgaatggaagcctactttcatgaaagtaatcacattttcatcttaaggatttttttcaaaaagaactttcctatattcatttttctttaacaactaacggctgctgttttggtgttaacttgccaaggtttttatattactaaggtaaatgcagagacataatttgaaaaagaataataacatttaaagggtgctcctactttgagagtgtatagtcacagaagagaagccaagaaaccaagctcctcttctaacatgaagaataaattcctagtgaatacagataatatgaactatttcagataggctttattattagatttgcaccaaaaaagccatatttttccagtctatagaaatagcctttgagaatacattttccatatagaaatcagaaacccctaaatacattctgagagccatcttgaatgtccaaactttttaaaaggggaactttaaatagttggaagcactctggtttctggagctgcatttttacccttcaccctgtcaggaaggggggcctcctgtgtgaagtcgcctctcgttaaggtgatcccctccgcgaagacctcaaccagcagccctaccatgtgcagagctcccactgaaatcaaaacccaacctcaagctcacgcagctccgcctccacatatcgtcacatcccacacatgctgctgtcatcacacccacgctgttgtcacaacacccaacgggctgttactaagggccctggtatgctgctgaatatatgcattcaataggaattttcaaaacatatttcaggaatacttgtccttggttccgcatcatctgctcaatgcagccactgtctctggaaggagcaactcctatcgggcacggctcctttgactcttggggcctcctgcgtccccagccccagccgtgaatacacaatggagatcagaggaatgctgcaggaggaatctagggcagtgcttaattggatcattccccttctattagaccattcatataggtcagcacatctcacttcaccctctccctctactcagcagtggctgccaacccaagctcagatgcaattcaagttatgtatctgtatcttcttaagattcccagggtcttagcctgaggtacctgacaagttatgtttctggcaaaacattccttctagcctcttcgatgctacggaatagctgtggtctctatatttaatcaaacaaaaactagaagaaaatgggggcaggagggcattgttgttgttttgactaaagtggtttgggcaaggtcatctgttccaggttagaagagagacattatttgacagacagcacaaattactgattcaatacttgggggctcttaattcttgttaaacatgtatggtgaattactacaggggacgagagaggttttgaacaagtttaaacacatttgacgacatctagcttaaaaactccttgtcacctttcctggaaattgatgtgagtacccaacagaggtaaaggatggctaaataattattacattggccttttgaggaaaatgcctaagtggcagggatgacttgttctctgctaaggctctgagtactcttagatccatggtcttctagacttgagctgtcttgtgcattctctagttgctttggaggtctccattttggtgacaacagaggcattatcagttgcttctggaatgacagccataattatttagtgccagacactatacacagctttatttttatatatattcttcaaaccaaagtcacaaggagctctaagattgtcctaacattatcttatggtaggttggtcacatccttcagatttctcatacgcttctgagagcaattcattccaatggtttagccattgacacaagaaccagcttaagaccgagagcctgaactgtagctctgagcttctgtttctggggtgtgcctgctcctctcctctctccacactattttccttctttcagttgagttcacccaacatacattgggtaactgtgtgccaagttctttcgaatgtattgggtagtgggtggtgatacaggctgtagagtcagaccaacctggcctgaaacctggctaggagacttaggggaagttactttacccctctaagtctcagtttcttcaatgactatcctcaaatgagacaatgcacacaaagtatttagcagagtgcttggcacacaggagatgtgcaggacataatatctctcactattacacagatatacacgacagatcaaaaacagctcatgagctagtgggaaggaaaacactacaggccatctgagtatttcctagtaagggctagtttcaaaggagtaataattattccagccttagtaagtgggtaggtggaagatggggctcagaggagtaatacaggaaatgatacctgagctatgctttattggataagcagtggaagccatcctctgtggtttgaaagacaatcataaaccttgtagagtcataagtaacatggcaaatatgaggtgactttggaagctccacaccatttcttctatgtattaaatgcacatgctaaggagaggataccacttgcatcatgtcatgctggtggcagcaaagaggccaacagagagcacaagcacaagcacggcagcaagtaggaggaggatggagactgtgtaggagggagagaatgaggtggggagaagcagaagccaggcaggaacgcaaccgcgggctttcaccaatctgtggaatgtaggggaactcaaactcagagcctgcagggatggaactggacagtccccaagaactctgcacttgggactctgcccagccgtgtggccacacccagggccccagctgtctggttctcagcagctctgcccaggctcttcacctttgtcaatccgatcttcctgcttctttgtctgctttgattacctaagccatgcctgccacatcaccccatccctccatcttttctcttattatcccccatatagaatgactttttgttcacatctatcggtaaaaaaatttcacctattttatttttatttacttatttatttgtttttttgaggcagagttttgcttttgtcacctaggatggactgcagtggcatgatcttggatcattgcaacctccacctcctgggttcaagcaattctcctgcctcagcttcctgagtagctgggattacaggtgcctgccaccacgcccagctaatttttgtatttttttttctttttttttaatagagacagggttttcccatgttggcatgttggccaggctggtcttgaactcctgacctcagaagatccacccgccttggcctcccaaagtgctgggattaaaggtgtgagccaccacacctggcctattttatttttttgacagggtctcgctctgtcacccaggctggactttagtggcatgatcatggcccactgcaacctccccctcctgagctcaagctgttctcccacctcagccctccaagtagctgggaccacagacatgcactactatgcccagctaatttttgtattttttttatagagaaagggtctccccatgttgcccaggatggtcttgaactcctgggctcaagcaatcctcctgccaggcctcccaaggtgctgggattacaggcgcgaaccaccacagctggccaataaaacattataaacctaaaaaatatgtaaaagattttccttattcctgctgcatctatgcacttcaagccttgcctatattgtgatatgccaaaatatgtgttagtcaaatttaatgtctttatgatatctagtattaaaaaaagacaacttctttgagtgcctttagagtatacacagcaaagactatgggattccagagggtgtagccaatgatggtgaagaaaccttctctgaacatgtttttgcagaataatgacttctttgaaggcagtcatatgaagaagcaatgggaaagccccttcttcttccttccaggatgcctgcctgccggcctctccacttgcacttcctgaggcacagtggagaagcagaatctggtagacttgggtttgacccctggctgtgtgatcatggacaaattatttagtagttatgatgcttactagaaagtgacaagatgaacactgtccagttttatctgactttgtaccttcaatgcagtatgctggtctttaggaatgaaaatggccatagaccttgtgcatggcaacatgcatgtgctggacttttgctggtctatttttactttcttttgacctgcctcgaactgatgaaatacaaattaaaaacacttttataacaatgttgtccagaaaaactgtattccccatatctacttcatttcctatgtgccagttctggagagtaaatatggtttctgtatgaatttctgagtacttgttcataaaggatactgcttcataagaaagactacagaaaaataaatcactgtaatgattacagaagctggtgttactaatgttcacagttcaggttgctaagtttttctaagtgctcaaggccttagtctgatgctctttgctttaggtttaccgactgatgtgcaatccaacatttggacccttacttttatgagaagcatgttcagaaaaagaaatcaaggtatatgtacttcatttggggaggaggctttcaaacaggaaatttcctctgttccttgtttatctcatatctggaatgaataaatttcatttttgtaaaatgatttctgctgagtggcaaccacgaggatattcatgaactgtggtatgcaggacgagataaggacagtaccttatgtctcctggaactgactttgagggatctttcattttctccttccacacagatttgctcaccttgtgtgtactgagaaggaagtggggttggtggctacaaaagacttcaaagtggtgttaatacatcataattcttctcactgaaggccagatttattaggaaacatctttagtacacctattttttccttttggtaaagaatttggatttcgagacaacagtttacaatgggcctgataatctagcaatttctagcttttgaataaacttttccgggatattgcctgaagtaaagggccctgttttttgtttgttttggatttgtctttttgcacacagctcctaagaaacaggctggcagatagatcaagcagaacccagttttgagaggctacccaatcttctaagctcacgtcaagctagcaaattggttctcagaagtctccattttccctcagaattgtctctgaatgaaggtccttgcggctgcttactgttcttttagagggtgacacctattctctattctccttcactttgaatatcatttttcaagctttctgagaagcgctgttacacttctatgaagagactccaactgccaatcttgaaatattctttgaaaccagtaacaccaggtgctctgtccaagaagcaaaggaggcagctccatataatagacaatgcaacatttgttcacaggcagcattggatttaaatacgcacacacagaaatgcacacgtgcatgtgtgcacgcgcacacacacacacacacacacacactgcagccttaatagctcaatgtttctcttgaaacactccaagggtttcaggaaatgcaaggaaactttcaaaaacaaagtgtaaaaaaaaggaaacagaataatcaaaggaaagattataaaaggaatccaaattgaatatagcttgtaataacatgcttaacagaaaggaagttgggaggttagatgaagttatatcaccaacctgcaaataaaaacgatctctttcagagtgattaaagatctactctttgtaagcaatttcagaggcatggatttgttttgtgatatcatattaagaagatacagctaaaatgaggtcattgcccaatggaggatgccaccattttctcagcataatttatgtatgaaaccaaaaaacttataagaataaacagcaacatgattctctgtactcttgctgagaaaatacttaatttcgttttgagtttttagacagtcttgcttatcaaagagcagaaaaatgcaaaggagagaagtcaggtgaaagagaaatgagcccaccccggcccacactgacagctgagctgggcccctcaatttcccggccacggaggcagtgtggccaaatagcactggggtgtcctcttcagtgctcaagagtcatttccatttcttttgggtgcctattttgtgttttctagcacacgcaataatatcgtagtaagtatttaatggcattttttaccacagttcctttacaatatcctagaatatagcccattgtccttaatttctatatttaataggaatgtttttgactagaaaatatgttatactcactttctttgttagtagaggtattagaatgcctcacgtattactgtatttcttaattatgtcttcaaactaattatctctttctaactaggcttgggtggctgcatataattttttgtttgggatgtttaacttccctctttgcttttataggagagtgtttttaacctctttctgctccttttttgagtttgttgtgactgatgctgaacaccaatcattctgtgtctgcatcactggcttgcttggttggaatccttttaactgtgtgtgctcactggcgtgtgcatatgcattgcttgattagaccatacaggacttggtgtccccttcccttgttgtctttcattctattgcagcctatttctcacccctgtcttcatttatttatttacttattttgagatggagtcttgctctgttgcccaggctggagtgcaggtgcagtgatctgatctcagctagctgcaacctctgcctcctgggttcaagcgtttctcctgtctcaacctcccgagtacctgggattacaggcgcacgccaccacgcccagctaatttttgtatttttagtagagacagggtttcgccatgttggctcacccctgttttcaaaggcagtgtatactggtgtagggtcatgcccagatgctctcatcttaaactcttgactaattcatcgaacacaagaaatgcattcttgcattttaggatagcacacttgtagacctcacaaatgtaaatggaaacccatacattacattcctttaagccaaaataccatggttcaatcttagaactggttttctgggttttagactcatggagttacccatgcatctttattattttcaggttctattcatttttaatgtggctagaaactggagttctgtgtctttaaaaaaaataatccctggtgtttgtaataaaattcctctagaggagaggtgaaagggcttgagcaacgcctttctaccctctggcttattagagaggatgaaggtttctaggcaggatgaaagaaataatccaggaaggaagccaggaagaaaaagggggtggaggtaaacttaagccagtgtcaagaggttggcgaatggaagaatgtgacacagaagagggggaaaggagaagccactctgataaatctcaccatccttccttaaaggcctgtttcaaaggcctcttgccatggagttgccctggcctttcccactctctcactctcccacctcatgtcagcctccactggaatcccagaacgttttatctacatctcccttacagccctcatcaacttctactttgtgctgtggatatttatgtgacttcctgtaagccctccactgactcgccatttaataaaccattattgagcacctctctgggtgccgggcgctttgctagatgccagggatacacagacggttgtggcaccgcctcagctctcaggagcctcccagtcttggcatggctctggtctaccaggcccaccatccattgtgcccaccatggcctgttagtgcagtctcccctgcctgaaatggccttcctctccttttctcgtttgtctttcaaggccttagacataaactgttcaggaagttttttgggaaatgttgagttcctatagaatatgcacacacctctttcagcacttcccataagttgacatcttccatttacaagtctatctctgccactggactcagggcagaagtctcactttttaatctttgattctccaacttcaagagctatgcctgttctatggtagatagccactaaatattagttgagttaataattgattagttcttctcggccgggcgcagtggctcacgcctgtaatcccagcactttgggaggccaaggcaggtggatcacgaggttagaagatcaagaccatcctggctaacacgatgaaaccccgtctctactaaaaatacaaaaaattagccgggcatggtggcgggcgcctgtagtcccagctacgtgggaggctgaggcaggagaatggcgtgaacccgggaggaggagcttgcagtgagccgagatcgcgccactgcactccagcctgggagacagcgagactctgtctcaaataaataaataaataatttaaaaaaattgattagttcttctcacactgtccctctaaggtggggtgggaaagatatcatttgtccccttttacagctaggaaaacaaaggggcagagagcatcaataacttgcctccaaatttaaatgatggtagagccagacaagaagccgtgtctgctctattctccaggctaaacagatctggtattagaaaaaggtgtacctgtttcccctgtgtccttttacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaactactttaaagttcatatgcaaccaaaaaagagcccacattgccaagtcaatcctaagccaaaagaacaaagctggaggcatcacgtgctacctgacttcaaactatactacaaggctacagtaaccaaaacagcatggtactggtaccaaaacagagatatagaccaatggaacagaacagagccctcagaaataataccacacatctatactatctgatctttgacaaacctgacaaaaacaagaaatggggaaaggattccctattcaacaaatggtgctgggaaaactggctagccttatgtagaaagctgaaactggatcccttccttacaccttatacaaaaattaactcaagatggattaaagacttaaatgatagactaaaaccataaaaaccctagaagaaaacctaggcaataccgttcaggacataggcataggcaaggacttcatgtctaaaacaccaaaagcgatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaacaaataaccccatcaaaaagtgggcgaaggatatgaacagacacttctcaaaagaagacatttatgcagccaacagacatatgaaaaaatgctcatcatcactggccatcagagaaatgcaaatcaaaaccacaatgagataccaccacacaccagttagaatggcaatcattaaaaagtcaggaaacgacaggtgctggagaggatgtggagaaataggaacacttttacaccgttggtgggactgtaaactagttcaaccattgtggaagacagtatggcgattcctcagggatctagaactagaaataacatttgacccagccatcccattactgagtatatacccaaaggattataaatcatgctgctataaagacacatgcacacgtatgtttattgtggcactattcacaatagcaaagacttggaaccaacccaaatgtccaacaatgatagactggattaagaaaatgtggcacacatacaccatggaatactatgcagccataaaaaaggatgagttcatgtcctttgtagggacatagatgaagctagaaactgtcattctcagcaaactatcacaaggacaaaaaatcaaacaccgcatgttctcactcataggtgggaattgaacaatgagaacacttggacacaggaaggggaacatcacacaccagggcctgttgtggggttgggggagtggggagggatagcattaggagatatacctaatgtaaaggacgagttaatgggtgcagcacaccaacatggcatatgtatacatatgtaacaaagctgcacgttgtgcacctgtaccctagaacttaaagtataataaaatatatatatatatttaaaaaaaaaaaaagaaagtgtgtctggatggagactgagtagaaggactgagtaaggagacgggacagatgtggtaggaggcctattcggcaaaagagaggtcactgaatcacaaccacttcttgttgtctctaaagaagacaggttgggggttaatgctgctgcgtggattctatccacggtcagttcgagaaaggaaaagaatatgggtgagaaaaacaagggtgaaaagcagattaacaagtggctgctactggataagaactcacaaaaaaatatccagacagagggcacctggggagaatcagattaaacctcgaattagagcgaggttgtttgacaaacaacactgtgacccaggaaatatgggaaaccgctgagcagatttatgagtgagtttctaattgatgtggcttttaaatgtgcagatatatttttgtttttatataagggtaaacaaaaggcagcacaagcagtgggaggggcctgactgatccatctgaagcgagaagccctggatttaggtctctcaaaatgtacaggctctgtgacttgggcaagtgactcagcttctctgaaccttagtttctttttaaacagtgggtaaaggtgatgcttttgcagggatgtggtgaggatcaactcttctttacactagtgaattcgcatttgtttttcaaatgattacattcagggttggattaggttgttggccagctttctcagaggcttctaggcagatgtgtcttcatgtctccttgggaaggcttcagtcgtgtggctatccctgactgcaagggagtctgggaaaaagatccccagttttgcttttcctttggtttggcttctataaagggaagaatttaaggcagaagagaattaggaaaagctttagattagtcaacataggctataatacccaatacagggtagcaacagcacatgtgtatctgcacagaagaaagggattatgagactaataaagcaaagtcgtaggctggggaaggtgaatctaattaaatagtaaattaaaagtagtagaggccaggcgcagcagctctcgcctgtaatcccaacaatttgggaggcctagatgggaggattgcttgaagccaggagttcaagaccagcctgggcaacacagcgagatcctgtctctacaaaaaaaatttttttttaaattagctgggtgtggtggtgtgtgcctgtaatcccagctacactggagactgaagtgggaggattgcctaagtccagaagcttgtggctgcaatgagctatgattgcaccactgtactccagcctgggcagcagagtgagatcctgcctctaaaaaaaaaatttttttttaaataatagagatagtggcatgaagagcccagtaagaaattactgaagcagtgccaccactagtttctaggaaaaataacacataggcatgtttcctgcaaaactgagtagagattgagttactttttcagggtctccctttttcatcatctgacattaccatttgctttttatgtcttctctttaacctccactcccctccccaactcctaatagtttttagttcctctaaatcagtactccctaatgctactttatagtgaactcgattttccaaggtttttttcctctttctttcccccaataactcaactgtcttatatttaattttctgacattctaattctctctttttttttttttttttgagacagagtctcactctgttgcccaggctgcagtgccatggcacaatcagggctcactgcagccttgacctcccaggctcaagcaatcctccagccttggcctcccaggtagccaggactacaggcacacactaatatgcctggctaatttatttttttatttttattttttttttagtaaagatggcgttttactatgttgcccaggctggtcttaaactcctggactcaagtgatctgcctacctaggcctcccaaagtgctgggattacaggcatgaactactgtgctcggcctcatattataattcttgattcctccttctgtaattaaaaaaaaaaaaaaggctgggcatggtggctcacgcctgtaatcccaacactttgggaggccgaggtgggtaaatcacccgaggtcaggagtttgagaacagcctggccaatgtggtggaaccctgtctctactaaaaatacaaaattagccgggcatgatggcaggtgcctgtaatcctagctacttgggaggctgaggcaggagaatcgtttgagcctgggaggcggaggttgtagtgagctgagattgcgtcactgcactcccgcctgggcaacaagggcgagactccaactaaaaaaaaaaaaaaaaaaaagagagaagaaggagaaggagaaggagaagaaagaaattcacgttaagacgtaggtaggttagcactctcttgtaatacttgcatttaagtagggagcattgtacgacagaaccagtggaagagggactttcagatcccttgaaatttgtcagatattacatacctacgttgtttgagctaaatgctaacactattaacaaaacccaggagtggaggtgcaggaagggaatgcagaatggattcgcctttcatcagtgtgtggtgtgataggacagggcggtagtgtactagaattgggtggagagggacaaatctgtcaaaacatgagaagaaaaactgatgtgctaagaagagatgacattacgtttaaaataaggcttcatgaaaagctatacagttgggtaacacccaatcaaaatagtgccgctaatggactaatgatgagcatggagatataactgtgaattatacatggtaactgagggaggggagtgggtgtagagagaacagaactggggaaggatatataaagggaaagtgaaaagttggccccacatacaccaggccaaagttacagaaaatgcctttgctttgcttattcttcagtaaaatacattatttttttctcctgggtgttcaactgtaagtgtgcactattagaaaaccatcaataaaaaaattgataaacgagggaataattacttaaaatataaaataattaccagctttacaaaagaattctcttcaaggcttaagtgccatttaaaataatgttcaacatgccaaagaaattttttttttgcatatagtacaaacttcaaagaattctgtttcataaagtaaggatggctcatataatagagagataaaagttgcagtggatttggttcagcattaaaaaaacaaaaaacatacactgctaatagataaaggagacagagaaacacaacccaccttcggctgtattaaggggtcattttatatgttgtgccagtaagctcctgtttcaccaagaagaattcattaagtgagagcaagtcaatgaaaatgagctttattaaaaaagaactgatgtaattaaaggtattggtgaaaactagctcagttatgaaggggaaatgactcagcagcaaatttaagaaatgaaaccatatacattagaatcttttcccagttttaagttatttcagaaaaaaatataacactccacacaatagccaaggtgcacgccagcatgaaggaggaagaagtgcttatataaaactgtcattcttcacatactagtgaattatagcattcatatgctggcaggccgagcagtcaatgaggagagtaagaaagcctgagactcaggctgacccggcttcagatgggcagtggtgactttcatcagtgctgttctacatggtacagtctaaatgagaatacgtgacctctgaaatactcaagagctgtatactggggaaaatacgcctaagactcttggagcatcccagatccaataatatttctgtcaaaaaaatgtataggtaagtcgaatgatagaatatccacagcagaatggctgtgcaatacggttttgaaaaagaatcatcctatccaagtttatgtggtcttagtcacatggcctgaatatgggacaaaaatccacacgcctcaagtccaagcaatgtgcacactgggcgtttttgcagacctcagatatatggatatgcgatgaagccagagggctgtgtgaggactggcaccttcttccccgggaagccctcagcttagtgttgtcttgtgatctgaacattggcctggaaggagagagaaacggccagaggcttggatttgccagtgatgccacatgacaagccactgcctagtctaacacctcctaatacagcaccatcacaaggattaagtgctcactagctaaaaaataaaattaaaaggtggatctgaaggtgctttgagtattagaacacttagacccacctcaccctcatgccaaggatggcaggcagaaagcgggaggagtgaagaggaacattgtgagaaaaaaggagatggaagaaggttggaaatttccagctacaaaataataaataacccatagtagactaagttccaagtgggtggcgctttgcaaatgagaatgtcatgttttcatacactctgtgatccacataacctttttgcccacctcagagagttgctaagaccaaccaatgaaatattgtctgcaagagtggtttttgaactacaaatcccttaataatttgctgtggtatgtggtctaaatggttaaaaaacaaaacaaaacaaaacaaaaaaacaaaaaaacccacaaaacctgggaagcttgaagaggaatacctgaaaatggttaggcctttagcaagtccctggagtctgcaggcattttcttcttgaaatgtctgccagcatgcgttggaactgaatattctggggtaataaaagggatatttcaccttataaaatgcaaataaaagttgagtgatcaagtttgggggatgggttacttcatgatctaattactgttgacttattgtgatatgtaaggaaagagcgctagaaaaagtctcagtgcatctgaaactttatcttacctaaagaataaaaagaccttcaacactttctactcacaatccgctgctctattaacaaacaaaagcaaaaccaaagcccaccactttctatctctgagcattgttatggttgggtgtctcatggctttgttccatcactcctcaggtagaggaggtgtattctgttcatcttaatgggtgtgtcttttaggggaggaagaaaaaaaaaagtaggctggtttgaatttaagttaatccctgccttctgatatttatacagcttatttttatttaatgttccaacagacaagtagcctatatgccaaagtagcagaaaaggcaacatttaaaaaatgggccagtctcctcaatagaattgggtacacacgttcaccaaaagataaaaataacagtgtacgtcacaatattattcaacatagctaaaatctagaaaggttacataaattatgagacagccacataactgaatattatacaggcatgagaagaataacctgtgactataaacagatacaatattgagtgaaagaaacagaaaacagattcaagattgagtcaccaaagagtatttacagtaagatttcacttacgcaaagtacaaaaacaaacacaactaaattatgttgttgggagacagaacagtggtgacctttggggagagggtgtgactggaaggggatcatggggtgggggcttctgggaggctagcgtgtctcctgagcaggatactgattacacaggtgtgttcagtttatgaaaatacattaaatgtacactgatgtacacttttctgcagtatattgtatttcagtgagaagtttttcaaaaaaaatggagcagccttctaagttggcaggattcagttagacttgctttgacgtgtgctctgaggccatctgttctcaaaccccctgttcccacagatcaggatgcagctgaggcacagaagcttgatttgcttcgaggctttgcagctgagacccggaacatatgaatgagtattttactcttactgtaaatcattgagtcagtaaatagatctataaattcagtggatgctattttagtaatatggattttgttccatttttgagatgtcttaaaaaccttagagatttcacatctcctgtacgaaagaaatcatctataaaaacggtctattgaatttatttaagtcaacaaaggattttcttactgatatgtgatcagggtctcatttaatactaatttagaaggtccctttggaaacaatcatgctatgattttaactccctcattttgtgggtcaggaatctgatacccaaagaggttaaatgatatgcgtatggccatgcaaatattccaaagcagaatatggactagaattcaggttccctaactgctaaaccaatttacttttcattctagctttctggcttccacattattgttgattcacagaattatgaacaactaaaaacagatgatataaaattgacaatgtaatgacactaaatgtttacttcattgtgacagtcatattttctaaagagcagggccaataaattacgtggccctgagtaattactggtttttagaaattagctaacaccagtttagaaattaatatgttaacagtacttgaaaaaaatggaatactcttatattggaaatgattgttaccaatgggagcgatatgggcacctttattttcttattcaagaacataccttgtcagaggagcacgaatgacctcagagcacccagaacagaatttatcaggcccttctacacacctctgaggacatttagctgagatgaatctggtgttattatggaagttcttgccttaagaacatttggattatttttatcttatgatgctctttcaaggactatttacttgctgtgggtcatttctatttgtaaatggtaatagtcacctgaaattgaaactgtatttacccatgtccattctgtttccaagaatctagattgctctaactcacttgctatagaacaaaagaagttcattatttttcaactgccttactttctgtattatgggtaatgtactatgactttgtattatgacccttatcagattaaaaatatatgtttccttgatcacagctgtataacatttatggtctgattcagtacacttctaagaataggaaatgcaagattaaactaggctttaaaaacaaccattgatgaaaatgaattaacaacgtaaatatcgaggcagacgttagtatcttaccgcattctcatcctaaggccctcagatcactggggggtgtagattgtactttcctctcaaatctgaggaaatggttacatctttcatggcatttatacccacagatgacttgctggccaaaggcccagtggacacatggagacaaacgctcgtgagagcagccagactaagaagtggcttctaggtaccatagaaatgtcagcatagtgagaatattgcatatataccatcccagttctaattaacaactgcaggggcataatgtgaagttaattcattcaacaagtattactgagcacctactctggcaactggagctcaaatgagataatccacgtgaacagcaggataacacttcctgtgacactgaagaactggaagaattaaccgggtaggtgggggtggagtggaagagagtagtgccacctggggacactaagaggttcaggagagtggagccatcagacgggaggggaagagttggggctacagagatgagcaggtggcagagcatggacagacccatcattcttgttacagaggttggttttgatcctttggacagcaagaattctaaaaagcaatgctttacacaccgtaggatctcatctattagttagctctgaaataactttcatggggtccaaccagcactactttttcaacaaaagagatcaaaatagaataggatagaaaaggacagaaaacataaaacttgttcacatatatatattgatatgagtattgggtcatgatgttaaattcattttttattgtgagtcacagtccagaaagtttgaaggtcacttctttgaaagcatttaagcagaggaatgatatgaacagccttgtgcttcagaaaatcaatttggctgctgtgcagaaaggactggcggcaggcctgagtacaggaagaacagttgccatagtcaggctaaagaggacaatgctaactgagggcagggccagtagacggacagaagttctacagagggataccaggagggatacactgaggaggacaagatttagctgaggaaggtgtccaaaatgcaacctggactgtctaggtttctgcattaggcaattgggtgggtcttgctgcccttctttgtggcaagtaaggaatgccagagcaaaagcagttttagggacagaagaagattattaggttgagacatgttgagataaaaagttgaaaacatggagaataagtacaattttgataactttatagaaacaaattcattatactgctctacaaaccaatcatgatcaagtgtctattgtctgacacactgaagtgtgatactaatgttagaaatatatatatgtatatatatatatttttttttgtagtaagaaaatgcagtaagtacagaagggatttgcaagtgctcacaatttggggacaagtttttataaagatcttttaaagcaaatgcaagaacacttacagataagggctataaagattaaagataaagtatatgagcatgtacaggggtgtccaatcttttggcttccctgggccacattggaagaattaagaattatcttgggccacacataaaatacactaacactaacgataactgatgagctaaaaaaaaaaaaaaaaaaaaaatcgaaaaaaaaatatctcaaaatgttttaagaaagttgatgagtttgttttgggctgcattcaaacctgtcctgggctgcatgtggcccatgggcagcaggttggacaagtctgatctagcacaatacctgacgcagagtagatgctctaaaaatagttttttttttcccctccacttttttataccttgtcattaagtctcaagatgcagcaatgcaaactatttacataagtatatttcaagtcacttgatagctagagttagcaaatgatgctctgattcacaaaacggtttatgttctttgttttacaagggctgccaagaagttaatgggcaaattcatgatgcatctctagtaaatgtacagaaactcaatatatgcattttgcatatttcacctatcctatttttaagcctttttctcaattccttcaccccccaaaaatcattaagaattgtaaaaaatcactttaaatatttttctgaaataagccaaagcctatagacaggtgggtagatggataaatagattagatagacagatagatggttgaaactgacggatggctatattttaaattattaatcaaatatctacgactttgggtagctgaatcagttgcctgaaccttggtttcttttattaaaaatgtattacatatcataatgtagagagaaaagtataatgaacctccatgaacccatgccccagagtcaacaattatcaattcatggccaattctgtttcatctataccttcacccactcccccaacccctggattaatttaaagcaaattctaaccactacatcatttcattggcaaaatgtgttagtattaatctccaaagaacaaggactcataactacatcactgtcgtacctttaaaaagttagtaattccttaataccatcaaacatcagtgttcaaatttcccctactgtttcttcattttttaaataatttgtctgaattttagatactgattatttctgggtcaacttataaaacgatttctcagaaagttaaactgaggaccagaatagagctttcccaaggaaccttcccttcacggcatgagactgggattcctctagctgttcattcaaatcccctctctcttcctgctttctccctattctgcacacacacacacacacacacacacactctcatacaatgggggaaagctttaaaacttgtgctacatgttaggctgtatgaaaatgaatgtttaacattaaaataaaaatgataatacagtagaaaaaaataaacaagcacttaagaaaactagtcttaagaattatcaaatttttaattaatgacaactatcaaaactttgagcaggatatcttccaacaaagatacacttaaatatacgtgtgtgtgtgtgtgtgtgtgtgtgtgtagacctaaaaagaacactttactgtgcattttgaaataaaacatcctactccaaagtttctgaagttttatatccattatatctctcaaagtatcttcaggaacgtagacatattaaaatgaatcgcttcaggaaaaacaaaaaaaagcatcccacactgtcagatgcatctttccttctactgctcccgtcttcctactggtttccctgtctccagtctttccctccttggtgtcatctagatgacaccatctagatgacatagatgctagcaaagtttgttttctaaaacacagaaccaaaatctcatgtcttacttaaaagtcttccattgttcaccactgtctacagaatagagttcaaatttctaacagtggcagtcaaagactaatataatctacccccacccaattctccagtcttctatcccactgccctttccaccccaatatcctcaatgccctggctatgttggaatagtcccattccctgaacatgtcttccttatgcctctgtggttctgttcatgttgttctctctgagatacaatattccctatgtatccaatgtataataaatgtgagcttgcaatgaagagataaaggaataagacatgagcttttctctcaagaagctcacaacctcattacagacagagataagtaactttcaagagaggtgtgataagtacagacatattaagatgttctaggtttggtgacaacacgaagagggattttgctgtggacatgagactattagcatttggaaacacaatgtgcagaaaacacatggagaaaggagggtccaatggatgacttaaaatcccccaaaagtggacatgtcaaattaatatatagccacgggatggttatatccaagagataactgaaaatcatttgcagctgatcacaggtaatgcctgtgagagactgtaattgcaaactcaaatgtaatcagtttgcttcttttaagaagcctttgctatcaaataaacacgaaatatgtaggaaccaaactggaagtgcaggatggtaaagggaggctgagcaatctgacttacgcatgaagaaaatgaagcagttacttccaacaaagaatgaagcatactaaagtacacactcagagaaggaagaaattcaatgtgatactaacaaatcaagctggcttaaacttaagtgtgccatacttgctgccacattcactctgacatcgtttaaatcatgtaaatattttaaaattcttgtcataaaaagtataacacatataaaagaatacatatatgctgttttatttcaaactcacacatactacacacaagtattcatgtacccacctgccaggttaagaaatagaacattatcagtaccttggaagcccttagaatcctcctgtccaattgcctttcactctctccctctgagtgggaaccactgtcttgctttttgtattaatcattcctttacttttctttataacttcaccacacacatttttaccacctagaaaacacttggggttttagttttggaaccctgcacagccagcgcaaagccagagtctaaggaaagcacaacattgccattatagatggagggctgggagaaaagaaacagcaggggcctgcctcatctgcctcaggttctctgaaaagtcaaattgcacttgggaattctgatacatgccaaagtttgagagccactggctagggtcccttctagcttctgattctagaataagtatttggatcaaaataagccaaaaaaacaaaaaaacaaaaaaaaaaaacactttttttgagtgaaccaaactaaagcattctctagcgagaacgggctttctgcaaccccacatttatataatgttgctccaaccaaaggctaaattgttgtatgttagttatatactaataacaactatgcaaagaactaaaatgttttaaataggattgtatttcaaaaatatggggaaatattcattgctttgaatttttagctgtgattcttaaaggtaggaaatactgcttgttgaaacattataatgaattttcactacatgtaaccagtgagttttggggatgaatcacagttgagtatgactcaaaaattccctcctcttaaaacaactctatagggcagcgcttttgttttcctttaggtctagtacagtaggtgggccattttctgagtccagtttccctactgtgaagttagtctgtgtgtatatagtcttttgagtgctatcccacagaggtggggttctttttccttttatttgaatttacttttatacctggagagattcttttggctgcggctggtttatactgtttgagcgcctccgaggtgtggggccacacttggtgcttcacacctattatctcatctaatccccaccataaccctgctggataggtgttgcatgcctcattagagacaggtagagcactggcctgtgatcgcattgccaggagtctcttggtgagctggcagataaactccctgactccaactcctggagaattcccaccggggccaccatagctactggctacaacttcaaaaaaaataaagaataaagaaaacagaaagatttatgatcttaaaaaaaaactgtcttttttttagttgaaaaatttaatagacatttgcacatatgaacaaattggtttattttcaggtatctctaggtatgaaaggaatccaaaggaaggagaagaaatccttcgccttggcactttgcaaactgactacttgcaaacacacactctcatacgagcagtctatgccaaagaagctcttttaggagacagtaacagaagtgatctcagtattctgccctgcatttaacatagaccacttatttgtgttaaaatgtatttaagttttatttttaacagaagtcttttatttgggttacaagctatatatactattaagaaatttattttcatggtcagagaaattaagaattactaattgtgacagatattttaacatgtagcaataactgggggttatatttatagtttgttaattgattgaaaacactcaaaaataacacttcacaacttcatttgcaggatcatgttgagaaattaggaccagctactgtgtacttacaccaaggttcaggtgttaaagtacagatgctatttaaccaactgagatgacttaattggtggttttctctataaagaatggtaaacagagctcccatatctcttataatttccttgtatcagaaccaaaaataatatttaatatttgctttgcaccttacacaataaatttttaaaaagccccatacacatcagtggtcagcaaagaatgtgcaagcctatcacagactctggagggtggagttgctggactttttcctctggtctctagtagcataaaaatggagttacagaaaaagtgctttcaacatgctgataaaagattaaaaagaatcacttggcctgaaggaattttaacaacataacattaaggagaaaagaagctgtaaaataaaaccaaaaagcatgtccacaagaacttaaagaaatcaggggggaaaaaacctcacaaattgtctaggcagtcgtgagcaatcattgacttggtttgttataattttaaattaacttcccttaaaatatgtgatttatatgtgaccatttatatagctcttatctatgatttcaaaggtgatcagttcaaagcttaatgaattttcttgatattgaatttttcaacctttgaaatcttatatttcagtaatgtactattaccttaacatttaagcaaagctgcatgatctagagagaattcaatctcttctgatgattaaatttcagtaattgaacataaaaacatttggaacaagaaggactgtataaatgaactgtcagcatatattacaacattacaatgttgcttaggtaagaaaatgctccttgaagaagttggcacaacgagaagccaataggaaaaacagaggaagtaagctatcactgaaataatgagcaggaattccattaaggctccaggccaggtatgtgaaggaggtgtgattgatacgcaggacttggagattaactgtgtgggacttgctgaggccatgcctacatgcatctaacatagtgctatatttggtatcagactttgactgaagtggtgtttacagagtcactgctcttgctagttcttttcttttaaatgctaaggattttgtttcagccacagcgtcaggaagggagcattttcacgaggcaaagaaaaatatagtcatatccggagttagtctcacattaagatgcaattagtgttcacttttagtgtcaacaactatttaaaaagctacatttcatacaaacacagggatgacaatgaccatgaggtcatcaagtccctgtgttcctatcagtaggtccccttggatattgctaataaatgataagatttcagaagccaacataatgatatgatataaaaacaatgtcaaaaatttgatatttatgagtatggcagtatggaagaagacagtgttctgaggctgcttctagaattgctacagaggattggaatctagttcaagttaacgtaacatccttgaaaggttaaaagacaaaggttacttctgaatatattatttctatcgcaagtgactacataatggaatagaggtcagcttggtggatctggaaattcttagtctttaaaacattctttctggaatagaaatgaagccctggaaatcttgcagagtagaactcggctaatgaatggctttctatgatacgatttactatatagtgagggttaaataatgttctatcagattcacctattacttacaataaaaggatatttaaaaagtataacaaaaatatcttagtttgtaaggtggatatcagccttgcttaccaatacccaagttacataaaagggtcccattttcctgtttatggctcctgcttttccctagaagaaatgaccagcctgtgattcccagttctgccactagctcactgtaaaaccctgataaatcaatcactcggcactccatggcaatcacaaactcagatgtgagcacactagaggttagttcaaattacgtacaaaggtttctctaataaaataaggattgacaactggggccatgacagaagagaagtcactttaaggtatttaccttttccataccttattaattagttgacaattttacatcataattacacttgatccttcttccaagaccaaattcaggtagatacattctaatttcacaggcaaaaaacccagaacagcccctgttgtttggattctatgatgcattcctcaaccccagcaactggtattacaggtactgtttaaaatgttgctttgttaccctgagaactacatccttactctttttttttttttttttttttttttttttgagacagaatctcgctctatcacccaggctggagtgatagtggcacactatagtggaatgtgcagtggcacaatcatagctcactgcagccttgaactcctgggatcaagcaatcctcccacctcagcttccagagtagctaaattatttgttctaaaattattattcatataacacatgagcattgattctttccaagacaggcacaattctgtgaatgtaaaagttggtgctctgcccccgggaagtttacaatccaattaccaagtggcctcgtgagaaaagtgccaagtgcaagtaggaccacggaagggagagatccgaacctgctagagaattaaaatacatgcttctggataaaggtggctactgcaatgggatttcaagaaccaatataatggcaagctcggtagctcagacccgtaatctcagcactttgggaggtccaggcatgtggattgcttgaggccagcctgagcaacagagcaagaccctcacctacaaaaaataaaaatattagccgggcatgagcacaagcctatagtcccagctactcaggaggctgaggcaggaggactacttgagagcaggagtttgaggctatagtgagctgtaatagtgccacagcactccagcctggacaacacaatgggaccctatctcaaacaaacaaacaaacaaacaaaaccatgataggcaaaagtagggaaaaagctgtccaaaacaaggaaaggcagagtgaaataaatagtcaggaaagcccaaggaaaattaggtaatttggccaaagccaaggactgtgtgggggtccagtagaggaagaggctgacaggaagttcagggtatactcttcagggtcttggcttcttctcttaaggagtctagacagagggaacaacatagaggccagacctctttctataagtaactaacctgttaactttgccaattaggtacataatagaatatccttcctcttattgattgtgtgaactccgtgaacacaagagtcatgttttctcactactgaatcccaggggctgccattagtaaacactccactttttttgttgaataaataagtaaatgaacaagtaactaaattgattcattaaaggtacatataaacactttaattttgctattagtattctcttagtaaaaataagttcctgtgtaatttatttcaaataaatgaacacttgaataatccagcagtttcttccctccacattactttctttccaggttactcaaaatgtcatataactagagaaatattaacaaattttatatgcaagaagatgatgtcacaaacatacttcagactggttttgcatattatcaactagctattagtataaaaagtagaacagctactctatcaaacatgaccgctaattttagaaaatcctttctctttttcctgaaaaatatccattatatatatatatatacacatttataagtaaatatatatatatatattttttttttttttgagacagggtcttgctctgttacccagactggagtgtagtggcatattatggctcactgcagcctttacctcctgggctcaagtggtcctctcacctcagcctaccaagtagctgggactacaggcgtgtgccaccacacctggatgatttttttattttttgtagagacagagtcttgctatattgcccaggctggtcttgaactcctgggctcaagtgatccacctacctcagcctctcaaggcgctggcattacaggcacaagccactgtgccccacctcatatctgtttttaacagggttatttcaagctggaaatataagcaaatctttttataatggcaacagaaaactatatgtaatatttcaaaacttccctttctcactggccattgaactcttgagacgtctggaagtggtaaaggcaataagctcttgtgacattatccaagcacgaaagcattttcatgaaatcatggcctaagaacactcttgtctatcaggctgccagtgctatctgtgggtcagttaggaaaatgatgcaaagaacttcttttgaaaggattctccagaattacctctaggaaggactctggtgctcagtgcctataattaactctggtgggtggtaggagtggaggttggcaaatgtgtgtcttgactggcatgtgagtgagggaatttggtctttctctcccactaatagccattggaaattaataagaaagtgaagaggtgacttgtgaattttatgtaataatagaggaggctcccaaacattgcaatgattatgaatgaagaatttacttctttctcctttttcacataaacacacagaagtgcccttccatttgataaagagggtgataggagatcttctggtttgtttgtttaatgtccaagtcttgcctgatcctgctgcactctgcaatttgaaaaggaacacttttcttataaatagcccacataaggcatcttgggacatcttaagagctttacatatatctgtacaaggcaatattgtggcattattatcaatgttgaacaatggttcaaataatcccaggacaaattagcttaatacagattaaccactcctaccacaaaagaaaaccaaaatttgggatccaagaaaggagaggttaagttccaaaaaccaaaaataaatttttattaggtacaaactataataaaaaaattagtatatcacaacctatgttagctgattgagataaaatatttggaagaatccgtgattctgaaatacaaattttcttacatatattctttgggaaaaaaatctgtttaccatgaacaaaaaaacattttgtgtggctcaaatatttaagctaggccaattagtttgtttagtggcatacagtttgcactcaataaatgttagggaatatatgtgtgaatgaataaaaaatgtaccataaatactttttgtctcttgaaaatacaaagggctaatataattgtactcttttacagagtaggaattttttaattaccttaacttgtaaacataatttcaaattccaaataaaatgataagactaaaatcagaaaacaatatattatgttctgaatttttacagcgcttttgacactatgtttatattccagttgtgaatgttcaaatataaaaatgggttcaagttttctatttagaagaccaaattcaccataaaatagctttggatcagacagatcccagcatttatgtcttgctggttcaaggaaataaagctgtagtaaaggaaataaagctgtaataaatcgctccaaagcaaaggcaaaatgaccacccaattaagctataactttaaaaatcaccttgaggttaccctgggaagaaatatgaggaaaagggcaattaaagatcagtcttttaaatctgaggtctcctcattgacaatgaaagattcagttacttaaactgtttttcactgtttcatttatgagttgcttttaacaatatttcatccctcaacagaggaaataagaaatccttaaaaaaaaaaaaagctataccagactatcaaaatcgttgctaaggaaaataaactaatcaagattgatctcctgggtcctcagaagttcaccaattccaaatgttctcataagtttcaaaagagaataaaacaattaagcttccttataatacaatgcttaataactcattgtgggtcagaggaattaatgacagtggcattttataaaatacatttaactctaattaaaagtactcatttatttcttttctgaataacctaactgtctctttcccacatactaaaaagtctgggtcaatttttttttctatcaattcttaagggattttctagaatagttttaaagaaaagatgggatgtactgctgttagcagtactttcagcagaaggaatttttttttcaaatttattaatttttaaaaacgaacaacaatgtaactaaagaaaaatgtctacaaagcaaacaaaatggtgacttcctttatatgcaagcacaatgatccattatttccttttcaagaggccttcaatattagttactgagagagcaaatgacaatgaaaaaaatattaattgcattactgaaaagagactataaggcaataagcttattttccctcatttaaaaatgctcttcctgcttcttttaaattccattaaaaaaacatagtttgctacaaatgacacacaaatgggatgaataaatagttaagtacaactgatggaggtcttaatctaatgtaccgttgtctgtcagctaatctctcctggtttaacaatctgagtttaactacttcatgatgaatgagacagggtgcaaatgacctgagtgtttcagcccataaaacaggcttagggaaataaaacctgcaaatttgatcaccagacttagattgaccaccattggcaatgcagttagggttttaaagcaattgtctacatgtaatattaagtaatgaagttccaatcatttatacttaaagtaccatttgctctaaagcagcttactattatatgcaagatttgccgttacataactgaaattcagatagctctgaattcaaaggtggtgagctaattgtcagaggacctcagtgaggctgagagttttatagactcagttctgcagaaagtttcttaggagcattaacatgtactcacattaagcaagaaagactccagttgttaacagcagtaggtctattgttcaggaagtaatacttttcatgagattcattatgaaagagaggggggaaatcctttttggcattctgcatataaaatcttctcagaaagacatctgcagtttaaaaaaattccacctacttttactactacaacctttgttaatttgctacagttctctgctccagtaacttaaaagtcatttccttaagaaaacagatgacagacaacttgagtgactgattatattgtgccatcactttgtttttctcagaggccttggtttaagaggatggatgttcgtgtaaatgacagcaaggggagcttcgcataagatttcacttctgttcaaagacaagctaatgtaacctcactgcggtgccatcaacttgacaaatggacaccgcgcaaccctctgcctcccactgaaacccgagagcctgatttacacaatattctccctgtagatggaaaaagacttcatgctgctaggctgtataatgggttgatctgataattctttgcatgtaatgaaatttgataatatgaaggtgagatgcatctcaaagaatgaggcaagctaatgaacttgtaaaactacacttaagtcttttaaaacctgaataaacattaaaagggacttagctcaatccatgttgagaaaacgtagcagttctcatgttttaactctgcaatcaaagatacacggcctttacttaaaaggaataaaagattccagctccaaggagtatagctctattcaaacaattcaatatgatctgtagaaattgctgtgccttatctttaccatcagattttgctggtcctcagttccttacctcaagaattctacattactttatcctgttaaattattttcctgggagctcaatattcttccttctaaagtaggaaatttcttaaagaattgataaataatgccatgcaaaattaacaaatagttcatctggagatttaaacgtaccttaaactggcacaaaaatcacaaaaattagagcttcataagaaacatccacttctgttttaaagtcgtaagttcttacatattcaaagtatgaatgtttaaataaagtattctgaaaagaaattcatggtatagtttattttataggcaaggctgatctcaaatcctcggcagtaaaactgtctattagtattaatgcctggaaataaacaccatgaatgtaaactacaatcagaagcagttttaacacatgtaaatgttgaatgaggtagaattttaggcttatatttactttgctgttgtcacaaataaaaaaagcacttatgaaaacatttcatgctgaagtgaatggatctcaacagctgctgatttggtgacatggagaaccccagaggagacatcctgctgaattaacgttttggaaatgttaaaaagaaacttcaaacagaccttgtttagcaggcggtcaaagattttgctctgtggggatcatgtgaaggctagcagagcagtcactcagccatgaatcagacttgtcaatagttgcctattttctcaacaggtgacttaaataggcacacagtctatttcccctaacatttctgtgtgtacttgtgcacaaaaaaatcatcctagactttgctctgggatttatttaggaaggcacagcatgcagggatggggaaatagttgtttaaggggtttagacatattttttaaatgtgtacttttgctttttttaactaaaaaaattagctaagttacatttaaaatcttattttcaaacaaacttttatcctaagttagaaacctggaacagattcaatcaaataattataggacagtaaagaaccttgaagatagcaaagatcaaacccattatttcacagatgaggaaactaaggcctacagagctttaagtgatttgccaaatatttacttgttcatgtgttcggactagaacttccattttctgactccttggttcaaaattagtacactaaacttatccttaagaaataaatgagaagtagtcttctttgagcaatgtaaaaatacgcaagagaagaaaccattaaactgagtaagatctcatggttcagtgtttttctgatttggcgtgttttgattattttcctttatgctggccacagagaaagagagagagttaatggaaaattccttccccacaccaccaagaagtagaggtgggggctggggtgagaaaaggcccagtaccaagatgtgttttctactttcaacatttaggagtttagtgtaaatgtagagtacaaaaacaataaagcatttctttgttactgactcagattggcattgtaaactatgccatacaagctactattatgtcagaaaattaccaggtatccattaaatgagctcagactgttttctattgttaagaattttttagttgttttggaaagcctaagtacagagttcagtgaaagttctcagaggtgactccacaatcacagcagtactcattaccttagtcaacctctcctactgcttccatcaatgcacggtcattaccagccaatgctaaaatggaatccgaggcttagtaaatcacctccaattgacaagatgcttcctagataagtactctcttgaaaatactttctacatgattcagagttaaaaattaggaagaaaagcaaatgccaatgccatcaacatacacacacacatatacacaaacctcttaggacccaattcctaagaattcactgattcttgttattaaaattcatcttttggaagtttaattcttcatatggtatgaggaaacaggtactctaatgcaaaggttgatgggagtgtaaaagacagattggatttatacatcaaaatgaaaaatgcactcatcctttgacccaacattcctacctatagaatgctgaggagataattcaacaagtgaggaaagatatatgtgcaaagattatcatggcagtattttttatggtagtacaaagctggaaattaagttggtggttaaataaaggtatatacatacactggcatacatgcagctgttaaaaatcactattcacttaatataaagctacagtagtaatagcaaatggatcaatggaacagaacagagaacccagaaacagacctacacttacttggtcatttgattttcaaaaaaatgccaaggaaatccatttatgtcagaataactgaatatccatgtggaaaaaataaacttcaacttcttcctaacatcacacacaaaatttaacttgaggtctaccttagacctgaatgtaaaagctgaaactataaagcttttagatgaaatcaaaagagaaaatcttcacaaattgagaatagaaaaaagtttcttaaagataaataatcataaaataaaaaactgataaattgaactgcatcaaaatttaaaaattctcctcatgaaaacacattgataagaaaatgaataaggaagcctaagagactaagagaaaacagactaagagaaaacatttgcaaaacatatatgacaagggtttggataagatatataaagaaatataacttaataatgaaaagacaaacaacctaatttaaaatggatttaaatttgaatagactcttcacaaagaaatataaataaccaataaacacaggaaaaagtactcaatgttattagtcattagggagtaacaatttaaaaccctaatgagataccattacacacccaccagtatggctaaaattaaaaggtcagtagcaaatgttggcaaggatatgtagcaactggaagtttcatacgacgttggtgggagtgtcaaatggtgtcttatacaaaacacacacctaccctatgacccagcaattccacctctagggattgatgcaagagaaaaaaacatgtccacaaaagccttacacaagaatgctcacagcagctgtattcatgatagttaaaaaatggaaacagttcaggtgtctatcaaaaggaaaatgaacaaacaaactgcatttatgcaatgaaatactatttagcaaagaaagaaacaaattatggatacacagaacagggctgaatgtcaaaagcgctttactgagtaaaaggaacattacatttcatttacataagggctggaacaatgattgcctttgagggtcgtgtgggctgagatttactgaaaagggacgtgaaggaacttattgtgatgataacgttttatatcttgacaggggtttgagttgtacaagcatatgatcagaacttgtcaagtggtacacttaagatttgtacactttgttgtttatctcaaaagaaaaaaggaactcacgtttatggacgcccatgctaaagtactcggggtggagggagtatacagatgtctgcctctttctttgaaatccaatacaaaaatgagatgggttaatagagacccacttaaatagagagatgaggtgaacaaatatagcaaaatattaattatacaatttaggtggtaggtatgtgggtattcactataaaattccgtctctcttattctcttggtgtgtgtgtgcatgcatgattgcaagtgacttacaaacagcatgtttaatttttcaaaataccatttttccaaactgacattttaacctctattaatagacacttgtttatttttgtactcaatgaagtttaacttctcctaaaacatagaataattaaataattttcaagttcatctatggcaaatgtcaaaggaagatatacaataaaactggttctgcttgatcagttgatttggatattgaagttttccacatttttagacaatatgaaagtacagtagttttgcaccaccttctattaaaaatctacaacatggctcagagcagagactcttttaaaaatgatcaacaacaataaattgtaagccacttgtattgtaattaggaatcccaaaacttttatgaaatattatcttaaattttaacggaagttttgttaacaaataacattataaattttgtagattactgatttacatgcatgtggaaggaaaagcaaaatccttccaattgtgctgagccattaaaatggagatgaaccataagatactgcaaagcccagaaggtcatgtgtaattaagcacatattctccggcttcttttatcatatattcatattaaaaacttaaactgtattccacttataaatcaatggattctgctgataaagatgggagtttttaattcttatttgttgggtatgatttttttccattttcaatggaaataataaatctctactttgtatcacattctgggatggttgggtgtaatgcaaaaatatcatgtaaggaaactgatatattcaaattagaagtgagttggtctctccaaaggtatttggtacttttttaagtacctgttaagtgctgttagagtatgcattttcctctcaggtatacaaacactgagcatcatatatcaaataaagtagaagtattctgccatttaattggaattgaggatttttaaatggttaataagaaatagtcaaaatgttaaaggcagtttatcttaagcatttacatttttcttctaacaagttattttttaaaacatatcagttactttactaaatgacttaattctttatttagtgctttatctgctaatatactatcatagaatcttccagtgttcaaataaaatgtcaataaaaacttatactttttattagtcaatatgcccacatttaactatatggtcccttacttaaatcataaactactctaaggaatgattcataaagccaaatatatatatatatatatatatatatgtatagttaacactatttattggatttacctaacaaaaatgtgactataaaacaatgattaaaatatctaaaagattatataaatgagtattgttttatgatattaatctacggaagcaacaattgattcatacagttgtagaattccattttggaactttctctcacaagactgtccacctcaagtttgtatgttctcttttgtctccccgcacacatatatgtacacacacaaagctgctctcttttataaacacattttgtttcagacacagtattacttagcagacacctccaaataacttgtagttatttctaaaaatcaaaatcagattatacagatgtctgcctctttctttgaaatccaattcaaaaatgagatgggttaatagagacccacttaaatagagagatgaggtgaacaaatatagcaaaatattaactatacaatttaggtggtaggtatgtgggtattcactataaaattctgtctctcttattctctcggtgtgtgtgtgtgcatcaaaaatacacaaatttgctatcaaaagaatgtttagaaaattccaagatgtttctgaaagtggaaacctaaatgtattactaaaatatgcatacacagcctcctccccagatgtgaagatgaccactttggaggaatcaatgcttacttagatgtatatgctctggaatgtgtatgtgtctgtgtgttgtaactgccacaactgaaggaagtgtgctagaatggaaagaactgtatcaggtatcacaaagcctgggtctgagtatcagctctgccatttataagttgtacatgtttagatcaatccctttacttctttgggcttcaatttcctcatctttgacataaaagtgttgatctagaccagcacagtccaacagaaatatagtgcaggctacatatgtaatttttgtagccacatctaaaaagtaaaaagaaacagatgaaattaattttaataatattctttatttaaccaacacagtatacccaatatattaccatttcaacatttaatcaataaaaacttattactgagatcatttacattcttttgttttttggtgctgcctttcaaatccagtgtgcattttatgcttggagcacacatcccaatttggatgagtcaaatttcaaatgctcaatagccacatgtggctaatggttaacgtattagacagcacagacctagacagttgctaatagtcctttcagttttataatttttattactttgttgttgaaaataatatattaataaaattagcatcaaattcagtgcaagtatataaaaatcatagatcaaatgcttccatggaacatctactttcatcaggaaaggttcattaattcttatctggcagtttaaaattctggatgatttttttctaacattgaacaatcattaagaagcaaagaactggcaattatcttctgaactcaacctcacagaaagtggattacttcatctattaaattggcttaagtctattaaataattgccaagtccccatttcacattctatgatgcagatttggctctaatctgaagctttagatctttatgtaatcataagaattgcaagactggttttaaaatgaataaacatccaaaattactgctatagcagtaaagcttatttaatttctgctttgtttcatgtagtctaaattatgaagattattaaagggctttattttagtgaaccacatttatataagcaaatcaatattcaataataaatattgcaattcttggcaaaggattgggaaaggccatgttcattaaaacaggtgatataaaagctgatactcaggttctaactgagaaaaatgtataaactattagctatgaagtatccctcggtaataaagactgaagtagaacctacttgcatcacaggacaacttttcgagttatcaattacacttgtaatagaacctctgcaagttatttatctccaggtaaaaatcatacataatttcaactagcttatcagtttttataccaaactttacagaaattatataaatgttctccctgatgttactataatcttttgacccttttcttccccctcaaatttataacagactagtaataacacactcgagtgtttctttatcagtataattaccataacagaattatttcttaaaaagaagtgaataaaacatctcacatgctttgtcaaaatacaaaaggtgtttctgcaaatctctaaattttgttttaacaaatacacagtgaaagctggtaatgatacaacttatgtacacgtggcaacataatatactgatctcttaatgtctagcacaggacacattgtgtttgtaaatttgccagtaagataaaaatcatgtccgttgaagttaactttctacatgatttatattatttaatgaacatttagcagagccagcctgccacataatactaccttatttctggggggaaaaaggtaaacattattgctatgctgtagtcacctataattcctccaggcaattatctattacatgtcagagaccagtgaaaaaagtaataaaggcaaaggcaaagaaactctaaacataatatggcccatgcccagcacactgcctggcatttaggagacattcagtgtttgttgaatgaatggccatagaacatatgtacacagtacagtctacatgtgtgtatacactgtagcctgcattgattccataggtaaataaatacactatacatttagtaggtatgcatgtttacttttttttttgctagaaaacttttatcctgattctgaagtccaaatctagctcttccttggggtgacataaaaactcaagtctctttcctgctttcatcattaagtacttcatttgttcatcaagtatttgtgtaactggcactatgataggcatggcgctgacataaaaagaaaatcataaagacaaacacatagactaataattatagtccttattttgtaaacaagggaattgctatttggggagattaagaaacttgcccaaggcaacccagcaagtgagtatatgaaccaagtgtcaaagctgtatccatatgtttttcaactaccccatgagacataaacattgagcagctaagggaatgtgacggttaattttatgtgttaacttggctgtgctgtggtgcccagttgcttggtccaacactagtctagatgttcctgtgaagacattttgcagatgtgatgaacatatataatcagctgattgaataaagcagattaccctccataatgtgggtggaccttatccaatcagttgaaggccttaagagcaaaaacaggattcccagagaagaaggaattctgccttaagactgtaacacagaaatcatccctgagttccatcctgctggcccaccttcaactcaaactgcaatattaactctgcctgtttccagcccacttacctgcactatagattttgcacttgccagccctcacaatcatgtgcaccaattatttaaaatcaatcagtctctcccccacctactctctcaatacatctatgtcctgttgttactctggagaaccctgactgacacagggtgtcatggctaaatatggaggttgagagggcatcaaaatgtggctagtagtgcaatacttgaaagtggataggacccaaatggacccaagataccaaggataaagccttgagcacaacagcatttaaggggccagcagaagtcaaagagccaaaaggaagagataagtcagtcatggcaaaagaaggcttcacaaaggagggaggcaatcctgcagaaaaggcaagtaggaggaagtctgagcataggcctttgtatttggcaatcagtaggacaagggtgactgtggccaggtcagttgcaatggtgactgggatggtatccatcctgtattcactgtattgtctaccagtgaataagaggtgagaaactagaaaaaggttggcagttgaggaaaggaagaaaacaatagctcaaaaaggacagaatggtggaggtggaagactgtgttagaattagggagacatttgtaagttgagggaaaggtgtcactggagaagaagataaagatagatagaaaccagtgagaaaacaagtcccaggagtaagatatccttgcatatgggctctagaccacgggagtatggaataactctaatcagaagtgaaatacctctgtcaaagacaagcagtgatagtcaagagattggcgctctcacggattgagctgaagctggggctccatgcctttattttatttatcttatacttttccagggaattaagaggtgaggtcatcactgagagttcttattaaataacatatatgtgtctagtaccatatgggattcaaaaaagcacaagacccattctttgccagtctatctgtcaagctattatggtccagtatacagtctctcagaagcaatggagcattggttccaggaacccacatggatacccaaatccacagatgctcaagtcctttatacaaaatggcatagtatttgcatatgatctatgcacatcttctgtatactttaaattacctctagattacttataataccgaatacaatgcctacctaccacttcgttggtgtggattcaacatactacttggcacatggcaaattcaagttttgctttttgaaactttgtgaattttttttttccaattatttttgatcactggttatttgaatccacagatgttgagggctcactgtagttaaattatccctagtattaagttacacagtattttgtgggaaacctttaacaaactatgcttgtttctgccagtgattagtaaaaaaaatattgttggccctgtttttcatcatttgtgcactttaaaaaaatagaagcttgaaaatgtgatttctgctagttatattttcgattagaaaattaaccatatgatcttagtggcaataagaatatgaccgtgataaaattgcacagtatattttaatcttactctgttcatatgtttagaagactaaacttgagactaattatatgatcaatgtctcctgttttattattttacctcagaatattaaagtgattacacaaataataagtaatgatatttttcccttaaaatataaaggaatttgcacaattttctcacattctgctaaacaaggagatgaatggttagaggctaaaatctttaagttctccaatgatgcattaactaaaccaaagagacaactttactcatttcaaaatgttttattataacagcagtcttcgaaggcaaacacaaaagattctactatgcttagattttaaaacataaccaatttaatgcatcactaatgatgtacaatagatgtcttctgcagtaccaattcaaataagagactgatgtaatctgccagatacttcaaagtaactaatttggtaataagaaaatacttcttttgtgcaaactttcctacttaaaaaaaaactgcagaaaccctcccagttgaatatttactaaataaaagtactgaaccctcattaaaatgtgatttaataagaaaaagagaaccatgtactttaggccttcaaaatttatcttgagtaacattaggcttttagatggaaatacatctctatacaaagaaaacagatattaatagcaaattatgatctattttagaattgtgtatttatatttgacatcttaaaattttaaatatctattacatttgttgctattatgttatacaccctatatacacacactccagatgccttatctatgaaagtatactagtacatttcacttctctataaatcttccccagtatgtgtaagtaaaacatttcccagactctaaacctctaaaggtaaaagcttaggtcagagtttcctgagcatattctactatgatgttaatatgttttcctggggaaagaatcttagatttctctttgcctttgttctcccttacccattagagaattcaaaattttggccttaatgggaaaagaaagtataaaattcaacaagtatttccaaaagcaagttcaatgcaataattattcattggccaagatatttgtcaattgctcttttggctcacaaattcaaccaaaatataaatgtaaattaagatgttttcaattatctattgcttcttctccagcagcagctaatcctgagaaagtacctattattccagagaggaaaaaggaagcaggagtttccatttctgttggccacttgggggtaggagtgtgtgtgcagaactaggacacaggagatacttcttagggctccttctgctgatattcaaaaaacccagaatccaaattacctaatttgtggaaaacattttcttaaaattggattttttttatggctaataattgggcagaattagcatccatgaagttacagtaggattttcctttattacatcatattttaggatatatgttcccaattaaataaaaaattattgatttgaaccacttataatgttaccaatagagcattattatgatacctattctacagaattgcagaagcaccagaaaaaaaattcctcataagaatttgctaacttcttacttcatattaactgttgatacatgtcctataccagtgcattagccataatgcttgcaaattttcttgacttcccctgacccactagatagcattcaaattcgtcatcctagtgtccaagatgcttcactctctgacctgtacctcacattctaacccttgttcccactaatatccaaagatcaaccctatacctcaaccaaaaggtctgtcaaataaatgaccttgtgcctccccactcagtgtctgggcccatgctagctctagctagtaaaaggcccgaatgccttttactaaatgcgttttttctctattgcctagagggagctctggttcatccttcaaaggtcaccttctgcataaaattctctttgtggaaatcactcctgccccatctctaaaattccttaagcattttgcttatatatctcataggccagttatgtgttgttgttgttgttgtttacattacagattttcttctaattataatgattaatttttagggacagcatccattttttatacacattttaaaatccacatgggcacatattgtcacactggcttacatgaggcagatattcaataaaggtttattgaatgattaacttttatgttatcataattttgtatttggatttattcttatttgagcaatcattgtagaaaccagtgggaaaaactgctactgcctgcaatctcctttcaaaagcaaacaatagaaatgattaatctcttaagttacaaatttgattggaagtaagaatagagatcaacctcatgcataaaatgagacagcagaagcccataacaagactgatgtcaggagctaagcaaaaggtctgaatgacaggtgccctcatagctgtggaaaagacacgctgcatagcacagtgtacatgggagacaccatttggcataaaacataaatgaatacatagtacatcgaagtgctttataatgaagttatgctgaatatatttttttactaccctattgaagtggtcaaattttaaaacctccaaatcaatgaggcttaaagtaatagcagggctcatttccttggatgatacatgattctctgttgggagttctatcatctacataaactgagaagccgggaatggaagaattaataaaatagggtttcttttcatggaattgacctaaacagtgaattactatttgaaaattactcatctaaaacaagaactaaacactcaaatgccttgattcttgtttaaaatccaacagcacttttttttttttggcacatagggatactaaatgtttgttgattttgttgaatggataaatgaatgactagctgctttttaaaattagaatattaatcacttcttggccttttggctaagaccaagtataaaattagaatattaaataattaaacaagtgatgcaacgttaatatctgagcatgtacttcaggggaagaaagtgaaaatttgtctcttggctgagactgagaaatgttcccctaaattttatactgtttctggctttgtaggacaccacctccagggaaactctatttctctttgacagtcccaggggcctgaccaaccttagggagggactcagtttctattagaatgaaagcaatagtctgctgcccatcaaagatatctggagacaaaaggacaaagtaaaagacatataaaaagaaagaagagggaaattgcaactgatgtcaatattaaaatgaaagtggaccattatttggtgaccttaataaagaaaacctttgaatagcacactttgaaaatgctattttgtctcaggtcatttttacgcatatcccaagacccatatagtcagtaggacctccagaaacttttcacattcatgaaagcccagagggggaagcaacctacagcgatattagcttaaaaatgacttctaatagcttcctaccagctactatcagatacaatagcttacttaaaatggaactgataatttggcaccaggttcttcaatacttggcatttcccaaggactcctgagacaaaattatcaatgaccacagtcattttttctttagtgtttcatgtgaaagaaatactaagttgtcacaaaatattcatattgctatcaaaaatcaacacaagttgtagattcatttttccttcctttattttacagactttagggattacatagactatacatttcaaatgtatagagtgtttgaatttttcaaaatgacagttttggggacgcaccgcttaggaagcagagacaacacagggtgtgggagcctagctgttaggtctctctctggcagcttacttttgccacctagtgggggaggcagtttcagagtcaggttttatgttttgtataaataaggttgtctcctttaagacctaatgatcagctgatttgaaaaaaaaaacaaaacttgtttttcctagtgaggattttatatagatttttaaaataaccttaaataatttctccaaattggtttattctatggctattggttttctttcaagcagttagtattcactacaatgattaacttagagaattcaaggtaaaaataaaacttttttgtatacatctataatttgtaactattcagaagaaaaaaggccttttcctggtttccagttattttctatcccttgactttgtagtatctcacaagatctatcttttggctcattgttgttctttctacttaggtggggaccaaatctatatctttatccctaatttctcactgtggctacaatcttcaatcttcagttatccaccaaatcatctctggaagacatttaatatggcaaaaacctaagtcatcgttctccaaaaggatcaaagaatgggctctccttttgagccagtgtggcaggcttaatcagagctagagtgcagcccagggctaaaaatggcagaagagatttttttaagcaagtaaaaattaataaaacagttaagcaaaaggaacaatcagaagtcaggatcagtttactgggctgggcaggaggaaacacaatgatcaagagagggtggagcaataatagtgaacaggaattgaggtcaggaacatgggaaatttgaggcaggtcacaaagttaaagctaaaaaaattggaaataagaagtaaaagaggttggacggagtaccacagctcaagtcctgaggcttgagtccaagaggaccccctgagacatggaaggtttggacctaaaaatgcatggtgacatgtttttccactctttcttcaaattataaaagcccctagttcccatggagagtcagtctgctgaatttcttgaagtttctgacctaaataaattattgcttatgaaaatttccatgatcatgaatgaccttataatagaagcttagaaaactacttcttaactgctttattaaggtgtaactgacataccataaagttcttctgatacggtgtggatgtctgtcccctccaaatctcatgttgaaatgtactccccagcgctggaagtgaggcctggcaggaggtaactagatcgtgggagcagatacctcatgaacggtgtagcatcatccccttggtgataagtgagttctcactcatcacatgagatctggttgtttaaaactatctggcacctcctccctctctctcttgttcccatgcccgccatgtgacacgcctgctcccacttagccttctaccagaattgtaacctttctaaggcctcatcagaagccaagcagatgttggtgccacccttgctgtatagcctgcagaactatgagctaatgaaccctattttctttataaattactcagcctcaggtatttctttatagcaatacacgaatgggctaacacgtgttccattgtgagtagttttagtaaatttagaaacttgtgcaaatgtcaccataatctagtctgagaacattttcatcaccacaaaagttcccctgtgcacgtatgcagtgagccgttgctcctaattcctagtccaaggcagccactgatctgctttctgtttctgaagatacagacttgcctcagagacattacaggtgaggttccagaccactgcaatagagtgaatattgcaaaaagcaaatcacacaactttttttgtttcccagtccatattaaagttatgtttacctacactccagtctattaagtgtgcaatagcattatgtctaaaaaaagaacatactttaattttaaaaacagtttattagaaaaaaatgctaacaatcatctgagtcttcagagttgtaattgctggtggagggtcttgcatcagtgtggatggctgctgactgatcagggtggtggttgctgaagactggggtggctatggttaagttcttaaaataagacaaccataaaatttgctgcacggactaactcttcctttcacaaaaaatttctctgtagtatgcaatgctgtttgataatattttacccacagtagaaatgtctttaaaaatcggagtctatcctctcaaaccctgctgctgttttataaacaaagtttgtgtaccattctaaatcctttttgtcatttcaacacactcacagtatcttcaccaggagtagattccgtatgaagaaactagttgttttgcttatccataagaagttcaagtttcatgagattgcagtaattcagcgctatcttcaggttccatttttaattctacttctcttactatttctaccacaccagtagttacttccctcactgaagccttaaaccccctccaagtcacccatgagggttggaatcaacttcttccaaatccctgctaatgttgataatgttgacctcctcccatgaatcacaaatgtatcttaatggcatacagaatggtgcatcctttccagaaggcttccaatttactttgtgtagatccatcagaggaataactatctatggaagccatagtgttaaaaaatgcatttcataaataataagacttgaaagtcaaaattactcctttacccatgggctgcagaatgaatgctgtattagcaggcatgaaaacaacattcatctccttgtacatctccatcatggctcttgcatgaccaggtacactgtcaatgagcagacatcttttgaaagaagcccttttttctgggcatatggtctcaacagtgggcttaaaatacccagcaaaccatgctgtaaacagatgagctgtcattcaggctttgctcttccatttctagagcacaggcagagcagatttagcctaattcttaaaggccctaggattttcaggatgggaaatgagcagtggtttcaacttgaagtcatcaggtgccttcaccgctaatgagaaagtcagcctgtcctttgaagctttgaattcaagcattgacttctcctttctagctatgaaaatcccagatggtatcttcttccaatagaaggctgttttgcctccactgaaaacctgtttagtgtaactacagtcttcaatgatcttagccagatcttctggataacttgctgcagcttctacatcagcatttgctgcttccccttacacttttatgttatggagatggtttcttttcttaaaccttatgaaccaactgctgctagcttctttcttctcttctgcagctttctcacctccctcagtcttcatggaattgaagagagttagggccttgctctggattaggctttggcttaagagaatgctgtggctggtttgatcttctgtccagaccacctgaactttctccatatcagccataaggctgttttgctttcttatcatttgtgtattcactggagtaacacttctaatttctttcaagagcttttcttctgtacccacaacttggctaactatttggtacaagaggcctagcttttggcccctctcagcttatgacatgccttcctcactaagcttaatcatttctagcttttgatttaaagcaagcaatatgaaactctttcagttgaacacttataggctgttgtagggttattaattggcctcatttcaatattgttgtgtctcagggaatagggaggcctgaggagatggagagagatgggggaatgggtggtcagtggagcagtgagaacacacagaacatttataaagttcaccatcttatatgggcatgatttgtggcaccctaaaacaattacaatagtaacatcaaagatcactgatcacagattaccataacacatacaataatcataaaaaagttggaaatatttcaagaattaccaaaatgtgacacagagacatgaagtgggcacatgttgttggaaaaatggtgctgatagacgctcgacatagggttgtcacaaaccttcaactggtaaacaatgcactttctgcaaagcacaataaaatgagctatgcctgtaatttaccttttctggaaatttcatatatatgtaatcatacaatatgtggtctcatgtctatttttcatatagcatgtttttgaagttcatccatgttgtaatatagatgtagttcaaaatagtgcagtagttccttttcattgctgaataatattccattatatggataaatgacattttggttacccattaaccagttgatggacatttgaattgtttccagtttttgactactatgaataatgctgctactattatttatatacaagtcttcctgtaaacatatgtttatttttcttaggtagatacttcgagtgaaattgctggatcatgtggtaaatttacatttaactttttaaagaaactgccaaactattttccaaaatgctgtacattcctaccagcaatctacaagcttcctatataaagtttctccatatcgtcaccaacatttattatggtctttttgagtacagtcatcttagtggggtgtgaaatggtatgttatcgtgattttactttgcatttccctgatggctaatgacattcagcatcttctcaggtgcttattagccaactgtatattttctttgggtgaactgtctgttcatatcatttattcattttaattgggttgtcttctaattattgagatataggagctctttatataaactacatacaattcattaatcaaatatataatttgtaaatattttcctctaatctgtggctttttaaaaaacattttattttaaaataaatttttaaaagcagagggtcagaaaacatcagtggctgccaggggtggggaagagaataactgcgagggggtagagggaaatattttgggttatgcaactgtttaatgtattgattagttatataactatgcatttgccaaaattcacagattggatattaaaaagggtgattactgggtgtaaatcgtaactttctttttttaagagaaagatactgaaaagaaaggagccacatattttccttatgtgaaaaaaaatagggtttatggttttctctggtagatagtaaaaacaattactggggaattatagtaaagaacagtaagatgagagatttcttcaatatacaactggtaaaaaaaaattaagaataatatgcttatgcagaggaaatttcttttttgtatttgagttgataatttgacctggaatttttctgttggcataaaactgttagaaatgcttattttttaaatttcacaaaattctcaggtagtaagcaaagcattagaacaataaaggcctctacaactagttccatacagcattttgatgtaaaaatatgcataaatctttaattggaaagtatatttctttttctttttctttttttttgagactgagtttcgctcttgttgcccaggctggagagcaatggcgtgatctcggctcatggcaacctccacctcctgggttcaagcgattctcttgcctcagcctcccaaatagctgggattacaggcatgtgccaccacacccagctaattttgtatttttttaagtagagatggggtttctccatgttggtcaggctggtctcgaactcccaatctcatgtgatccgcccacctctgcctcccaaagtgctgggattacaggcgtgagccaccgcgcctggccagaaagtatatttctttacagtaaaaaattaataatatttggacaaatagtcaaatttgtacaaatagtacaattcagatgtaacacactaactataaactatgtatttttacaagaactaatttcaaaatatacatatatggatgtattagtccattctcacactgctaataaagacacactcaagactgggtaatttataaaggaaacaggtttaactggctcacagttcagcatgactggggaggcctcaggaaacttcaatcacggcggaaggggaagcaaacacatccttcttcacatagcagcagcaaggagaagaatgagtgcccagtgaagggggaagcccctaataaatccattagatctcctgagaactcactcacatcatgagaacaggatgggggaaactgcccccaggattcagttatttccacctggtccctcccacgacatgtggggattatagaaactacaattaaagatgagattttggtgccaagccttatcaatggatttacacaattgatatttagaagctcttcaaatctatttgtaaatttaaaagttaagtagaatcatctctgccttgcaattgggagctgcagaaggtcaactggcagcgcctgcctgcgtgggcaacgttcttggtgaccactgaaggcagtgtgggctcaccaaagcgaggctgctctctgggttccttcctctttggctacttatggtgtcggtgcatgagatgctctatcttatccacgaagggaaacaacctactggacatctgaaaaagtgaggaaactaaacatgcagtgttgtgcttacttctaagcaatggagctaatccagaagggtccataccaggctgattaaagcacttctcttttggtttagtattcaccttcatcaacatcactttcaccatcatagtcattctacccctcctcctcatcttcttcttccctcctttcctctttaagaactttcaggtatttactagtggaaaccttctttggcaataatacaccttcaagaaactgaaaaatttctgattcctctgctgtatttgctaaattactgttagtgctttcttctttctactgccatgaccgtaggaatagatggttagagacttaacaaagagttgtgtggccttggccaggagcacctcgaggttgatgcacaacaccatgggagaactcttcatgatgaccagatgtgggacagggacagcaagagaagccactgctccctgcacttgtctttgcccacaaccacgtcccccacttttccgcccctcccatgtgggtggcagctggtgccccaccatgaggtggctctcaattttcattttcttaataatgttgttaatgcaaaaaagttttaagttttggtaaagtccaatttaccaatttcttcttgtatggatcatgattttggtgtcatatctaagaactctttgcctaacccaagatcatgaacatttctcctatggttctttgagaagttttaaagttttgggttttacatttaagtctattatctattttgagtgaatttttgcatatggtatgaggtaaggctccaaattcatctttttcatatgaatgttttattttcccagtaccctctgttgaaaatgttattctttcctgattaaatttccttggcatttttattgaaaattgatcaaaaataaatataaaagttcatttctggactctcaattctgttccactgatctacatgtctatccttaatgccactaagtagagtactgtagttttacagtaaaacttaaaattcagtagtgtaaatgtttcaattttgttcttccttttcaaaactgttttagcgattctggtctctttgcatttccatacacattttaagatcagcttgtcaactgctatccccaaaagcctgctgggattttgacagggattgtattaaatctataggtcaatttaagagaaagtgcgaacttaacactaaaggttcatctaatccatgaacattgaatacctctcatttgttttagatctttaatttcttttagcaatattttatagttttccatgtgcaaatcttgcatctctgtgtttaaactgattcctaagtattttattctttttgatgctactgtgaatgaaatggtcttaatttcatttttggtttttttttaccagtatatagaaatacaacaaatttttgtatattcatctataaattatatcctgtctgtaactgaacttgtttatcagttctaatagggtgtgtgtgtgtatgtgtgtggggggtgggtatttctcaggattttctacatacaggatcacatcatctggaaataaagaacattttgcttcttcctttcaaagctacacgctgatctatcttgaagtttatgggtgtgggttcttctgccatctcaaatctgttattgagttactcaagtgaatttttcatttcggttattgtacttttcaactccagaatttccatttgactttttaaataatttatcttgagattctttatttgttgaaccattgttgttatactttcgtttaatcctggttttctttaattccttgaacatattttagctgctttgaagtatctgtctgcatagtacatctgagcccactcagaaacactcagcttctgcttccattcactgctttttccccctaagtattaatcacccttttctttctttaaatatcttgtaattttttaagcctgaattttaggtacaatattgtactaactctggatttttatgttcttccctcgggattgttgttcttgctgtggttttctttttttgtttattaagttgcctaaactaaatctgtggaatccatctccttcatggtgcatcgctgcttatctctctacttaattttttaaaacttatttttgtttttatttttaagcctgattcttaggggtcactcccatgtctgcatagcttagtggtcagccagtaattagtcggtggttatgctcaaataccctaagctagtaaagcttttaccctctgcccatgggtctgtggttgggttgggggagcccattaaaaactcaggcagttttcaagtctgccctggcatttactttctgccaggcctttttgcatcttctctgcatatgtgcagatttcacagtcatccagggtgtataggtagcttgagccctctttgatatctcctgcttgtgtttgaagtgttttggtgagtttatcaaggctccctatcactgtgccattttcccaaatctccctgatagatttctggctagtctgctgatacactgttggccccaactaggaatgtaacctcaggttcactgagttgctagctagcctttcttgtctcttaccgagatgtctactgttactcataatgttggtgggcatggggctttcacattccatttcatatcaaggaaggccactccatcagtgaaactgatggttttcatggccttctttacccttgtagaactattgtgctgagtctgcaggtgggggatgggagcacccgcaggcagaaacaccacaaaatcctaattagcttacttggagcactatagtttgtctatgaataaatgcttctcaatttgttgagtgtcttttatcaattttcagagtcctaaagttgctgtttttgacaattttgtctagttctgttgttttttggaaagggaatttgttcagctctcactctgttcttttggtagtctacctttagaactattgttaagagctttttttcactctttcatactcagctggtcatcaaggcctgctgattttttctctgcaatgtctctttaggagagatgctgctttccttgccattttcagagtcacacccatcaaggtgatcagtatccattcctaaattcctatgatagaagccttcctcctcatcacagtcagttctgcatctggctgctagattgatcttatagacaccagcataatcacatcccttgttcctgaatgaagaacggctctttgttgcaaagaacataaatttcatactgctcagcctacctttcaagaatgtattcaactgccttgatctcatgtacaatcatttatgtctggaactcccaccaagttgagtttttctatccccacatattctttgtcaacttccatttttctaccttttctcatgctgtttcccctatgtggaatgtccttataatctgcctttcaatttttggtccatcaactcctaaaagaagcttaatcagattaattcttctgttgttgatcattcctatactccatagctcttcagtattcatatgtagatttttaaaacatttctggcacaaaatcttactggtttgcaattggtcttcaattgtttctgtatatgttttattttttctccaacttttttttcctttttaaggatttattttttagaacagttttagattcacagaaaaattgagcacaacttacagagacttctcatataacccttgcctccaacttttaattataatcaatttaggactttatttacaaaatagaagatacttcttagcatctagtacagtggtggacatgcagctggtggttaaaacatgactgttgagtgaataaaatgtttcttgatcttcaatgaaaattctaaaaactctttgaaaatgaacacttttggatttttttttcctgaagaccttaactcttacatatacctctgaaagcagcagtagtattaaaactatttaatagtgtgccatgaaaactgaaaataaaattagaaaagaaaacagagtcctgaaaactgctgggccaaataatgacctattagttcctagaccatggggaagtcccagaggtcctggacatgaggccatgaaggcagggggtgaagcatgaggtagcagctatttgccatgtggaatgaaagtatttaaacattttaacaattggcacgacagtatcaggggacagcctgaatgtcggttctgccagcaagtagactgatactctctggatttcataatggctatagaatatctataaagtggaattctgtcaaccttcagcagttttggatttggagagaaatatgagaataagtccctgaaatgtaaagtgcagacaagaacagtcagaagccagtgtcaaggatcagttaaacagcaaaagatcatagagtacaaaagtaccataggccaagacaaaccaacagtggagaccctaggtaagtaaccagaagtcagagttcaaattaagtaggtggaacaagccaaacaaatagtaaggaaattctaggtgaggatcccagcaaacagttgtctaggaagcagaaatgcatggataaggagactctgacttcaaggcaaccttctccctgtgctgaaaaaatttctcttttttttttttttttttttttttttgagacacggtctcactctgtcacccaggctggaaagcagtggtggctcactgcaacctccaccttccaggtcttcagcatatcagtcttttagagtaagacatttaagtgtgggtcttgatagggcactgactctttttttttttttttttggaaagagagtcttgctctgtcacccaggttggagtgcagtgatgtgatcatgactcattgaagcctcaaactcccaggctcaagcaatcctcccacctcagcctcctgagtagctgggactataggcacacaccaccatgcccaactaattttttttttggtattttctgtagagatggggttttgccatgttgcccaggttagttgcaaactactgggctcaagcagtctgcccaccttggcctcccaaagtgctgggattacaggcacaagccaccatgcctgacctagagcagtgactcttcttaccaaacagtagaaaacctgacctaggtttgctcgtagcattatcactgtttcatctatggagggtaacagaagacattttttttttatcactaccttgcccttaaaatttaattttcacatattaaattatgtgaaattaaatttcacatatgtctagaatatttgggggtttaaaaatgccttcaaatttcttccatcagaggatgcaaacgagaagccaattaactaaagggtatttaaaaaaatatgtaatctaaaaaggcattcagtgccaacttagaaacaaagagagtaggccaaataactattagcaatgaaagaaaaatattgaaatttttgaaaaataaccagtaactggtttgtctaaaaaggaattttggacatggggagaggcatgacttaattgaaggtgtattgctaagggagagaaggttaccgcttttcagttttaaatagtgtaataaatcatacgcaacaccataatttaagtttatgaggaaggtaatactctttaggttgtaaaagtgacctccagtgggcaataatgctctcaaatccgtggcctagggaactatattccattgatcatcactttaaaaaagtctatataggcaacagttttccactataactttcacatctatttagcaattatatacatatggttatttattggtttaataatgtatctggtttgattcattagtagtgaactgttaacagaaaggtttttagaatatttccccagtgatcttcaaatcaacatcaaacatagaggcatacagaatagtaggaatagtaaattcctacctaaatatttttaatttagaggggacactaagaattagaatactgaatttaaaatgaagaaactgggcaggcatgatggcttatgcctgtaatctcatcactttgggagcctgaggtggaaggatcaattgagcccaggagctcatgaccaggctgggtaactaagaaaataaaagagaagaaaaaagaaaagaaaagaaattagcttattaggtgtgctggcgtgtgtctgtagtcccagcaattcaggaggctgaagtgggaggatcacttgtgctcaggagtttgaggttacagtgagctaagattgtgccactgcactccaccctgggcaacagagtgagttcttgtctcaataaataaaaataaataaataaaggaactactgataagcagcatatgtgcaggtccaaaactgaacaaaacttactagaaaatctagaaaacactttgggttctatttatactttgtctcctatgaaatcatgaacatcaaattatcttcagagataacctgttatgaaacaccaagctacagataactgaggtacagattaaataaccacatttttagtcttttttagtgtgaaaagttaggtttttttaattctaaaatttcacactttttgcccattaaaatagctgttattcatcatttcaggaaaaaaaaaagtgggagaaggaaagcaataagtaagttcgtggcctttgactctagtccaaaattattttatagctcaaattaataagtcacttgtgtgcacaatatcactggatatatgcaatctctcagaaatgtggttatgctgttctaagcatatatgaaattataagtcagttataaaatacacaatattcaatcttcccactagcttcccctataactcactgttggttctggaaactgcttatacatctgaaatgaaaaaagtgaaagatcactatggaaatagcagaatattctttattacttaaaaaaaaagttctgctcagaagtgtttctaaatggaatttcagcaaggagagaaaagtaacctttgccataggcaaactttcttttaacactctgataaatactgatgaagacagacttatttattattccttcagaaaataaaattggtttccactgtaaataaattcaaaattcagtcaagtctaattgtgctataaaatgggcaatacttccagaaaactggcttctttccaaaagagaatggactctgaataaccatgtttaaggcaatatttgatacaaaattcagaaggtgaatttttaaggcttcttccttctaatcctaggattgaactagcaaacttttcctgtaaaaagtcagatagtaaatattttaggacgtgcaggcaataaggtctctgtcataactactcatatctgtcatcatagtgtgaaagtggccataggcaataccaaaataatggttgtggctgtgtcccagtaaagctgtatttacaggcactaaaattcaaattccatataattttcacatgtcacgaaatactatttttcttgtgatatttttcagccatttcaaaatgtaaaagccattcttagttcaggtggtgggctgaagctgactcacaggccatagtttactgactcttgttttcgtccacagtctatttttagtctattatttagatagaataatatctatcctgtggtgagaagctcctggtgacttttcctgctgtaattttgtttaagatatgattaaattccttaactataagatataatttgtgtaaaacgaaaattgtatataataaagttaaatgtcagcagaagacattttagttctaagatcaagggacaagtttcggagggaggaccattttgaaatatttaaaaaaatcaacaaatacgaaagcactttaccaaagcaaacattaaagttgatgttcatttttaatatatctgtcttagcactctaattcataaaaaataaacaaaaatcaagttatattttgaattttggcagctccaggacctcctggaagttgccagcggcagtgattatacccaatctttccacaccccacagcacttggcgctgctgacgtacagagcaagcaaagccgctgaagttcaaaacctgcactgaatctatctcaaacaaagaatgccaggacccactgcagtgacccctaggatgaagacatggaatctgttattatgcaatgtcacttaagtatgtcttttatattaataaaaaagttcgtcttggtaaattcttgctcaaacctatgacgtctctttagattctgaggaatgcagtcatgaatgacattattcagtgattagtgacttgtatactaataaggaggctgcccctggtacttgaagaaagtaatttaggacgccacgaaaaatgtactcatatgcataatatgttagaacaatgaaaagttataaacagagaaaagaactaatggagatattatgatggatttctaaggccaattacatgtatttacagtatgtgaatacaccaagatcaagctctgggattctttcacaaaaaaatgtccttatagggccaccactagaaaaagcttactaggccagacattctatttctctcactaattttaccaaatgaattttaccaaacctaagtcattctaattttcttagaaattcaatttaattccatcctataaacacatatcaagtgcctcgtaagtgcaagagcataaacactgagaatactgaggtgagcaagactctgccctgtatctcaaggagatcactgcccagtggggtagaccaacatgaagagatcttgggagacagcttgataagtgtaacaatgggataatgtacaaagtacagatagagctcaaaggaagcagagttttaactctctcttggtttggggaaggcctattgactggagtgacatcttggctgaatctgacagaacaattaaaattaccctatgagcaatgagagaatgggccaggcagagggaacacacatgcaaagatacacatgtaagagcatgaaatatggtaactcaggactgctagagcataaagcgtgggtataagtacagggtgaatggtaaaagatgagattggagacataggcaaagaaccaaatcacagtctcctgagatttcatcctacagacttgtgcatccaacacccatgtggctactgagcacctgaaatgtaatagttttaaatcagatgtattataagaataaaatacataccagatttcaagtatgaaagaatagtatctcaataatcttaaaagttgattatatgttgagatgatattttagatatattgggttaaataaaatgtattattacaattaattttaactgtttgactttttaaaatacggctactagaaaatttaaaattgcatatgtgacacttgatcccttatgtagtagtccttgcggttgattcctcaacaactacttcaccccaagcatttaaaccagaagtgattacttctcctgccagcaactggtgtagaaatgggcacatgaccaacccaacccaggcttataaattgagggaaagatagctggaggggttcctggtacagatgtctttgcccaggacacaagaagatcagctctctccttctggatgtggttatactgcacacaacacagagaactcctgtggctatctttctgagtcagaggatgaagtggaggatgtcagagctaagaaatgggaataacctgagtccttgctgacatcattgagctgctttatcaaccaaccctggagctcacccttcctttgaacttcctgttatgtgagataatgaggttcgttattatttaagccaatatgagtcaggttttctgttacttgtagccaaaagcatcctggctgatacactccattagaccataattacctcaagggcaagggaatacagatactatcacttaagaccatctcgtactgcaaaagctctgtacatagtctacaatcaatatattattgttgtgataatgtatattggggtaatatgtgggaaggctttccctttcttagttctaaaatatcattagttgtaagacattacagcctaatgactcaggcgaggagaattttaattaatcagagaataacctacaagcagaacttaatcaaaactagaatactcattagatttgtaaattgttacacttcatgaatgtcctttcattaagaggcctgacttgaatcctagtcaaagcatacacattggaaacaattcagcttaattttactaatctggacataaacccttaaaggtgatttagcaaatatacaactgctagagtttatacctcattattctgagaactaagcaaaataatgtacggagagcctagcacatatgtatatgtatgtatacggtaaacatactacatatagatttggttcttgcttattttctcttgtagaattggatttttattcaaaatacaaatggttcccaacttacaatgattcaacttatgattttttgactttaaaatggtgatacacattcagaaggaactgcatttccaattttgaacttcctgggctagtaatatgcataccatactctcttgagatgctgggtggcagcagcaaactgcaccttccagtcagccacttgatcatgaggaaaaacaactaatgaggtaggctaagctaaactaaactatgatattcagtaggttaggtgcattaaatccattttctacttataatattttcaatttagatgggttgaagagcatttgtaatatatgaaatatgcagtcatttactctatgtggtaatcttgcttttgttgactagaagtcagattacagtaaatactaatatacatatgttaaacttcattggctagttaatgcttggttaggtggttgatttactaattcattctttcatgtatatgaagcaagtaagctcaagatctaacctcaacacaataaggcaggcagcaataaaactatcaactagaaattagaagctatagtgtttttactaagctacatctacttacccaatctttgtgagatttggtgatattgacaatgcaatcagaatgaagatgaataaaaaggaaacaaagatagggaaggaagtttatgactttggggctgtaattagaaggtgactaatgtaattaaaggagacaggaaaagatacttagtaacatctaaaagtgatgaggaaacatatagaaagggtgtcatgacagagtcaagaataatacttagtgagttatatcaagctaggagattacaaaaccctcctgaactatcactaagtatgttgcttttaataacatacactaaccaatacaaccaacttccaaataggatatgctgaagaatattgagcaaaaccctcaccagctcaatcttaaaaaataaatgactgacaagttcaaaatttcataagacaattggctcagcaattgtaaatcagtgacctttgtatgcactagtgtctaaaggagtattcctacatacagttattcacagttagctcatgtttgctgagaaatctgtatctgaaaatttaagctatgtttttgttctggacaattgaactaatttgagtgtgaatttctaatatcatatttgttgtgatgaataaggtaaacatgagaatgtcaaaacattctctccaagacatcacgaggacctccaggcaaacccagcctgaatgactgcccactgtctggatgagaattcagggtttcaggatgggaaactctggcctacagacgtcttcgctaaagccagacaggagtgggcttagaccactttttgtagactgataattactttaagaagtctgggccaggtgcagtggctcacacctgtaatcctagcactttgggaggccaaggcgcacagatcacgaggtcaggagttcgagaccagtctgcccaacatggtgaaaccccgtctctactaaaaatacaaaaattagtcaggtgtggtggcgtgcacctgtaatcccagctactcaggaggctgaggcaggagaatcacttgaacccgggaagtggaggttgcagtgagccgaaatcacgccactgcactccagcctgggtgacagagcaagactttgtctccaaaaaaaaaaaaaaaaaaaaaaagaaaagtctgaagcaggccttaactaatcactggcatttggagaagctctaaaccaggctatgggttaaatttagtgcattccaaggtggagccaacacaccaagagagcacaggagaggcaagaggatggcatccacattttctcagaatcaggactgcatacgagtacgtgataaagcaatgaatctggctgtttttttaacattaggcttaatctagtattatctatatacagtaaaatttaccctttttagagtgtagttcagtgaatttgacaaacgcagtcatgtttctaccaccacaattaagatgtaacacatttccattacctcccaaaactccctcatgatactttgtagttaatccctctccatacccccagcccctgcaaccactcatctgttttctatccctatagttttgatttttccagaatgtcatataaatggaatctatagtatgtagcctttcgaatggtttctttcaccaaccatcatgtaactgacaacaaggccagtgagactcggacacaactgatgaactggaaagtgggaggaattgaagttggataagtggagggggccaaatcataggagtttgtgtgccatagctaaattttttgcattttataggaggtgtgatgggaagccactggaaggttttgtgtagttgagtcaggtaatcagattaatttttcacacctataatcccagcactttgggacgctgaggtgggaggattgcctgagcccaggaggctgaggctacaatgagttgtgattgtgccactgcactccagcctgggtgacagagcaaaactctgtctcaaaataatatgtgaaagagagactacagtggagcaaaggtagaaaaaatgaggctaatttagagactgctgcagtcatctgggttaaaaatgatagggacttaaactagaatggtaaaattggaggtggtgagaagcagtcaggtcagagacataatttagaggaagagatgctgggacaaggtgtagcatgtgacggggactaggggttcaaggaaagctccaaggatggtctgagcaacaaggtaatgatggtaacattcactgggacagaggaaaggacagaagaggtaggagcaggcatggtagggggacgcagggaacaaagagttccataaatttgggcatcatcagcatatagatggtattgaatctttcccctgatcattttgcatatccgtatcaacttctgatagagaaatttcacttaacagtctctgtcctgttaccctttaatacagcaaatgaatgcaccaggtaatgtattcaatttccacttcactaagttcctagagttacatttttaaaaaataagaagataagctataaaggctcaagtctagagagctcttccatttcttgcctttgttttccacacaggtaagaacaacctgtgtttcataagaaggaccacttccaaatttcacatatactttttttctcagaataccaattctgtttggtcaactgcattgggccaaatggattatgaatagaaactttaaaaaaatgattacaatttttcttgctttaaaatgtttccctatttactagcatttacaaattaatgggtgaaaaagcatttagtggtccaagttttccaccttatgagatcaagttgatgctgctacggtgaaggagtaccttttgcttagacagaccctcaggttggggagagggtaacggcaacataatgtagaaaagccagagggtgtgaagtggggatttactttgtgtctcctttccccagggagcccaaatatccaagaacaagagaggagcagtgatcacaccccctactttctacctcctaggccactacaatagtgtttgatgtacaggatgattattcctgtccaacatttattccagtcatttattcatctaccaatgtgaccatcatcaacacatttcctgaaagtttctatcttaaaatttcatgcaaatttgtcatctataaaatagttgtatttgctttaatataaaaatgtcttaatttatcattgagtgcaattgacattcagttagatatagtgagaccactatgtacagtcgtgcaggtgtacactgcacacctcaatggggtgcattcacaccgcagttattgtagacttattacaaaaattttctgtcagatggcagtaaaatgccttgaggaagaggcactttttttttctaatttgtaaaggtgtcatatgggtgaacagtagccctgaactttgagtaccttggcataggaacttggcacaagcccaaactagcctcattatcttatatatgaagaagccaagtccccaagaggtgaagaaacaaggtcccaaagctagttcaaggcaaaattgcatttgatcccagtctgcactctcactccagtgttacagcaacatgccacctctgtgaacagtgggttgctcttttcagaggtgtgggttactgatgtgctttttcatttctttgctcagccttagaagagacctttccaagagaggtatcccacgctgcttttgacatttgcctctaccatgagtggatacatagatagatataaagttagctacactgtacttgcccagtattcaaaaaggtggagttgctagactgtaagctccatgagagcaagaaccatgtctgacattctcctcatgtatccttagcacctagcatacagtcaatttgtagtttacacaaggaaacataatactcttctgtaagctaatttaggccatgcccctcaggttcctactgcactctcttctacagctagggcatatgtcaatgtaaaaccctgagaagcactggagtggtctctaagctgctttccatattaatatgctacaactgtttatttttggttgggctcattcaacctggatcaggaagatcagttacagaatcataacagcactggaatggatcttgtaagtcatctaacccaactccttcatttaacataaccaggaaacagagttgcaaggaagtaacagaatccatccaggtagctgcagcaaacctatactatggtccattcctaaaactcagattttctgaccaccaattacatgatcttccctaaatatcacaatacttccccaccaatgaatgaataatgattggaaacaaacaatgtcagaggcattgtgaactagaaaggtatgtccttaagaatgttttccaaagtcttgtttgagttggacaatgataaatcatgagtttgagaagatagactctttattctttccaagcaagaagtactagtgagatagaagaaaagaagattagttaggtaagactattagaagtcctcaaatttactgaaaaacggatataaagctggattatagttgttctgtacatgaatggctaatttagaaagcataactggttagtcatacagaaaacatgtatgtctacttactctgactccaagccagaaattctgtgatttaggacattagtttagtctaaagtgattattttaatgaaaaatatgtattctgttgtaaacaggatgtattctcaagctgctatctaaacaataaaaggaatttgtttattaagaaacaatacacttttcagatttttagctttatttcagaaataaacctttaaaagtaaaaacaatactggaactttatttcaataatatcccaagttatgggactaagttgatggttctgaaagtttacacagttgttctacatacagtcacatgctgcattatgacgttttggtcaataacagaccacaaatataatggtgctcccagaaggttacaataccatatttttactgtacattttctatgtttaaatatacagataccattgcattacaattgcctatggtattcagcaaagtaacatgctgtacacgtttgtagtgggagcaggaggctctaccacatagcctaggtgtgtggtaggctctagtatttaggtttgtgtaagtacattctgtgatgcttgcacagcaacaaaatcacctgatgatgcatttctcacaacatatccttgtcattaagtgacgcatcactgtacattctataatacaaaactctttttaacagaaccaaatgagtatactacagcgagactccagtgttatctatattgttttgttgacccttcctctcatatataactattaaagataaaaataacctgtgggacaactatttttcatataaaataattccatatttaaaataataatgaactgcaaacaagaagtctaaaataatttaaatctactatgatatcaatttcccaacacaaacaattttgatttttcaagtctagcagatggtgctagcagataatgtattaaggaaagcaaagctgcatgtgcgcacatagcttccattttgatggccttccatttccgagctgggccataacacagcaaaatggcagtggcatattatacctgatcatggctggcttcaatggagcttccaatagcatggaaagtcatctgcacaggggctaatgtcagacaggtcacacactctttgccactttgtctatcacagtagtgaacctataacagaacacacgcaatccactgaacaccattttcagaggggacaagatgcaaataggtccttttgcaaagggtctagatttcacagaacacactttaaatatttaaaaccttattgaacccctccaatatctgggacttgaattgaatctattaattccatcttaagtctttttgaggatttaagggagtttaggaaatgctatgcaaagtgcttttacattatagctagtagaaaaattcacaactaaatgctatacctatctttcaagtccagctttttataatacatgatccataaagggctcaagcataagcgtaagtcaaagttcatctgattctaatgtaactttgtcaacctgaattttctctcttctttgactccatgtgtatgtgactgccacataattggtactgacactcttctatttctacagtatagtccctacaaaaccactgttgaatatatatcactatatcatgttctgtttgaaattgtgacattacaatcaaattgaattaaattgaaatgatttgtaatgtgcagaccaaaataaagtggtcacaatattatctttcatttagttaaatacaactaaccattattaaagccacatgtaagacactccacatcagaggtaaggtacatggggaagggggaagagtttgagtccgtcttcccattaagaaaatttccatccttccatttatccactgtcaaaaacttccaggtttttaaaattgtaagctaataaagtaaaaagagcatcactttcgtaataaaattaatgaaaatatgcttatagaataaattagggattcctatttattatattagagagaaaattggttttattagctataacttgctcaatttgttaaatgtgtatagatttaggataaaggcttaagtgaaaattttgaatttgtgaggaagaaaattaaaacacatacctgagttagttccttgtcttggtttttattgtatacctgagttattcccttgtcttgggttttattctaattgctgcataatgtccatatatttttattgcagaatatggcctacgtttatttaatcatgtataatatggatctgactgaaaattacaatatgagccctagtctaatggcttaataattcaagttttttaaaccagtagggttgttaagaatggccatcattttccctggaggtagggaaacttcttcctgggaatctataaaagtagtttagagctcaaatcaagtcaacataaaagccttattcccaaagtactataaagattttgttataaaaaatatttttaccaagttaaccttggggaaaaaggtttgacaacagttctaattcaccatcctacacttcctgagcaaattaaaagctcagtcaatgtatacgagttcaagaatgtggaagtgttgtttactacacagcaactaggtataaggggaaaaatgaaacttatcacataataggtttatgtaaaagccaataaatgctggcactaaaataatagcaacagttcacaaccatttatggcatggttaaactattatgtctgatatagtgctattataaaacatgctcttttaaaatttaataaaatataattaccctttcgacaccaactgaaagtctgtatgaaagacatgacaatctcctaaatatacagtgacagtaaacacacttctatgtcagctgacttaatgtagctctattctttctcttagagaaatgaaaattagaaaggacaaaaataggacaattgcagtcaaaaaaataaactttaaacttcgtttccatcagtgactcagataccattaatgagacatataatttttctcccaactgtatacaattcactgtgaagcctgcaagtactaataaaacattgtgccttacagacattcaatattagtgtgtttacatatataactcatatatgaaagataaatgtaaaggtgcaagttagcacacagctccaaagatgtcacagcacccaatgatgtgacagagactgctagttgtcctccaagattcttccaccgtaattcttagccaggcacttggaagctcaaaataaaaaaccatattttccaggctcccttgcaactggccatataactaagtagactgtaaaagaaagaattatgtggcagcttcctgaaaacttttaaaagagatttcaagtgcgtgccttttgcttttttacccatttagccaacctgctgtttggagtatagatattatcatcttgactgcgaggacaaaggccaaaacctagatgagagtagtgagttggaagggaactgggtccatgaggacttcatggaacagaaccatcatgccagctgtagcctgcaagcttatggacctttaagtgacaaaaaaataatctctatattgtttaagccactgggctttttatcactcacaaaagaacctaatctcagtgagattttctcctattggcccataactgacaccaagactcatggccaaaccaaaagaagctctagagagctgccaacatttagggctaggctttcccctgaacccccttgtaaaagtcagtacaactggtccaatcacaaagaacacacaaaggaacaaaggatgggggagtacaacaggagggaatcatctggattgtcagcctgatgagaaatacagtatttccagctagtgggtagctctaagagaatagctgatacagagtgggaatacctgcatgaaggggaggctgacatatcactccctggtgggaggcttgctgagaactgaaactgtaggccctttttgaatagaaattttgactgagtttgctgtatatccctggcagtttagaagcacatgaaaatacagaaattgggcttggaggtatctgagagcttattgaaggagtcctaggtaggtagtgtacctgaaaaaacaaaaagataaaggaagatatgatcactgcctacctccatggcctttgaacagcatgagagaatcccagcagaagccaaggggctactcaggccagccaaagtaacactcaccaacagaggaggtcagagcacaaaccactggtaaagccaaaagaaaacgtggctgtccctcagggccagagggggccactgactcaagacacatggacatggtgtacatggaaaagcacaatggaggccaccaggagtggatgaaaccaggatgagtagcagcttcctctaccctagtcaccctctaaccctccagagcagtaagcccatgaaatagacgtaaagtgtgcaggaaggtgtctcagagccaggttaagctctgaccccaccaatctcaaatacatatgcttgagtgagatgaggagtgaaagagatcagtgtacactgtccctcctctaagtctctggagccaaaatgaatggcttgcaatggaagggtatgaacttggagttctacactgatgcattagatttttaaaaactaaaagctagccagaaaactatggaatttgccaaagatatcacaaaggaacatgaatgggagatgtggcaaggcacggaggaagggggtgactggagaaatataaaatcattctgtgttatatccccactgcattgagactgctcagtaaaccagataaaaatatgtagggaaaaacatgaaactcttgcttgaggacccaatttcaaattaaacgtaataatatgctgataaaaggccttaagaaaaagtcacattttacatactcaaccaatgactcataaagacaagttaaatatggctttcttcaggtatatattttcttcctggaaataaaaatatcagtgttcatgaaactgtgaattaaaaaaaatatgtaaatgacattttgaaattcactcttctaagtctaaaaatgcttcttatgattcaaagcatttgcaggaaccaggaatcttagaacactatattaaaataattagggcaacaaaattccattcattgtgtctgtaacacacaaatcttcagaactgactgggtaaactctttctgctagaacaaagcagtgcgtttctacaaacgtggcctgaaaaattccaatacacaatgtcataggaccttgattttgatgaaagaaaaatgaataaagataattatagaaaattacaaaagagtcatcaccctatgttttgtaaaccaacaataaaatcctaaggcccctgcagccaacttaatagaccccctctgagtcaaggggacctcagagaaacctgaaaaactgaattcccagccatgacagaaagggaggttggatatgcgcagtcattttaggcataactaaccaacattaacattgaaatagaggtcataagactgatgaaacatgttatttgtggcaataagattctaagttccaacctgactctaagtttcaaccatagcatcacatgacagatagcagtccctgaaggaaattaaaatattttaccccaatatatatttaaatgacatgccttgaaatggccctgcaaagcagtaccttgtgcggggaacgtgcacctgtacagaaactccattaagcctcccctttttaggcctttcctgggtctaagagattaaatgagagtctgggatgagcatggtggctcacacctgtaatcccagtgctttcggaggccaacaggggaggatcccttgagcctaggagtttgagaccaacctgggcaacacaggagaccccatctctacaaaaaaaattagacaggtgtggtgtgcccaggagtttgaggttgcagtgagccataactgcaccactgtactccagcctcagtgacagagcgagaccctgtctcaaaaatataaaaaattttaaaaatgagagtctggcaactttaagctctgaaaagagacatttaccatctattctctctaaaggctgtcacctatgaggcttcatctacataacaagaaccttggcctccacaaccactccctttatcttaagcatttatttctaaactgacttcaagtctttagacaaagcttaatactttcaaccaattgccaatcagaaaatctttgaatccacctatgacctgtaagccacgcacctcctccactccccacccagccccttccacagcttcaagatattctgcctccttaggttgaaccaatatgcaccttccatgtattgatttgattttacctacaattcctgtctccctaaaatgtaactccaacacccagtgcacactttctcaggacctcttgagactgctccttgggctatggtcactcattggcttagaataaacctctttaaaaatacttcagagtttggtttatcaacagtttaagatttattatttataaattaaatcattttgctgcctttggtactctaaaatgtgagcaaccaatcttgatttttataatgttatagagcttcttctggatttataacaccatcaactactataaattgatattttgtttctttctcatgaatttacaaaaactattccactgaaaggtgagttataaatttcaatatatcaattaaataagacggctttctttgaaatttgcaaatctataacttttaagataagtttcctagtttgatttgtaatctcataaacccagatgagatactatacttgagatggtatactaagtttcctagtttgatatgtactcttctaaacccagatgagatactatacttttgcattctgatattgactttgccagtctaaagacttccttttttctgaagggaaaatcaggaagtattcatagaatcacttgaaatattcatagaatttaagaaatagacaaggcactgtggttcacacctgtaatcccagcactttacaaggccaaggtgtgaaaactgcttgaggccaggagtttgagaccagcatgagcaacagagagagatgagaccctgtttctgtctgaatgaatgaatgaatgtcttaaattacataaaatgctaggtgtgtgaatttttttcatgctgttttgaaaatatgaggggccatccaaataaaaatttaaatttcctacccccagctccgaaaagaagttgagtcaaactacttcctgcagagctaaaagtccttgatgttgcatgactactaattttactaatctcagcagggaactgggttaactgcttgtctgtcggatgtttttaatggccaccccctatggaacaaaaatgaggagggtataaaaaagacctatgtttaaagaaagttgcctgttagatcattaaggtatgtgatacatagcacaatcactgtgttaagaaaacatgtatttgattagtacacctcagatccattaactgtggagttgacttcacagcagtaggtagcaattccactgtagctactgcacagaagccttgcacagaagagtacaggcagcaaggagctgaagagtgacagttgaacactaaaccttaggagattcaaaacatgcttgattttcgcaacgtctgcacctcagttgtacaaagttgtacaaataaagacccaaatcttaagacaaaatagcatgttcttggcaaggcacaaagcagctttctttcataaatattgacctaaataagtagattaagttggtttcaaaactttactactttttttgatcacttgatgacatgtaaattattgtatttatttaactacagtcaacagtacaaatctacatgttagttctatttataactaatgaattaatgtataagtaaacaaaattaatttaggcatgaaaagtatacagaactgtagctagctcatgattagcattaataataactatcagatagtcttataacacatccactcataatgtaataaaataaattacaagatatataattattgaaagtaatattaaagagaataatatctgttactgtctcttcagttttttcccagtcctttccataactaacaaacatcacatccactcctttgtaacaaaaatatgaacatacatttaacatgcttggtcatgtaccagtgttttagttgatgcataatgtttcactctaaatgcaatatgcttgtcacattaatgcctctaaagggacatggataaataaatgaatgaaattacattacacagactgagacacaacttggaattatcttttctctcttttaaaaatcctatgttttagataagctttgaaaattacatgcttatatttgataatcaaaatctggcagtaatgtataaagatttttttgtgcaagccacggataaaaattgtctaacaaatgaaacagatgtgttgtcagcgttgtttagggggataataacattcttactgtaagtgacaagcatgtacatgacaaaaatcctaaacatttgatctttgcttttttttttgagacggagtctcactctgtcgcccaggctgaagtgcagtggcgtgatcttggctcactgcaagctccacctcccgggttcacgccattctcctgcctcagcctcccaagtaactgggactacaggcgcccaccaccacgcctggctaattttttgtatttttagtagagatggggtttcaccgtgatagccaggatggtctcgatctcctgacctcgtgatccgcccacctcggcctcccaaagtgctgggattacaggcatgagccaccgcccctggccgttctttgctttttagtttccattaactatgccagtgaaggtctagggagacagctagttaggacataaattacacttacacacacacaaacaattattttagttttacatttccatcgaaagaaaacactaagtgattctttaacagtttcatgtctaccagaaaaggcacttccctattttgcagtgtgcacccatgttttgacatacctatatacatcatttacatacgtaaaagaagccacattaaacggcagagggctttgtaaagaattaaccttttaataagaaaaattattttcaacattaaaggaaaattgtggttacacaggcagtcagtataccatcaaactaatacaaactcttctctctatggggcaaactctactatttctaatgtattacaattctattgtattgaatatcacttcaaaaaataggtatcaaacacaggaccttacaaatcttattatatactgacttaattcataatggcatttaatttttttaaaaaaaatattttaacatggtgctttctactcaggaattacagattttcaaaatgtataatatatacttgaatttaaaatagttacatttatgatgacagaccatttatgatttccacatccagacaagatgagatagattaactttttcttatttttcctgcttaactacaaaaagctctggacgctatatataaaataagcataattccaaaatgtggagagaaggaggaagactgactagggtctttgggacccaaggaataatacagtagtgaattcctaagttttctttttgctttacatatccttggctgggtaccagaaaagccagcaacttgagaatgccaatgggtacaggtggggaaaaaaagccctaagaaagtctgctctttctaaccaaaggaccaaaaaaataataatataacaacatataaatcttttaggcaataactgccctactccagggaaacaccatggaaaaaatggcagatccacctccatccccaacagcaaaagtcaatttggaagcctacactttcaccttaccagactgtaatgaggcgacccaatttccttgctaaagttgtgacagagaaggccaaatggggagttaggattttcatccctgttggatccctggacagtcacctatacctagtgatgatggggcgtcgtactcctccttgccagggtggtgtcaatagaggcatggtggaaggtcaggactttcacccccacccagctgtaacaatatccctcctcccaagaagatgtcaacagaggctaggtggaaaatgtgaacttccagtaacaaggcagcacccctattccctaactggtacaatgtcagaggagccttactgaaacagaaattttaggaacatagtactcaaaatgtccaaaattcagtagaaaatcacccttataccaagaaccagaataatctcaacttgaatgagaaaaggcaatcatcagatgccaacaagatgtcacagatgatagacttatctgacaaatattttaaagtagccatcataaaaatgtttcaataagcaattacatacacactcttgaaacagattttaaaaaatagtctcacgaaagaaatacaaggtaactcagtagaagggcttcatagcaaaatggaaagaacagaagaaagtatcactgaacttgaagatagaaaaatataagctccccaatctgaaaaacagagaaaaaaagactgagaaaaaaacaaatagtgcttcaagggtctgtgagatcataacatctaatctgatgacttgtgtcatcagagtcccagaaggaaaagagatgagtgggactgaaaaaaattcaaaaaagtaacagcttaaaatttacccagttttggtaaaagataaacctatacctttaagaagctgggtaagccccaacaggataaaaacaaacaaatcaacagacaatcaagcttctaaaaattaaagcctaagaaaaatcttgaaagaagtgagagagaaacagctcatgacctacagaagtaaaagaaagacagcagtttctcaacagaaaccacggatgccagaaggaacaggcataacgttttccaagtgctgaaagaactgtcagcccagacttttatatctagaaaaaatatccctgaggaagaaaggaaaacccaaaacattctcaaatacaaggaaacagtctgtcaccagcatacctaccctgaaacaatggctaaaattaagttattgaaacagaacggaaatgataaaagcaggaagaacaaacatgaaaaagagtatgaatattggtaaatacaacaggtttcctttctctttttgaagtttctaaattatatttgacatttgaagtaaacactatagcactgtctaatgtggttctaaaagcatgtagaggaaacatgttataaagagtcacatgaagagcactaagatgggcacagtatcacttctgtgatagtcttaccaaaaatgcacaacctcaatctaatcatttgaaaacatcaggaaaactcaaattcaagaacattttacaaaataagtaactgattttcttcaaaagggttaagattgtgaaagaccaaagaactgatacttgattggaagagacttgagagacttgacaactaaatgcaatgtggatcctagactggattctggaccagaaaaaggacattagtaggaaaactggcaaaatttgaataaaatctgtacattagttaagagttttatatcattttaaatttcctggtagtgataattatactatggtaatataaccagtaacaataaagtcagtactattttttttacttttctgaaagtttaaaatccctttttaagggccatttacaatacgaaataaaatcattagtgctatgaattaaggagaattgaaagtagccaagagcctattaagaatagataataaacttaagtgtttctttgcatgccagaattttatatttaaagagtcttcaatcaatgaaagaagggaatctgtggggactaaattttctcttaattagaaaaacaaagtcagtggggcaatgtggtactgtctacctctgatatggaaaggaaaaagggtacagaaaaaatttctagtataaaggcctggagacttgtaatattgaaagcttcatgaaaaagaagagtaaaagctttctccttaagtcagagttttagaaaaaaaaaaaaaatagtaacataggcctatgcatgagaatcatagtaatggggaccaagaaacttaaaccaagaaacatcaatacttgctacttgatttgcaaaagataagaagaaataagttggtgcttaaactacaaatccaaattggtagcaaataccactacttatgacaggttcttttttagatagtcctatttttactctaagaaagcatttctaccactacctcaactttctcccctatcattcacttcaatgaaaaaagtttgcactaaagacaccctaacagggaacagtaaccacataaataccaactctattaggtttttctgtgcagcatttgacacagaatttgatggagagtcaggagaggctactgccccagaaactaagagaaaagaaagtccaagaagaaagaagtttggatttgagtccagccagattaagtgcctcagaaaataaaacgcaaaactattcagaggactgtaaacagaatccaaagtctctataatgtattattcacaaatgttaggatgcaatccaacattacttgccatagaataaacagaaaaaggtgatttatactcaaaagaaaaggcaatcaatagacaccaaactcaatacatctctgatgttgaaattatggggataaaaacggtgtttaatgcacctatgctaactatatttgagcatgtaaaggaaaatacatctgcaattaatgaatggatataaaatctctgcagagaaacagaaactaatgaaaaggaccatatataaattctagaaatgaaaaatataattacgcaaaataaaaaaaaatttactggattaaggagacaggagtcactgaacttataggtcaatagaaattgtacaatctgggccaggtgtggtggctcatgcctgtaatcccagcactttgggaggccaaggcaggtggatctcttgagctgaggagttcgagaccagcctgaccaatatggtgaaaccccatctctactaacaatacaaaaattagccaggtgttatggtgggtgcctgtagtcccagctattcaggaggctgaggcaagataatcgcttgaacctgggaggcggaggctgcagtgggctgaaattgcaccactgcactccagccctgggcgacagagtgaaattccatccccatccaaaaaaaaaaaaaaaaattgtacaatctgaaactaagaggaaaaaaatgaataacgcctcaaggaatctgtgggacaatatctaaaatgcatgtaaatgaagtcccagaaggaaaaagagagaaaaaaggagacagaaattatttagggaaaaaaatggccgaaaatttcccaaatttgattaaaataataaatatacagattaaaggaaaaaagagatatacagtgagatgaacagtgtaccctaaaagatatatccaagtgtgtagccctagtacctttgaatgtaaccttatttgaaaataaagtctttgcagatgtaattaaagacctgggaataagatcattctgaattttgggtagactcgaaatctaataacaagtccccttataagagacagcaaagaagaatacacatacacaaaggagaaggccatgtgaagatggaggcagaaactggaatgatgaatctacaagccaaggaaaaccaagaattgccagcagccacaaaaagctagaaaagaggcacagaacagattcttcttcagagcctctagaaggaaccaaccctgctgacactttgatttcagacttctggcctccacaactgtgagagaataaatttcttttgttcaatccattgtgtttttatgtaaccaattatgtaatgaatatcttacatttagagattttcccaaattttgaattattttatttgaacagatgtcaagtttaccagttagtaattaattagtcaattcaatgaatattttaaaagaattggtagagttccagcttctgacaacaggagaatgaattcactggacaaagtcttttgcagatatcaaagtaaaatatagacaaaataaaaaatatttgaagacactagaatgttaccaaaatcaagcagataccaccagggcagagatttccctggaaagatcaaaatgtatgcagtaagaattatgagttttgacttttttttttccatctgtgcttcttatagttctactggtggaaaactgcagtcttacccactggaggacgcagaggaaagagtttagggttggcaaatgagctagacattttgggaagaaatcccaggagaaagctgcagaagtggcacaactctaaatctgaatcttttacccaaattccagctgactgctaaacttcacatgcacaagggagatcttggaaggcccaatggaaaagtaggcagaaaccagtgagaactggttgagatttgaaagtctgctactttttgaatagagtgcagtccctaatctgaatgcagctcaaatgattgaacgctaaagctttataggcctgtagtatcagtgggtgtgtggctggcagatcagctagaaatttagaggaggaaatgccagaaagaagaaaaggcaaaaaaagtgggccccaaaatataagcataaactcagcccaaataattggctttcactatatgatgcaggcacagaggagaccataagagaaaatgctgcagttataaggtagaaatactgagtagactgtatcagctgagggataccaccatggagaagataaagcttgcagttttagcttaagcaacttaatcaaaaaccaaaaccaaaataaaaatattaatctggggaagaaatgatgatccacagttgcaatatgttatccacaatgtccatttttcaaacagaaactaaagacatgcaaaaatcaggaaaaaggtaaatcacactcatgaataaggcagtcaacagaaattgactcctaatgggcccagctgttggatttagttgacaaaaaacttcaaagcaggtatgatatagatgttcaaagaattaaatgaaaatacaatctcagtaactatacagatatggaatctcaacagagaaaaggaactacaaaaaacaaccaaatggaaatgtcagatgtgaaaaatacaacaaaatgaaaaatttattataggggctcaagagcaaactggagaggatggagggaagaatctgtaagaatccaaaacttcaaggtagatcaatagaaattacataatccaaaagactaaagaaaaataaatagagcctctgaagcctgtgggagaataacaggagatttaacacatgtgcaactggagctctaaaaggaaaggagaaaaaggtagaaaacttttttggaaaaaatagtggtccaaaacattccaaaaatggttaataaaaaacaccattttttaaccattattttacagttctaagaagctaaatgtatcccaaactagattaaaaacactcctacatgtaccataatcaaatcggtgaaaaacaaagatatacaaagtatcttaatgctttaagtattaagaggagagattccttgcttaagcctagacaaaacacaacatgacatacatggtcctgtaacaactggctatcctatgaggaaaaaaataaatttcaactcttaccccataccatacattaaaaattaactttaagtgggtcttagcattaaatataaaagctaaaagcattaaatgtccataagaaaacttaagataaaaagtctttgtgatcttaggggtagtcaaaagattcctcagattagactaagaaggcataaaccttaagggggaaaactgaaaattttacttcattgaaatggaaaaacctctgtttttcaaaggatcacgttaagataacaaaaagacaagtcatagggagggagataatatttgtaatgcaaatgacttatggccaggatacaaagaacttgtgtaaatcaataattatgggggaaaatcccaattagaaactgagtaaaagatgtggacacttcgcaaagatacacaaatgaccaataagcacatgaaatgaagctcatatcatttgtcctcagtgaaatacaaactaagatatcaatgagacaccattatactctcaataaaataagactgaccatattaacgtgtacaaccctcacacattgctggtaggaatgtaatgtatgtaatacattaaaatagaatctgaaagtttcttataacattgtatgtacacttaccatgtgatccagcaattcactctaaggtattttcccaagagaactggaaacatatgtctgcacaaaatattgtaaatcaatgttcataaacagctttatttataatggccccaaagtgaaaacaacccaaatgtccatcaacaggcaaactgaaacaatttgtggtatatatacataaaataaactaattcttagcaataaaaactactgatacatggaacatgcgtgaatttcaaaatatactgagtgaaagatgccagatacaaaactgtgaatactgtgtaattccacctatatgaaatcagtgaaaagacaaaactaatttttagtgccagaaaggattttgtggttgtctggaggtgaggaaaatcggcggcaagggcggaggcaaatcttttgcaataaagagtcccatcttgattatggtggtagtatacattttggtgactatatacatttttcaaaactcatcaaactgtacaatatgggtgtgttttatcacatgtaaattatacatcaataaggttgattaaaacacttaagtgtagttatctctgacacaactgaagacactaagtcatggtttatattttgcataatcataagtaacctcacaattaactaatttccaagcaactgttacattaggagcttaacaccatttgaatttattgtatgtgttcagatgtgtttatctgcccttgcacctacaccaaaccctcccctcttccacactaccattctgatgttagctcattgagggcagaaaccctggctatcactttcatgttatatactcagtgccaagtcgtgtacctggtccatggcaggtgctcaatacacactggttgaattcatgaataaatgaatcccttacatgttagtatgcttctggaatctcttgtaggcctttgtccattctccctgggcaatattaactgtttctatggcttcagttatatctatacactgatgactctcaaatctgtatgtaccatgttctcttactgatcaccagaccgatttcaactgcctactggacaaatccatgtgaatgtcccacaagcaattcgaattccacgtttaaaatggaacttgttaagttcctctaagtttattcatctcatccatagtaaaaataaaactttgcctaaacatctcacactcatactatctcacttactcctaaaatggtctctacttacttttcaacatatgtaaatccagcttccaccctaaccaggccagtgaaagcatcctctctgaagtcagcacaagagatcatttaattttctcaattgaaccttagacaactgtaccctagatccactcctccatgcccaacagctttgtcttaactcaatctttattctttctttcctggattcatgaaaaaccattctaattggtctttctattatcaagtctgtctctttcttgtctagttcatcttgtacactgctgacagaattatctttctgttaaccaatcatgtcacatctcttttaaagataagtcagtggtctttgtctaatggctaaaaaaattctaactcccaacaatacacacacatttttttcagcctcctcactagccacttccactttaaattattttctaaaacaccatgcccttttatgtcttcagtgctttgatgcttctgcctataattccttttcttatccaccttaaaatctgaagtattctttaaaacatatttcaaatattccctctgctatgaactcttccctaattccttcagccagaaatgttcatttccattcacaattcttgacatcactaaccacacttcgagttaacatttatcaggttatacttactatgtcatttattatgtggggtaggcattacaaacattatttcttgcaccatgctacaaacatttaactatttttataagaccattgtgtaatgtttgaacactgatcccaggagacaggatttgtggccgtgggttatcttcttctgcatattgattttatttgcctgtcagtctccaacttgaccataactccccgagtccaaagtttagcatgtttagcaagtttagcatgctacccagcatttgtaggcctttaatgagtactgcccagtgtgagcaaacaaatgttccatgtcctgtgcttcagctgaatcagttccaatgttcaacgggatggcattctatgggcagattaacttcatatccatctaattcttcatatacatgctgaaattatggaaacctcttcacaatatactatctaccacctatctttcccttagtaagagtttttcaaactgtaaacctagtactgttttccagcaatggttcaaatgttccattttaggacttgattctagactttattttgagacagagtcttgctctgtctgttgtccaggttgtattacaggtgtgagccacctcatccagcctgtacttttcttatgcttttaaaaaaatagataatactacagataaaaaaaaaatttggaagtttttcaagtatgtgttttctctgacagttaaatctgctttttgatgtgactatattaagatggcagaactttctagaacctaaaatctgtcagggtttaaaatcaagtaaaaacaagtaaactacattactaatatgatgtttgatgtatgtattcccaaatgtgtttacatataaaattttacattagaataaaatctaaagtcccttccatctcaaaggagtcagaattcttttttttttttttttaatatatattttttgagacagagtctcacactgtcgcccaggctggagtccagtggtgcaatcttggctcactgcaagctccgcctcttgggttcacaccattctgttgcctcagcctccctagtagctgggactccaggcgcccgccaccatgcctggctaattttttgtatttttagtagagacggggtttcaccgtgttagccaggatggtttcgatctcctgacctcgtgatccgcccgccttggcctcccaaagtgcagggattacaggcatgagccaccacacctggccctattgatttttttgaaacagggtcttgctctgtcatccaagctggagtgcagtggtggggtcttggctcactgcacttccgcctccctggttcaagcacttctcctgcctcagtctcccagtagctgggattacaggtgcctgccaccatgcctggctaatttttgtttggttttctttttttttttttttttttttttggtagagacagagtttcaccatgttggccaggttggtctcaaactcctgacctcaagtgatctggctgccttggcctcccaaagtactgggattacaggcatgagccaccatgcccagccaaggagtcagaattcttaaatggcttactcagttgtatatatagttgagggcagaaataaatttattaatgaaatctatgacaaaaacaaaccaatatccagaagactatgggccaccaccacacattagtcctacttacagggactggtcttcaaacattatacaatagctttcttcaaaatcaaataaaagatttgtaggcaaaaacataccaggtattctgaaataatatatgtaatgcctacttcactatgggatatgtgagtccatcaataactgtcagtttcctccctagtttatccatatatcccctaaatgcatgcccctgttatgtcagagcaattttttgagtatgcaaaaatcttttacatgcaacattccacatactgttctttcttaagagttgccttgggtgagaagagaacaatacatatgaaatttcagccactgtcatttgtggggaaaaaaaaatctccttagatatagctggatgctggagaaagggaaatgctggactcacttcaacatgacttggaatgagtgtaggtatacagctgccatccacctgaagagtaccataattaattatatgtcaggaaaaattacatcattgtcaatcgtttctagcaaaaggaaatgtaatgcatctttagatgaaaaataattttttccttcaaatacttgatttttcaaataattccaagtagtagaattttcatgttgagttgaaatctcttctgatacaaacagaaaaggttatcagatagttctacttggaaaggacacgaaatgataatcatctttttctgtatcatgatggctcatttcagatctacattaaagtttctttggttggaaaagctcttacagtgtttgtatattacttagattttgttgaactatcttgtgtgtcttactatgtatgtgctggtgcataaaggctcaaaataagtatcatagcaacatagtttacgcagtaataatggactgttttgctcaaggcctgcttgattcttacctgtattactgttactcattgtagtttttatatgcaccaggatttctttcttcaaacatagtattttttttttacagggtttaaaatttcagtaaaatgagctgatctacaattctgctggtttttatggaagtacaggtgtgtgttatgtttgcatatcccttggactttggcctgcatatcaaagtctaaggacaccagacacaacaggtcagtttgcatgaactggggctgcccactggaataacaaacctgagtgttaatgtcactaaaggaagaccaagccttcaagagagttctaacacatacttaagtctttccaaggtccttggaaggtagtagaggtcaaattcaagagagctttttaagaatttttaagattttaatggcaaatcagagcagtatctgctgaccaaacccacaaatgtgttttgctcattgtagtctaagtaatttattatggttttatacatttgtttaatagcctacatgaacatttggtctcagaggcaacacagtaagttatgtttcaatgacaaattaaaaataagggaaaacacacagttgggccctccatatccatgggctatgcatccaaatatcaaaaatattaaaaaagaattgaaaaaaaaccacaaaaaagcaatatggtataaccattatttatatagcatttacattatattaggtattataaggcatctagacatgatttaaagtataagggaggatgtgtgtaggttatatgtaaatactacaacattttatataagggacttgagcgtccatgaactttggtatctttgggggtcctagaaccaatccttcctgcagataccaagagacaactatattcctaaatgtgggtgtgtatgtacatgcattatttctttctccatattctcctaagaggaatttacaaaattgtacttgtattgatctcctaacaaaaatgaataccttattctaaaaaaaaaaaaaaagctgctgcaaatagccaccttgatgataactatatggattggaaaacatgaggtataggagagataagaataaataggtgaaaggttgattctcagattctcagggagaccagccaccacccccccacttccaccagccccatcccaatataacctatactaagtcatattgttaaaaaataaatacttaaaagaagcctgtggctataaaaacctgctatcatcatattaaactccacaaaaggaggcatatgagttgaaatgtattcagcgtgaattatatttgaaaaggaagattttaatttaagtggacaatctcatcttgctggaaatggcatgattatgatcaataatgaaatgcccctccataaaacactccctgattttggacaataaactaattatagtttaactaaaacaccaactaagtgtttctttatattatttatgtgagggaaaaaacctagtttgttacactatactcggaaggtttcacaaacaacactgttacagtggatgatgctcacaggagaggcacagaatagcaaactgaaatgaaatccatctagaagggacgatttgctaaaataatccactttcattttcaacctaatttttaatgactagtttaaacaaagaaaccacttatatttatagatttctaatataattagcatagaaaagcatattaaagatgtgaaaacttaaaataatgcaaagtacaacatgaaacaaattctttcacttcagctcaaatgcacagcatttcaagagtgtcttttgcataataagtttctttaaaaagctgaatgattttgaaacattttgccattatagtaaaagtgtacacaacaaggaaccctgaaacactatggtaggactacaactttgaatgagttcttataaaatgtgtagaagttacagaagcatacgattaggctgaacaacaaagtctgaagttcacagaactactgaataaaacatttaaaagaatataaataaaacgtattaatacttgataaaacttgaaagaaataaacattcatttctgacagagatccaaaaggttcgattctaaaatacgataaaaactttaggtgagaccaaacaagaataacagaactgctgagaatgtgtaagtgttcggtcacattctgctctcttaagtcagttttattaataactttaattgtataataattttacctattttgtaggtttaaaagaatttgagcttggatacctacattcagttgatcaaagtagctttttgtaatttataaattcaaattaaagactgggtgatgaaacaaaattaaaagttaaaacaactttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctccc

SEQ ID NO: 2336 - DNA, 326560 bp, Homo sapiens; identical to SEQ ID NO: 2335

SEQ ID NO: 2337 - DNA, 326560 bp, Homo sapiens; identical to SEQ ID NO: 2335

SEQ ID NO: 2338 - DNA, 326560 bp, Homo sapiens; identical to SEQ ID NO: 2335
